United States Patent
Hatchwell et al.

(10) Patent No.: US 10,240,205 B2
(45) Date of Patent: Mar. 26, 2019

(54) METHODS FOR ASSESSING RISK OF DEVELOPING A VIRAL DISEASE USING A GENETIC TEST

(71) Applicants: Population Bio, Inc., Melville, NY (US); The Université Paris-Sud, Orsay (FR); The Assistance Publique—Hôpitaux de Paris (APHP), Paris (FR); The Institut National de la Santé et de la Recherche Médicale (INSERM), Paris (FR); PML Screening, LLC, Newport Beach, CA (US)

(72) Inventors: Eli Hatchwell, Winchester (GB); Peggy S. Eis, Fitchburg, WI (US); Edward B. Smith, III, New York, NY (US); Yassine Taoufik, Paris (FR)

(73) Assignees: Population Bio, Inc., New York, NY (US); The Universite Paris-Sud (FR); The Assistance Publique—Hopitaux de Paris (APHP) (FR); The Institut National de la Sante et de la Recherche Medicale (INSERM) (FR); PML Screening, LLC, Newport Beach, CA (US)

( * ) Notice: Subject to any disclaimer, the term of this patent is extended or adjusted under 35 U.S.C. 154(b) by 0 days.

(21) Appl. No.: 15/639,591

(22) Filed: Jun. 30, 2017

(65) Prior Publication Data

US 2018/0223360 A1 Aug. 9, 2018

Related U.S. Application Data

(60) Provisional application No. 62/454,676, filed on Feb. 3, 2017, provisional application No. 62/524,324, filed on Jun. 23, 2017.

(51) Int. Cl.
*C12Q 1/6883* (2018.01)
*C07K 16/28* (2006.01)
*G01N 33/569* (2006.01)
*A61K 39/00* (2006.01)

(52) U.S. Cl.
CPC ........ *C12Q 1/6883* (2013.01); *C07K 16/2839* (2013.01); *G01N 33/56983* (2013.01); *A61K 2039/54* (2013.01); *A61K 2039/545* (2013.01); *C12Q 2600/106* (2013.01); *C12Q 2600/118* (2013.01); *C12Q 2600/156* (2013.01); *G01N 2333/025* (2013.01)

(58) Field of Classification Search
None
See application file for complete search history.

(56) References Cited

U.S. PATENT DOCUMENTS

| | | |
|---|---|---|
| 3,625,214 A | 12/1971 | Higuchi |
| 4,683,195 A | 7/1987 | Mullis et al. |
| 4,789,734 A | 12/1988 | Pierschbacher |
| 4,897,268 A | 1/1990 | Tice et al. |
| 4,906,474 A | 3/1990 | Langer et al. |
| 4,925,673 A | 5/1990 | Steiner et al. |
| 4,992,445 A | 2/1991 | Lawter et al. |
| 5,001,139 A | 3/1991 | Lawter et al. |
| 5,023,252 A | 6/1991 | Hseih |
| 5,075,109 A | 12/1991 | Tice et al. |
| 5,143,854 A | 9/1992 | Pirrung et al. |
| 5,190,029 A | 3/1993 | Byron et al. |
| 5,223,409 A | 6/1993 | Ladner et al. |
| 5,272,071 A | 12/1993 | Chappel |
| 5,288,514 A | 2/1994 | Ellman |
| 5,376,359 A | 12/1994 | Johnson |
| 5,384,261 A | 1/1995 | Winkler et al. |
| 5,424,186 A | 6/1995 | Fodor et al. |
| 5,445,934 A | 8/1995 | Fodor et al. |
| 5,451,683 A | 9/1995 | Barrett et al. |
| 5,510,270 A | 4/1996 | Fodor et al. |
| 5,527,681 A | 6/1996 | Holmes |
| 5,665,549 A | 9/1997 | Pinkel et al. |
| 5,700,637 A | 12/1997 | Southern |
| 5,744,305 A | 4/1998 | Fodor et al. |
| 5,776,434 A | 7/1998 | Purewal et al. |
| 5,811,128 A | 9/1998 | Tice et al. |
| 5,814,344 A | 9/1998 | Tice et al. |
| 5,820,883 A | 10/1998 | Tice et al. |
| 5,837,832 A | 11/1998 | Chee et al. |

(Continued)

FOREIGN PATENT DOCUMENTS

| | | |
|---|---|---|
| CN | 1733937 A | 2/2006 |
| CN | 101148684 A | 3/2008 |

(Continued)

OTHER PUBLICATIONS

D'Amico et al. Treatment-Related Progressive Multifocal Leukoencephalopathy in Multiple Sclerosis: A Comprehensive Review of Current Evidence and Future Needs. Drug Saf (2016) 39:1163-1174.*

(Continued)

*Primary Examiner* — Nianxiang Zou
(74) *Attorney, Agent, or Firm* — Wilson Sonsini Goodrich & Rosati

(57) ABSTRACT

This document provides methods and materials related to treating a disease. For example, this document provides methods for treating a subject's disease based on identifying the risk of progressive multifocal leukoencephalopathy PML using a genetic test.

27 Claims, 16 Drawing Sheets

Specification includes a Sequence Listing.

(56) References Cited

U.S. PATENT DOCUMENTS

| | | |
|---|---|---|
| 5,853,763 A | 12/1998 | Tice et al. |
| 5,858,659 A | 1/1999 | Sapolsky et al. |
| 5,928,647 A | 7/1999 | Rock |
| 5,942,252 A | 8/1999 | Tice et al. |
| 5,945,334 A | 8/1999 | Besemer et al. |
| 6,040,138 A | 3/2000 | Lockhart et al. |
| 6,054,270 A | 4/2000 | Southern |
| 6,146,834 A | 11/2000 | Schaad et al. |
| 6,207,392 B1 | 3/2001 | Weiss et al. |
| 6,210,878 B1 | 4/2001 | Pinkel et al. |
| 6,251,607 B1 | 6/2001 | Tsen et al. |
| 6,300,063 B1 | 10/2001 | Lipshutz et al. |
| 6,423,499 B1 | 7/2002 | Song et al. |
| 6,429,027 B1 | 8/2002 | Chee et al. |
| 6,733,977 B2 | 5/2004 | Besemer et al. |
| 6,858,394 B1 | 2/2005 | Chee et al. |
| 6,858,412 B2 | 2/2005 | Willis et al. |
| 6,892,141 B1 | 5/2005 | Nakae et al. |
| 6,916,621 B2 | 7/2005 | Shah |
| 6,951,761 B2 | 10/2005 | Star et al. |
| 6,969,589 B2 | 11/2005 | Patil et al. |
| 6,977,148 B2 | 12/2005 | Dean et al. |
| 7,011,949 B2 | 3/2006 | Amorese et al. |
| 7,014,997 B2 | 3/2006 | Knoll et al. |
| 7,030,231 B1 | 4/2006 | Craik et al. |
| 7,034,144 B2 | 4/2006 | Van Dongen et al. |
| 7,238,484 B2 | 7/2007 | Pinkel et al. |
| 7,364,858 B2 | 4/2008 | Barany et al. |
| 7,424,368 B2 | 9/2008 | Huang et al. |
| 7,702,468 B2 | 4/2010 | Chinitz et al. |
| 7,910,353 B2 | 3/2011 | Shaffer et al. |
| 7,957,913 B2 | 6/2011 | Chinitz et al. |
| 7,998,744 B2 | 8/2011 | Stevenson et al. |
| 8,367,417 B2 | 2/2013 | Stevenson et al. |
| 8,655,599 B2 | 2/2014 | Chinitz et al. |
| 8,862,410 B2 | 10/2014 | Hatchwell et al. |
| 10,059,997 B2 | 8/2018 | Hatchwell et al. |
| 2002/0012921 A1 | 1/2002 | Stanton |
| 2002/0012930 A1 | 1/2002 | Rothberg et al. |
| 2003/0023070 A1 | 1/2003 | Ni et al. |
| 2003/0049663 A1 | 3/2003 | Wigler et al. |
| 2003/0068629 A1 | 4/2003 | Rothberg et al. |
| 2003/0082606 A1 | 5/2003 | Lebo et al. |
| 2003/0100102 A1 | 5/2003 | Rothberg et al. |
| 2003/0148344 A1 | 8/2003 | Rothberg et al. |
| 2003/0207295 A1 | 11/2003 | Gunderson et al. |
| 2003/0215821 A1 | 11/2003 | Gunderson et al. |
| 2004/0018491 A1 | 1/2004 | Gunderson et al. |
| 2004/0137473 A1 | 7/2004 | Wigler et al. |
| 2004/0157243 A1 | 8/2004 | Huang et al. |
| 2004/0197774 A1 | 10/2004 | Wigler et al. |
| 2004/0248161 A1 | 12/2004 | Rothberg et al. |
| 2005/0032095 A1 | 2/2005 | Wigler et al. |
| 2005/0037393 A1 | 2/2005 | Gunderson et al. |
| 2005/0037414 A1 | 2/2005 | Lee et al. |
| 2005/0079510 A1 | 4/2005 | Berka et al. |
| 2005/0100893 A1 | 5/2005 | Gunderson et al. |
| 2005/0100932 A1 | 5/2005 | Lapidus et al. |
| 2005/0112595 A1 | 5/2005 | Zhao |
| 2005/0124022 A1 | 6/2005 | Srinivasan et al. |
| 2005/0196799 A1 | 9/2005 | Wigler et al. |
| 2005/0233339 A1 | 10/2005 | Barrett et al. |
| 2005/0266444 A1 | 12/2005 | Wigler et al. |
| 2005/0282196 A1 | 12/2005 | Costa |
| 2006/0012784 A1 | 1/2006 | Ulmer |
| 2006/0012793 A1 | 1/2006 | Harris |
| 2006/0024678 A1 | 2/2006 | Buzby |
| 2006/0024711 A1 | 2/2006 | Lapidus et al. |
| 2006/0063168 A1 | 3/2006 | Albertson et al. |
| 2006/0078909 A1 | 4/2006 | Srinivasan et al. |
| 2006/0134674 A1 | 6/2006 | Huang et al. |
| 2007/0141577 A1 | 6/2007 | Moore |
| 2007/0207141 A1 | 9/2007 | Lieberburg |
| 2007/0207481 A1 | 9/2007 | Wigler et al. |
| 2007/0259351 A1 | 11/2007 | Chinitz et al. |
| 2008/0131887 A1 | 6/2008 | Stephan et al. |
| 2008/0305967 A1 | 12/2008 | Ward et al. |
| 2009/0026082 A1 | 1/2009 | Rothberg et al. |
| 2009/0098547 A1 | 4/2009 | Ghosh |
| 2009/0127589 A1 | 5/2009 | Rothberg et al. |
| 2009/0170712 A1 | 7/2009 | Beatty et al. |
| 2009/0304653 A1 | 12/2009 | Messier |
| 2010/0003685 A1 | 1/2010 | Aasly et al. |
| 2010/0028931 A1 | 2/2010 | Eggan et al. |
| 2010/0035252 A1 | 2/2010 | Rothberg et al. |
| 2010/0120046 A1 | 5/2010 | Brennan et al. |
| 2010/0137143 A1 | 6/2010 | Rothberg et al. |
| 2010/0167286 A1 | 7/2010 | Reijo Pera et al. |
| 2010/0188073 A1 | 7/2010 | Rothberg et al. |
| 2010/0197507 A1 | 8/2010 | Rothberg et al. |
| 2010/0227768 A1 | 9/2010 | Wigler et al. |
| 2010/0248236 A1 | 9/2010 | Chinitz et al. |
| 2011/0021366 A1 | 1/2011 | Chinitz et al. |
| 2011/0111014 A1 | 5/2011 | Langston |
| 2011/0130337 A1 | 6/2011 | Eriksson et al. |
| 2011/0264376 A1 | 10/2011 | Chinitz et al. |
| 2011/0311512 A1 | 12/2011 | Hakonarson et al. |
| 2012/0059594 A1 | 3/2012 | Hatchwell et al. |
| 2012/0100995 A1 | 4/2012 | Scherer et al. |
| 2013/0247249 A1 | 9/2013 | Singh et al. |
| 2013/0305410 A1 | 11/2013 | Bent et al. |
| 2013/0316911 A1 | 11/2013 | Scherer |
| 2014/0088882 A1 | 3/2014 | Chinitz et al. |
| 2014/0155271 A1 | 6/2014 | Hatchwell et al. |
| 2014/0161721 A1 | 6/2014 | Hatchwell et al. |
| 2014/0162894 A1 | 6/2014 | Hatchwell et al. |
| 2014/0162933 A1 | 6/2014 | Hatchwell et al. |
| 2014/0208449 A1 | 7/2014 | Malek |
| 2015/0051086 A1 | 2/2015 | Hatchwell et al. |
| 2015/0132295 A1 | 5/2015 | Hatchwell et al. |
| 2016/0019336 A1 | 1/2016 | Chinitz et al. |
| 2017/0253930 A1 | 9/2017 | Hatchwell et al. |

FOREIGN PATENT DOCUMENTS

| | | |
|---|---|---|
| CN | 101403008 | 4/2009 |
| CN | 103436606 | 12/2013 |
| EP | 0373203 B1 | 8/1994 |
| EP | 0619321 A1 | 10/1994 |
| KR | 20090080105 A | 7/2009 |
| KR | 20110114664 A | 10/2011 |
| WO | WO-9002809 A1 | 3/1990 |
| WO | WO-9106667 A1 | 5/1991 |
| WO | WO-9117271 A1 | 11/1991 |
| WO | WO-9201047 A1 | 1/1992 |
| WO | WO-9209690 A2 | 6/1992 |
| WO | WO-9210092 A1 | 6/1992 |
| WO | WO-9215679 A1 | 9/1992 |
| WO | WO-9218619 A1 | 10/1992 |
| WO | WO-9220791 A1 | 11/1992 |
| WO | WO-9209690 A3 | 12/1992 |
| WO | WO-9301288 A1 | 1/1993 |
| WO | WO-9322684 A1 | 11/1993 |
| WO | WO-9511995 A1 | 5/1995 |
| WO | WO-9820019 A1 | 5/1998 |
| WO | WO-02099129 A2 | 12/2002 |
| WO | WO-03048318 A2 | 6/2003 |
| WO | WO-2004018633 A2 | 3/2004 |
| WO | WO-2004044225 A2 | 5/2004 |
| WO | WO-2004075010 A2 | 9/2004 |
| WO | WO-2005042763 A2 | 5/2005 |
| WO | WO-2005068664 A2 | 7/2005 |
| WO | WO-2005108997 A1 | 11/2005 |
| WO | WO-2004044225 A3 | 4/2006 |
| WO | WO-2006050475 A2 | 5/2006 |
| WO | WO-2006091254 A1 | 8/2006 |
| WO | WO-2006116873 A1 | 11/2006 |
| WO | WO-2007070640 A2 | 6/2007 |
| WO | WO-2007070640 A3 | 8/2007 |
| WO | WO-2007129000 A2 | 11/2007 |
| WO | WO-2007131135 A2 | 11/2007 |
| WO | WO-2008016374 A2 | 2/2008 |
| WO | WO-2007129000 A3 | 3/2008 |
| WO | WO-2007131135 A3 | 11/2008 |

(56) References Cited

FOREIGN PATENT DOCUMENTS

| | | |
|---|---|---|
| WO | WO-2009038684 A1 | 3/2009 |
| WO | WO-2009043178 A1 | 4/2009 |
| WO | WO-2009073764 A1 | 6/2009 |
| WO | WO-2010036353 A2 | 4/2010 |
| WO | WO-2010056897 A1 | 5/2010 |
| WO | WO-2010124101 A2 | 10/2010 |
| WO | WO-2011012672 A1 | 2/2011 |
| WO | WO-2011035012 A2 | 3/2011 |
| WO | WO-2011112961 A1 | 9/2011 |
| WO | WO-2012023519 A1 | 2/2012 |
| WO | WO-2012027491 A1 | 3/2012 |
| WO | WO-2012047234 A1 | 4/2012 |
| WO | WO-2013067451 A2 | 5/2013 |
| WO | WO-2013071119 A2 | 5/2013 |
| WO | WO-2014043519 A1 | 3/2014 |
| WO | WO-2015131078 A1 | 9/2015 |
| WO | WO-2018158632 A2 | 9/2018 |

OTHER PUBLICATIONS

Serana et al. Immunological biomarkers identifying natalizumab-treated multiple sclerosis patients at risk of progressive multifocal leukoencephalopathy. Journal of Neuroimmunology 277 (2014) 6-12.*

Antoniol, et al., Immunological markers for PML prediction in MS patients treated with natalizumab. Frontiers in Immunology. Jan. 2015; 5(668): pp. 1-9.

Bowen, et al., HIV-associated opportunistic CNS infections: pathophysiology, diagnosis and treatment.Nat Rev Neurol. Oct. 27, 2016;12(11):662-674. doi: 10.1038/nrneurol.2016.149.

Calabrese, et al., Sorting out the risks in progressive multifocal leukoencephalopathy. Nat Rev Rheumatol. Feb. 2015;11(2):119-23. doi: 10.1038/nrrheum.2014.167. Epub Oct. 14, 2014.

Calabrese, et al., Sorting out the risks in progressive multifocal leukoencephalopathy. Nat. Rev. Rheumatol. advance online publication Oct. 14, 2014; pp. 1-5.

Chahin, et al., A risk classification for immunosuppressive treatment-associated progressive multifocal leukoencephalopathy. J. Neurovirol. (2015) 21:623-631 DOI 10.1007/s13365-014-0303-1.

Chinn, et al., Severe combined immunodeficiency disorders. Immunol Allergy Clin N Am 35 (2015) 671-694.

Colin et al.,Drug-induced progressive multifocal leukoencephalopathy: a case/noncase study in the French pharmacovigilance database. Fundam Clin Pharmacol. Oct. 13, 2016: pp. 1-8.

Day-Williams, et al., Whole Genome Sequencing Reveals a Chromosome 9p Deletion Causing DOCK8 Deficiency in an Adult Diagnosed with Hyper IgE Syndrome Who Developed Progressive Multifocal Leukoencephalopathy. J Clin Immunol (2015) 35:92-96; DOI 10.1007/s10875-014-0114-4.

Durandy, et al., Primary antibody deficiencies.Nature Reviews: Immunology. Jul. 2013; 13: pp. 519-533.

Durandy, et al., Supplementary Information Table 1. Nature Reviews: Immunology. Jul. 2013; 1 page.

Durandy, et al., Supplementary Information Table 2. Nature Reviews: Immunology. Jul. 2013; 1 page.

Gagne, et al. Natalizumab-related PML 2 weeks after negative anti-jcv antibody assay. Neurology. 2016; 86:484-486.

Hatchwell, E. Is there a (host) genetic predisposition to progressive multifocal leukoencephalopathy? Frontiers in Immunology. May 2015; 6(216): pp. 1-5.

Jelcic, et al., Broadly neutralizing human monoclonal JC polyomavirus VP1—specific antibodies as candidate therapeutics for progressive multifocal leukoencephalopathy. Science Translational Medicine Sep. 23, 2015: vol. 7, Issue 306, pp. 306ra150 DOI: 10.1126/scitranslmed.aac8691.

Kalamtas, et al. Evaluation of serum JCV-Test and INDEX values in Natalizumab-treated individuals. American Neurological Association. 2015; S63:S507.

Maas, et al., Drug-associated progressive multifocal leukoencephalopathy: a clinical, radiological, and cerebrospinal fluid analysis of 326 cases. J Neurol. Oct. 2016;263(10):2004-21. doi: 10.1007/s00415-016-8217-x. Epub Jul. 11, 2016.

Melis, et al., Drug-Induced Progressive Multifocal Leukoencephalopathy: A Comprehensive Analysis of the WHO Adverse Drug Reaction Database. CNS Drugs Oct. 2015, vol. 29, Issue 10, pp. 879-891.

Milner, et al. The cup runneth over: lessons from the ever-expanding pool of primary immunodeficiency diseases. Nature Reviews. Immunology, Sep. 2013; 13: pp. 635-648.

Multiple Sclerosis. Special Interest Group Symposia 5. Session abstract. Sep. 27, 2015.

Pavlovic, et al., Progressive multifocal leukoencephalopathy: current treatment options and future perspectives. Ther Adv Neurol Disord 2015, vol. 8(6) 255-273 DOI: 10.1177/1756285615602832.

Ray, et al., JC polyomavirus mutants escape antibody-mediated neutralization. Science Translational Medicine Sep. 23, 2015: vol. 7, Issue 306, pp. 306ra151 DOI: 10.1126/scitranslmed.aab1720.

Reinke, T., MS Drug going generic without making waves. Medication Management. Jun. 2015.11 pages.

Schwab, et al., Therapy with natalizumab is associated with high JCV seroconversion and rising JCV index values. American Academy of Neurology. 2016. pp. 1-8.

Spelman, et al., Comparative efficacy of first-line natalizumab vs IFN-B or glatiramer acetate in relapsing MS. Neurology clinical practice. 2016. pp. 102-115.

Zerbe, et al., Progressive Multifocal Leukoencephalopathy in Primary Immune Deficiencies: Stat1 Gain of Function and Review of the Literature. IDSA 2016. pp. 1-9.

Abravaya, et al. Detection of point mutations with a modified ligase chain reaction (GAP-LCR). Nucleic Acids Research. 1995;23(4):675-682.

Agami, R. RNAi and related mechanisms and their potential use for therapy. Curr Opin Chem Biol. Dec. 2002;6(6):829-34.

Agarwal et al., Novelty in the target landscape of the pharmaceutical. Nat. Rev. Drug Discovery 12(8):575-6 (2013).

Aitman, et al. Copy number polymorphism in Fcgr3 predisposes to glomerulonephritis in rats and humans. Nature. Feb. 16, 2006;439(7078):851-5.

Albertson, et al. Profiling breast cancer by array CGH. Breast Cancer Res Treat. Apr. 2003;78(3):289-98.

Alexander Zimprich, et al., A mutation in, encoding a subunit of the retromer complex, causes late-onset parkinson disease, American journal of human genetics, American society of human genetics. Jun. 2011; 89(1):168-175.

Altschul, et al. Gapped BLAST and PSI-BLAST: a new generation of protein database search programs. Nucleic Acids Res. Sep. 1, 1997;25(17):3389-402.

Amarzguioui, et al. Approaches for chemically synthesized siRNA and vector-mediated RNAi. Febs Lett. Oct. 31, 2005;579(26):5974-81. Epub Sep. 20, 2005.

Ansel et al., Pharmaceutical Dosage Forms and Drug Delivery Systems (Lippencott Williams & Wilkins, Baltimore Md. (1999).

Arakawa, et al. Advances in characterization of neuroprotective peptide, humanin. Curr Med Chem. 2011;18(36):5554-63.

Ausubel (Ed.), Current Protocols in Molecular Biology (2007 John Wiley & Sons, NY).

Ausubel, et al. Current Protocols in Molecular Biology. John Wiley & Sons, New York, 1999.

Bailey, et al. Analysis of Segmental Duplications and Genome Assembly in the Mouse. Genome Res. 2004; 14:789-801.

Bakkaloglu, et al. Molecular cytogenetic analysis and resequencing of contactin associated protein-like 2 in autism spectrum disorders. Am J Hum Genet. Jan. 2008;82(1):165-73.

Bangham et al. Diffusion of univalent ions across the lamellae of swollen phospholipids. J. Mol. Biol. 1965;13:238-252.

Bedell, et al. In vivo genome editing using a high-efficiency TALEN system. Nature. Sep. 23, 2012. doi: 10.1038/nature11537. [Epub ahead of print].

Bennett, C. Efficiency of antisense oligonucleotide drug discovery. Antisense Nucleic Acid Drug Dev. Jun. 2002;12(3):215-24.

(56) References Cited

OTHER PUBLICATIONS

Berkel, et al. Mutations in the SHANK2 synaptic scaffolding gene in autism spectrum disorder and mental retardation. Nat Genet. Jun. 2010;42(6):489-91. Epub May 16, 2010.

Bernard, et al. Sequence of the murine and human cellular myc oncogenes and two modes of myc transcription resulting from chromosome translocation in B lymphoid tumours. EMBO J. 1983;2(12):2375-83.

Bernstein, et al. Role for a bidentate ribonuclease in the initiation step of Rna interference. Nature. Jan. 18, 2001;409(6818):363-6.

Betancur, et al. The emerging role of synaptic cell-adhesion pathways in the pathogenesis of autism spectrum disorders. Trends Neurosci. Jul. 2009;32(7):402-12. doi: 10.1016/j.tins.2009.04.003. Epub Jun. 21, 2009.

Bier, et al. DNA microarrays. Adv Biochem Eng Biotechnol. 2008;109:433-53.

Biomarkers Definitions Working Group. Biomarkers and surrogate endpoints: preferred definitions and conceptual framework. Clin Pharmacol Ther. Mar. 2001;69(3):89-95.

Bochukova, et al. Large, rare chromosomal deletions associated with severe early-onset obesity. Nature. Feb. 4, 2010;463(7281):666-70. Epub Dec. 6, 2009.

Bodmer, et al. Common and rare variants in multifactorial susceptibility to common diseases. Nat Genet. Jun. 2008;40(6):695-701.

Bodzioch, et al. Evidence for potential functionality of nuclearly-encoded humanin isoforms. Genomics. Oct. 2009;94(4):247-56. Epub May 27, 2009.

Bosher, et al. RNA interference: genetic wand and genetic watchdog. Nat Cell Biol. Feb. 2000;2(2):E31-6.

Bremer, et al. Copy number variation characteristics in subpopulations of patients with autism spectrum disorders. Am J Med Genet B Neuropsychiatr Genet. Mar. 2011;156(2):115-24. doi: 10.1002/ajmg.b.31142. Epub Dec. 8, 2010.

Brummelkamp, et al. A system for stable expression of short interfering RNAs in mammalian cells. Science. Apr. 19, 2002;296(5567):550-3. Epub Mar. 21, 2002.

Bult, et al. The Mouse genome Database (MGD): mouse biology and model systems. Nucleic Acids Research. 2008; 36 Database Issue: D724-D728. doi:10.1093/nar/gkm961.

Bych, et al., The iron-sulphur protein Ind1 is required for effective complex I assembly. The EMBO Journal (2008) 27, 1736-174.

Calvo, et al. High-throughput, pooled sequencing identifies mutations in NUBPL and FOXRED1 in human complex I deficiency. Nat Genet. Oct. 2010;42(10):851-8. Epub Sep. 5, 2010.

Carles Vilario-Guell, et al., Mutations in Parkinson disease, American journal of human genetics, american society of human genetics. Jun. 2011; 89(1):162-167.

Chan, et al., Identification of key residues essential for the structural fold and receptor selectivity within the A-chain of human gene-2 (H2) relaxin. The Journal of Biological Chemistry vol. 287, No. 49, pp. 41152-41164, Nov. 30, 2012.

Chavanpatil et al. Novel sustained release, swellable and bioadhesive gastroretentive drug delivery system for olfoxacin. International Journal of Pharmaceutics. 2006;316(1-2):86-92.

Chen, et al., Identification of small molecule agonists of human relaxin family receptor 1 (RXFP1) by utilizing a homogenous cell-based cAMP assay.

Chen, et al. The evolution of gene regulation by transcription factors and microRNAs. Nat Rev Genet. Feb. 2007;8(2):93-103.

Chen, H. Clinical development of antisense oligonucleotides as anti-cancer therapeutics. Methods Mol Med. 2003;75:621-36.

Chi, et al. Genomewide view of gene silencing by small interfering RNAs. Proc Natl Acad Sci U S A. May 27, 2003;100(11):6343-6. Epub May 2, 2003.

Ching, et al., Integrated analysis of copy number and loss of heterozygosity in primary breast carcinomas using high-density SNP array. International journal of oncology, 2011; 39:621-633.

CNV: 14q23.3 summary output from https://gene.sfari.org/database/cnv/14q23.3 Nov. 30, 2017, pp. 1-3. (year: 2017).

Conrad, et al. Origins and functional impact of copy number variation in the human genome. Nature. Apr. 1, 2010;464(7289):704-12. Epub Oct. 7, 2009.

Co-pending U.S. Appl. No. 15/279,012, filed Sep. 28, 2016.

Copy Number Variants summary for 12q23.3-q24.13 from gene.sfari.org/database/cnv/, two pages printed on Dec. 2, 2017. (Year:2017).

Corti, et al. What Genetics tells us about the causes and mechanisms of parkinson's disease. Physiological reviews.Oct. 2011; 91(4): 1161-1218.

Coskun, et al., A Mitochondrial Etiology of Alzheimer and Parkinson Disease. Biochim Biophys Acta. May 2012 ; 1820(5): 553-564. doi:10.1016/j.bbagen.2011.08.008.

Crespi, et al. Association testing of copy number variants in schizophrenia and autism spectrum disorders. J Neurodev Disord. May 30, 2012;4(1):15. doi: 10.1186/1866-1955-4-15.

Cronin, et al. Analysis of genome-wide copy number variation in Irish and Dutch ALS populations. Hum Mol Genet. Nov. 1, 2008;17(21):3392-8. Epub Aug. 7, 2008.

Daruwala, et al. A versatile statistical analysis algorithm to detect genome copy number variation. Proc Natl Acad Sci U S A. Nov. 16, 2004;101(46):16292-7. Epub Nov. 8, 2004.

De Krom, et al. A common variant in DRD3 receptor is associated with autism spectrum disorder. Biol Psychiatry. Apr. 1, 2009;65(7):625-30. doi: 10.1016/j.biopsych.2008.09.035. Epub Dec. 5, 2008.

Desmet, et al., Human Splicing Finder: an online bioinformatics tool to predict splicing signals. Nucleic Acids Research, 2009, vol. 37, No. 9 e67.

Dias, et al. Antisense oligonucleotides: basic concepts and mechanisms. Mol Cancer Ther. Mar. 2002;1(5):347-55.

Dibbens, et al. Familial and sporadic 15q13.3 microdeletions in Idiopathic Generalized Epilepsy: Precedent for Disorders with Complex Inheritance. Hum Mol Genet. Jul. 10, 2009. [Epub ahead of print].

Dijkhuizen, et al. FISH and array-CGH analysis of a complex chromosome 3 aberration suggests that loss of CNTN4 and CRBN contributes to mental retardation in 3pter deletions. Am J Med Genet A. Nov. 15, 2006;140(22):2482-7.

Elbashir, et al. RNA interference is mediated by 21- and 22-nucleotide RNAs. Genes Dev. Jan. 15, 2001;15(2):188-200.

Encode project consortium, et al. An integrated encyclopedia of DNA elements in the human genome. Nature. Sep. 6, 2012;489(7414):57-74. doi: 10.1038/nature11247.

Estivill, et al. Copy number variants and common disorders: filling the gaps and exploring complexity in genome-wide association studies. PLoS Genet. Oct. 2007;3(10):1787-99.

European search report and opinion dated Feb. 11, 2015 for EP Application No. 12839712.2.

European search report and opinion dated Feb. 27, 2015 for EP Application No. 11814903.8.

European search report and opinion dated Jun. 9, 2015 for EP Application No. 12846660.4.

European search report dated Apr. 11, 2016 for EP Application No. 13840476.9.

European Search Report dated Jun. 9, 2015 for European Patent Application No. 14192587.5.

European Search Report dated Sep. 2, 2016 for European Application No. 13836501.0.

European search report dated Oct. 14, 2015 for EP Application No. 13746934.2.

ExAC Browser (BETA) | Exome aggregation consortium. Available at http://exac.broadinstitute.org/. Accessed on Jun. 8, 2017.

Fan, et al. Illumina universal bead arrays. Methods Enzymol. 2006;410:57-73.

Fassbender, A., et al., "Biomarkers of endometriosis", Fertility and Sterility, 99(4), (Mar. 15, 2013), 1135-1145.

Fassone,et al., Complex I deficiency: clinical features, biochemistry and molecular genetics. J Med Genet 2012;49:578-590. doi:10.1136/jmedgenet-2012-101159.

Fernandez, et al. Disruption of contactin 4 (CNTN4) results in developmental delay and other features of 3p deletion syndrome. Addendum. Am J Hum Genet. Jun. 2008;82(6):1385.

(56) References Cited

OTHER PUBLICATIONS

Fernandez, et al. Disruption of contactin 4 (CNTN4) results in developmental delay and other features of 3p deletion syndrome. Am J Hum Genet. Jun. 2004;74(6):1286-93.
Fernandez, et al. Gene Discovery in Developmental Neuropsychiatric Disorders: Clues from Chromosomal Rearrangements. Yale Journal of Biology and Medicine, vol. 78 (2005), pp. 95-130. on p. 103. Abstract.
Fire, et al. Potent and specific genetic interference by double-stranded RNA in Caenorhabditis elegans. Nature. Feb. 19, 1998;391(6669):806-11.
Flannick, et al., Loss-of-function mutations in SLC30A8 protect against type 2 diabetes. Nat Genet. Author manuscript; available in PMC Jun. 10, 2014.
Freeman, et al. Copy number variation: new insights in genome diversity. Genome Res. Aug. 2006;16(8):949-61. Epub Jun. 29, 2006.
Freshney, R. I., Culture of Animal Cells: A Manual of Basic Technique. Wiley-Liss; 5th edition (2005).
Gagneux, et al. Genetic differences between humans and great apes. Mol Phylogenet Evol. Jan. 2001;18(1):2-13.
Galfre et al. Antibodies to major histocompatibility antigens produced by hybrid cell lines. Nature 266:550-552 (1977).
Gatto, et al. Genetic controls balancing excitatory and inhibitory synaptogenesis in neurodevelopmental disorder models. Frontiers in Synaptic Neuroscience. Jun. 2010; 2(4):1-19.
Gelb, et al., Diagnostic Criteria for Parkinson Disease. Arch Neurol. 1999;56(1):33-39. doi:10.1001/archneur.56.1.33.
Gelmann, et al. Identification of reciprocal translocation sites within the c-myc oncogene and immunoglobulin mu locus in a Burkitt lymphoma. Nature. Dec. 22, 1983-Jan. 4, 1984;306(5945):799-803.
GeneCards output for ATXN2 gene, from www.genecards.ord, pritned on May 20, 2015, pp. 1-3.
GeneCards output for DIAPH2 gene, from www.genecards.ord, printed on Jun. 11, 2015, pp. 1-11.
Gilling, et al. Breakpoint cloning and haplotype analysis indicate a single origin of the common Inv(10)(p11.2q21.2) mutation among northern Europeans. Am. J. Hum. Genet. 2006;78(5):878-83.
Glessner, et al. Autism genome-wide copy number variation reveals ubiquitin and neuronal genes. Nature. May 28, 2009;459(7246):569-73. Epub Apr. 28, 2009.
Goldstein. Common genetic variation and human traits. N Engl J Med. Apr. 23, 2009;360(17):1696-8. Epub Apr. 15, 2009.
GPHN Gene—GeneCards output. pp. 1-14. Printed on Jul. 2, 2015 from www.genecards.org.
Gregoriadis. Chapter 14, "Liposomes," Drug Carriers in Biology and Medicine, pp. 2.sup.87-341 (Academic Press, 1979).
Gribble, et al. The complex nature of constitutional de novo apparently balanced translocations in patients presenting with abnormal phenotypes. J. Med. Genet. 2005; 42:8-16.
Griffiths, et al. Human anti-self antibodies with high specificity from phage display libraries. EMBO J. Feb. 1993;12(2):725-34.
Griswold, et al. A de novo 1.5 Mb microdeletion on chromosome 14q23.2-23.3 in a patient with autism and spherocytosis. Autism Res. Jun. 2011;4(3):221-7. doi: 10.1002/aur.186. Epub Feb. 28, 2011.
Grskovic, et al. Induced pluripotent stem cells—opportunities for disease modelling and drug discovery. Nat Rev Drug Discov. Nov. 11, 2011;10(12):915-29. doi: 10.1038/nrd3577.
Guatelli, et al. Isothermal, in vitro amplification of nucleic acids by a multienzyme reaction modeled after retroviral replication. Proc Natl Acad Sci U S A. Mar. 1990;87(5):1874-8.
Guilmatre, et al. Recurrent rearrangements in synaptic and neurodevelopmental genes and shared biologic pathways in schizophrenia, autism, and mental retardation. Arch Gen Psychiatry. Sep. 2009;66(9):947-56. doi: 10.1001/archgenpsychiatry.2009.80.
Harada, et al. Subtelomere specific microarray based comparative genomic hybridisation: a rapid detection system for cryptic rearrangements in idiopathic mental retardation. J. Med. Genet. 2004; 41:130-136.
Hatchwell, et al. High rate of submicroscopic human genomic polymorphism detected by array CGH. Proceedings of XIX International Genetics Congress. Melbourne, Australia. Abstracts and Posters. 2003; 1.E.0092. pp. 168 and 319.
Hattersley, et al. What makes a good genetic association study? Lancet. Oct. 8, 2005;366(9493):1315-23.
Hay et al. Bacteriophage cloning and *Escherichia coli* expression of a human IgM Fab. Hum Antibodies Hybridomas 3(2):81-85 (1992).
He, et al. Analysis of de novo copy numbers variations in a family affected with autism spectrum disorders using high-resolution array-based comparative genomic hybridization. Zhonghua Yi Xue Yi Chuan Xue Za Zhi. Jun. 2012;29(3):266-9. doi: 10.3760/cma.j.issn.1003-9406.2012.03.004. English abstract only.
Hegele, et al. "SNP Judgments and Freedom of Association", Arterioscler. Thromb. Vase. Biol. 22 (2002): 1058-1061.
Helbig, et al. 15q13.3 microdeletions increase risk of idiopathic generalized epilepsy. Nat Genet. Feb. 2009;41(2):160-2. Epub Jan. 11, 2009.
Henchcliffe, et al., Mitochondrial biology and oxidative stress in Parkinson disease pathogenesis. Nat. Clin. Pract. Neurology, 2005;4(11):600-609.
Hicks et al., "Novel patterns of genome rearrangement and their association with survival in breast cancer," Genome Res 16:1465-1479, 2006.
Hirschhorn, et al. A comprehensive review of genetic association studies. Genet Med. Mar.-Apr. 2002;4(2):45-61.
Hoffman, et al. Pharmacokinetic and pharmacodynamic aspects of gastroretentive dosage forms. Int J Pharm. Jun. 11, 2004;277(1-2):141-53.
Hoheisel, J. Microarray technology: beyond transcript profiling and genotype analysis. Nat Rev Genet. Mar. 2006;7(3):200-10.
Huang, et al. Whole genome DNA copy number changes identified by high density oligonucleotide arrays. Hum Genomics. May 2004;1(4):287-99.
Hudson, et al., Two-stage association study and meta-analysis of mitochondrial DNA variants in Parkinson disease. American Academy of Neurology. 2013;80: 2042-2048.
Human Genome CGH Microarrays—Details & Specifications, six printed pages from www.agilent.com, printed on May 20, 2015.
Hunt et al., Silent (Synonymous) SNPs: Should We Care About Them?, Methods in Molecular Biology. 2009; 578: 23-39.
Hunter, C. Genetics: a touch of elegance with RNAi. Curr Biol. Jun. 17, 1999;9(12):R440-2.
Huse, et al. Generation of a large combinatorial library of the immunoglobulin repertoire in phage lambda. Science. Dec. 8, 1989;246(4935):1275-81.
Hutvagner, et al. A microRNA in a multiple-turnover RNAi enzyme complex. Science. Sep. 20, 2002;297(5589):2056-60. Epub Aug. 1, 2002.
Iafrate, et al. Detection of large-scale variation in the human genome. Nature Genet. 2004; 36:949-51.
International Preliminary Report on Patentability dated Mar. 16, 2017 for International Application No. PCT/US2015/000093.
International search report and written opinion dated Jan. 15, 2014 for PCT/US2013/062346.
International search report and written opinion dated Jan. 20, 2014 for PCT/US2013/059739.
International search report and written opinion dated Apr. 9, 2012 for PCT/US2011/001363.
International search report and written opinion dated Apr. 22, 2013 for PCT/US2012/063451.
International search report and written opinion dated Jun. 21, 2013 for PCT/IB2012/002498.
International search report and written opinion dated Jul. 3, 2013 for PCT/IB2012/002498.
International Search Report dated Sep. 11, 2008 for PCT Application No. US2007/68183.
"Introducing Genome-Wide SNP Array 6.0 Pure performance & Genetic Power." May 21, 2008. Available at http://www.genehk.com/news/doc/Genomics_genome-wide Human SNP Array 6.0.pdf. Accessed on Dec. 22, 2016.

(56) References Cited

OTHER PUBLICATIONS

Itsara, et al. Population analysis of large copy numbers variants and hotspots of human genetic disease. Am J Hum Genet. Feb. 2009;84(2):148-61. Epub Jan. 22, 2009.
Jonsson, et al., A mutation in APP protects against Alzheimer's disease and age-related cognitive decline. Nature. Aug. 2, 2012;488(7409):96-9. doi: 10.1038/nature11283.
Jorde, et al. Population genomics: a bridge from evolutionary history to genetic medicine. Hum. Mol. Genet. 2001; 10(20):2199-2207.
Juppner. Functional properties of the PTH/PTHrP receptor. Bone. Aug. 1995; 17(2):Supplement 39S-42S.
Kallioniemi, et al. Comparative genomic hybridization for molecular cytogenetic analysis of solid tumors. Science. Oct. 30, 1992;258(5083):818-21.
Kaminsky, et al., An evidence-based approach to establish the functional and clinical significance of copy number variants in intellectual and developmental disabilities. Genetics in medicine, 2011; 13(9): 777-784.
Karlin, et al. Applications and statistics for multiple high-scoring segments in molecular sequences. Proc Natl Acad Sci U S A. Jun. 15, 1993;90(12):5873-7.
Ketting, et al. Dicer functions in RNA interference and in synthesis of small RNA involved in developmental timing in C. elegans. Genes Dev. Oct. 15, 2001;15(20):2654-9.
Kevelam, et al., NUBPL mutations in patients with complex I deficiency and a distinct MRI pattern. Neurology. Apr. 23, 2013; 80(17): 1577-1583.
Kim, et al. Strategies for silencing human disease using RNA interference. Nat Rev Genet. Mar. 2007;8(3):173-84.
Kim, et al., Synthetic dsRNA dicer substrates enhance RNAi potency and efficacy. Nature biotechnology. 2005; 23(2): 222-226.
Kimchi-Sarfaty, et al. A "silent" polymorphism in the MDR1 gene changes substrate specificity. Science. Jan. 26, 2007;315(5811):525-8. Epub Dec. 21, 2006.
Klausner, et al. Novel gastroretentive dosage forms: evaluation of gastroretentivity and its effect on levodopa absorption in humans. Pharm Res. Sep. 2003;20(9):1466-73.
Klein, et al. Comparative genomic hybridization, loss of heterozygosity, and DNA sequence analysis of single cells. Proc Natl Acad Sci U S A. Apr. 13, 1999;96(8):4494-9.
Knight, et al. A cytogenetic abnormality and rare coding variants identify ABCA13 as a candidate gene in schizophrenia, bipolar disorder, and depression. Am J Hum Genet. Dec. 2009;85(6):833-46. doi: 10.1016/j.ajhg.2009.11.003.
Kohler, et al. Continuous cultures of fused cells secreting antibody of predefined specificity. Nature. Aug. 7, 1975;256(5517):495-7.
Kozbor, et al. The production of monoclonal antibodies from human lymphocytes. Immunol. Today. 1983; 4(3): 72-79.
Kraus, et al. Detection and isolation of novel protein-tyrosine kinase genes employing reduced stringency hybridization. Methods Enzymol. 1991;200:546-56.
Kumar, et al. A de novo 1p34.2 microdeletion identifies the synaptic vesicle gene RIMS3 as a novel candidate for autism. J Med Genet. Jun. 21, 2009. [Epub ahead of print].
Kumar, et al. Recurrent 16p11.2 microdeletions in autism. Hum Mol Genet. Feb. 15, 2008;17(4):628-38. Epub Dec. 21, 2007.
Kumar Kishore, et al., Genetics of parkinson disease and other movement disorders, Current opinion in neurology, Aug. 2012; 25(4):466-474.
Kurreck, J. Antisense technologies. Improvement through novel chemical modifications. Eur J Biochem. Apr. 2003;270(8):1628-44.
Kutyavin, et al. A novel endonuclease IV post-PCR genotyping system. Nucleic Acids Res. 2006;34(19):e128. Epub Sep. 29, 2006.
Kwoh, et al. Transcription-based amplification system and detection of amplified human immunodeficiency virus type 1 with a bead-based sandwich hybridization format. Proc Natl Acad Sci U S A. Feb. 1989;86(4):1173-7.
Lakowicz, J. (1983) Principles of fluorescence spectroscopy. Plenum Press, New York.
Landegren, et al. A ligase-mediated gene detection technique. Science. Aug. 26, 1988;241(4869):1077-80.
Langston, et al., Multisystem Lewy body disease and the other parkinsonian disorders. Nature Genetics. Dec. 2015; 47(12):1378-1385.
Latchman, et al. Viral vectors for gene therapy in Parkinson's disease. Rev Neurosci. 2001;12(1):69-78.
Lavery, et al. Antisense and RNAi: powerful tools in drug target discovery and validation. Curr Opin Drug Discov Devel. Jul. 2003;6(4):561-9.
Lerner. How to make a hybridoma. Yale J Biol Med. 54(5):387-402 (1981).
Liu, Qing-Rong, et al. "Addiction molecular genetics: 639,401 SNP whole genome association identifies many "cell adhesion" genes." American Journal of Medical Genetics Part B: Neuropsychiatric Genetics val. 141 (2006): pp. 918-925.
Lizardi, et al. Exponential amplification of recombinant-RNA hybridization probes. Nature Biotechnology 6.10 (1988): 1197-1202.
Lucentini. Gene Association Studies Typically Wrong. The Scientist18:20 (2004).
Maftei, et al. Interaction structure of the complex between neuroprotective factor humanin and Alzheimer's β-amyloid peptide revealed by affinity mass spectrometry and molecular modeling. J Pept Sci. Jun. 2012;18(6):373-82. doi: 10.1002/psc.2404. Epub Apr. 20, 2012.
Maniatis, et al. Molecular Cloning: A Laboratory Manual, Cold Spring Harbor Laboratory Press, Cold Spring Harbor, N.Y., USA (1982).
Manolio, et al.Finding the missing heritability of complex diseases. Nature. Oct. 8, 2009;461(7265):747-53.
Margulies, et al. Genome sequencing in microfabricated high-density picolitre reactors. Nature. Sep. 15, 2005;437(7057):376-80. Epub Jul. 31, 2005.
Marques, et al. A structural basis for discriminating between self and nonself double-stranded RNAs in mammalian cells. Nat Biotechnol. May 2006;24(5):559-65. Epub Apr. 30, 2006.
Marshall, et al. Structural variation of chromosomes in autism spectrum disorder. Am J Hum Genet. Feb. 2008;82(2):477-88. doi: 10.1016/j.ajhg.2007.12.009. Epub Jan. 17, 2008.
Martinez et al. Single-stranded antisense siRNAs guide target RNA cleavage in RNAi. Cell 110(5):563-574 (2002).
Mast, et al. Invader assay for single-nucleotide polymorphism genotyping and gene copy number evaluation. Methods Mol Biol. 2006;335:173-86. Abstract only.
Matsuoka, et al. Humanin and the receptors for humanin. Mol Neurobiol. Feb. 2010;41(1):22-8. Epub Dec. 9, 2009.
May et al., Endometrial alterations in endometriosis: a systematic review of putative biomarkers. Hum. Reprod. Update, 17(5); 637-53:2011.
McCarroll, et al. Copy-number variation and association studies of human disease. Nat Genet. Jul. 2007;39(7 Suppl):S37-42.
McCarthy, et al. Microduplications of 16p11.2 are associated with schizophrenia. Nat Genet. Nov. 2009;41(11):1223-7. Epub Oct. 25, 2009.
McInnes, et al. A large-scale survey of the novel 15q24 microdeletion syndrome in autism spectrum disorders identifies an atypical deletion that narrows the critical region. Mol Autism. Mar. 19, 2010;1(1):5. doi: 10.1186/2040-2392-1-5.
McManus, et al. Gene silencing in mammals by small interfering RNAs. Nat Rev Genet. Oct. 2002;3(10):737-47.
Mockler, et al. Applications of DNA tiling arrays for whole-genome analysis. Genomics. Jan. 2005;85(1):1-15.
Mohapatra, et al. Analyses of brain tumor cell lines confirm a simple model of relationships among fluorescence in situ hybridization, DNA index, and comparative genomic hybridization. Genes Chromosomes Cancer. Dec. 1997;20(4):311-9.
Mounsey et al., Mitochondrial Dysfunction in Parkinson's disease: Pathogenesis and neuroprotection. Parkinson's Disease, 2010: 18 pages.
Mummidi et al., Evolution of human and non-human primate CC chemokine receptor 5 gene and mRNA. Journal of Biological Chemistry, 275(5):18946-18961, 2000.

(56) References Cited

OTHER PUBLICATIONS

Nakamura, et al., Codon usage tabulated from international DNA sequence databases: status for the year 2000. Nucleic Acids Res. Jan. 1, 2000; 28(1): 292.

Nakazawa et al. UV and skin cancer: specific p53 gene mutation in normal skin as a biologically relevant exposure measurement. PNAS USA 91(1):360-364 (1994).

Nalls, et al. Extended tracts of homozygosity identify novel candidate genes associated with late-onset Alzheimer's disease. Neurogenetics. Jul. 2009;10(3):183-90. doi: 10.1007/s10048-009-0182-4. Epub Mar. 7, 2009.

Nalls, et al. Imputation of sequence variants for identification of genetic risks for Parkinson's disease: a meta-analysis of genome-wide association studies. Lancet. Feb. 19, 2011;377(9766):641-9. doi: 10.1016/S0140-6736(10)62345-8. Epub Feb. 1, 2011.

National Center for Biotechnology Information. NCBI. Available at: https://www.ncbi.nlm.nih.gov/. Accessed on: Jun. 8, 2017.

NCBI. GenBank accession No. AL390798.3. Human chromosome 14 DNA sequence BAC R-21O19 of library RPCI-11 from chromosome 14 of *Homo sapiens* (Human), complete sequence. Apr. 28, 2011.

NCBI GenBank accession No. NG_12385.1. Mar. 27, 2012.

NCBI GenBank accession No. NM_207303.1. Apr. 20, 2004.

NCBI SNP Database rs201412882, ss491686165, Mar. 6, 2012 (National Library of Medicine, NIH, Bethesda, MD, USA).

NHLBI Exome Sequencing Project (ESP) Exome Variant Server. Available at: http://evs.gs.washington.edu/EVS/. Accessed on Jun. 8, 2017.

Nielsen, et al. Sequence-selective recognition of DNA by strand displacement with a thymine-substituted polyamide. Science. Dec. 6, 1991;254(5037):1497-500.

Nord, et al. Accurate and exact CNV identification from targeted high-throughput sequence data. BMC Genomics. Apr. 12, 2011;12:184.

Notice of Allowance dated Jan. 11, 2018 for U.S. Appl. No. 14/026,642.

Notice of allowance dated Jul. 25, 2014 for U.S. Appl. No. 13/196,882.

Nouws et al., Assembly factors as a new class of disease genes for mitochondrial complex I deficiency: cause, pathology and treatment options. Brain, 2012;135:12-22.

Nykanen, et al. ATP requirements and small interfering RNA structure in the RNA interference pathway. Cell. Nov. 2, 2001;107(3):309-21.

Office action dated Jan. 6, 2011 for U.S. Appl. No. 12/707,561.
Office Action dated Jan. 9, 2017 for U.S. Appl. No. 14/449,217.
Office Action dated Jan. 9, 2017 U.S. Appl. No. 14/806,131.
Office Action dated Feb. 21, 2017 for U.S. Appl. No. 14/090,932.
Office action dated Feb. 24, 2016 for U.S. Appl. No. 14/039,770.
Office action dated Feb. 25, 2016 for U.S. Appl. No. 13/648,874.
Office action dated Feb. 29, 2016 for U.S. Appl. No. 14/026,642.
Office action dated Mar. 1, 2016 for U.S. Appl. No. 13/763,550.
Office Action dated Apr. 3, 2013 for U.S. Appl. No. 13/095,722.
Office Action dated Apr. 7, 2017 for U.S. Appl. No. 14/538,404.
Office Action dated Apr. 13, 2017 for U.S. Appl. No. 13/648,874.
Office Action dated Apr. 13, 2017 for U.S. Appl. No. 14/039,770.
Office Action dated May 1, 2017 for U.S. Appl. No. 12/449,566.
Office Action dated May 17, 2016 for U.S. Appl. No. 14/090,932.
Office Action dated May 25, 2017 for U.S. Appl. No. 13/668,049.
Office Action dated May 25, 2017 for U.S. Appl. No. 13/763,550.
Office action dated May 27, 2015 for U.S. Appl. No. 14/039,770.
Office action dated May 28, 2014 for U.S. Appl. No. 12/449,566.
Office action dated Jun. 23, 2015 for U.S. Appl. No. 13/763,550.
Office action dated Jun. 28, 2016 for U.S. Appl. No. 12/449,566.
Office action dated Jun. 29, 2015 for U.S. Appl. No. 14/026,642.
Office action dated Jul. 9, 2015 for U.S. Appl. No. 13/648,874.
Office action dated Jul. 17, 2013 for U.S. Appl. No. 12/449,566.
Office action dated Aug. 4, 2015 for U.S. Appl. No. 13/668,049.
Office Action dated Aug. 11, 2017 for U.S. Appl. No. 14/026,642.
Office action dated Sep. 2, 2015 for U.S. Appl. No. 12/449,566.
Office action dated Sep. 13, 2012 for Chinese Application No. 200780015873.8.
Office Action dated Sep. 15, 2016 for U.S. Appl. No. 13/763,550.
Office Action dated Sep. 20, 2017 for U.S. Appl. No. 12/449,566.
Office action dated Oct. 3, 2014 for U.S. Appl. No. 13/668,049.
Office Action dated Oct. 10, 2017 for U.S. Appl. No. 14/449,217.
Office Action dated Oct. 13, 2017 for U.S. Appl. No. 14/806,131.
Office Action dated Oct. 19, 2016 for European Application No. 12846660.4.
Office action dated Nov. 18, 2013 for U.S. Appl. No. 13/196,882.
Office Action dated Dec. 5, 2017 for U.S. Appl. No. 13/648,874.
Office Action dated Dec. 6, 2016 for U.S. Appl. No. 14/026,642.
Office Action dated Dec. 11, 2017 for U.S. Appl. No. 13/763,550.
Office action dated Dec. 16, 2008 for U.S. Appl. No. 11/421,348.
Office action dated Dec. 16, 2014 for U.S. Appl. No. 12/449,566.
Office Action dated Dec. 29, 2017 for U.S. Appl. No. 13/668,049.
Office Action dated Dec. 7, 2017 for U.S. Appl. No. 14/039,770.
Office action dated Feb. 9, 2011 for UK Application No. GB0822081.6.
Office action dated Jun. 14, 2010 for UK Application No. GB0822081.6.
Office action dated Jun. 2, 2009 for U.S. Appl. No. 11/421,348.

O'Keefe, et al. High-resolution genomic arrays facilitate detection of novel cryptic chromosomal lesions in myelodysplastic syndromes. Exp Hematol. Feb. 2007;35(2):240-51.

Ozelius, et al. LRRK2 G2019S as a cause of Parkinson's disease in Ashkenazi Jews. N Engl J Med. Jan. 26, 2006;354(4):424-5.

Paisan-Ruiz Coro, et al., Parkingson's disease and low frequency alleles foung together throughout LRRK2, Annals of human genetics. Jul. 2009. 73(4). 391-403.

Pang, et al. Towards a comprehensive structural variation map of an individual human genome. Genome Biol. 2010;11(5):R52. Epub May 19, 2010.

Peltz, et al. Targeting post-transcriptional control for drug discovery. RNA Biol. Jul.-Aug. 2009;6(3):329-34. Epub Jul. 7, 2009.

Pennisi. A closer look at SNPs suggests difficulties. Science. Sep. 18, 1998; 281(5384): 1787-1789.

Perkel, J. SNP genotyping: six technologies that keyed a revolution. Nature Methods. 2008; 5:447-453.

Petrini, et al. The immunoglobulin heavy chain switch: structural features of gamma 1 recombinant switch regions. J Immunol. Mar. 15, 1987;138(6):1940-6.

Pinkel, et al. Comparative genomic hybridization. Annu. Rev. Genomics Hum. Genet. 2005; 6:331-54.

Pinkel, et al. High resolution analysis of DNA copy number variation using comparative genomic hybridization to microarrays. Nat Genet. Oct. 1998;20(2):207-11.

Pinto, et al. Comprehensive assessment of array-based platforms and calling algorithms for detection of copy number variants. Nat Biotechnol. May 8, 2011;29(6):512-20. doi: 10.1038/nbt.1852.

Pinto, et al. Functional impact of global rare copy number variation in autism spectrum disorders. Nature. Jul. 15, 2010;466(7304):368-72. Epub Jun. 9, 2010.

Plasterk, et al. The silence of the genes. Curr Opin Genet Dev. Oct. 2000;10(5):562-7.

Poewe, et al., Parkinson disease. Nature Review:Disease Primers. Mar. 23, 2017.vol. 3, Article 17013: 1-21.

Pollack, et al. Microarray analysis reveals a major direct role of DNA copy number alteration in the transcriptional program of human breast tumors. Proc. Natl. Acad. Sci. 2002;99(20):12963-68.

Prasad, et al. A discovery resource of rare copy number variations in individuals with autism spectrum disorder. G3 (Bethesda). Dec. 2012;2(12):1665-85. doi: 10.1534/g3.112.004689. Epub Dec. 1, 2012.

Probe Reports from the NIH Molecular Libraries Program [Internet]. Bethesda (MD): National Center for Biotechnology Information (US); 2010. Available from: https://www.ncbi.nlm.nih.gov/books/NBK47352/.

Provost, et al. Ribonuclease activity and RNA binding of recombinant human Dicer. EMBO J. Nov. 1, 2002;21(21):5864-74.

Purcell et al. "Postmortem brain abnormalities of the glutamate neurotransmitter system in autism" (Neurology, vol. 57 (2001) pp. 1618-1628).

Ragoussis, et al. Affymetrix GeneChip system: moving from research to the clinic. Expert Rev Mol Diagn. Mar. 2006;6(2):145-52.

(56) References Cited

OTHER PUBLICATIONS

Ramsey, et al. A CFTR potentiator in patients with cystic fibrosis and the G551D mutation. N Engl J Med. Nov. 3, 2011;365(18):1663-72.
Redon, et al. Global variation in copy number in the human genome. Nature. Nov. 23, 2006;444(7118):444-54.
Rees, et al. Isoform heterogeneity of the human gephyrin gene (GPHN), binding domains to the glycine receptor, and mutation analysis in hyperekplexia. J Biol Chem. Jul. 4, 2003;278(27):24688-96. Epub Apr. 8, 2003.
Remington "The Science and Practice of Pharmacy" (20th Ed., Lippincott Williams & Wilkins, Baltimore MD).
Revised American society for reproductive medicine classification of endometriosis: 1996. Fertility and Sterility. 67: 1997; 817-21.
Reynold, et al. Rational siRNA design for RNA interference. Nat Biotechnol. Mar. 2004;22(3):326-30. Epub Feb. 1, 2004.
Risch, et al. A genomic screen of autism: evidence for a multilocus etiology. Am J Hum Genet. Aug. 1999;65(2):493-507.
Rodriguez-Revenga, et al. Structural variation in the human genome: the impact of copy number variants on clinical diagnosis. Genet Med. Sep. 2007;9(9):600-6.
Roohi, et al. Disruption of contactin 4 in three subjects with autism spectrum disorder. J Med Genet. Mar. 2009;46(3):176-82.
Saha, et al. Technical challenges in using human induced pluripotent stem cells to model disease. Cell Stem Cell. Dec. 4, 2009;5(6):584-95.
Saiki, et al. Primer-directed enzymatic amplification of DNA with a thermostable DNA polymerase. Science. Jan. 29, 1988;239(4839):487-91.
Sambrook et al., Molecular Cloning: A Laboratory Manual (2 ed.), Cold Spring Harbor Laboratory Press, Cold Spring Harbor, N.Y., USA (1989).
Sanders, et al., Multiple Recurrent De Novo CNVs, including duplications of the 7q11.23 Williams Syndrome Region, Are Strongly Associated with Autism. Neuron. Jun. 9, 2011; 70: 863-885.
Santa Cruz Human Genome Browser Gateway. 2017. Available at: http://genome.ucsc.edu/cgi-bin/hgGateway. Accessed on: Jun. 8, 2017.
Sauna, et al., Understanding the contribution of synonymous mutations to human disease.Nat Rev Genet. Aug. 31, 2011;12(10):683-91. doi: 10.1038/nrg3051.
Schapira. Causes of neuronal death in Parkinson's disease. Adv Neurol. 2001;86:155-62.
Schapira, et al. Mitochondrial complex I deficiency in Parkinson's disease. Lancet. Jun. 3, 1989;1(8649):1269.
Schapira. Mitochondrial complex I deficiency in Parkinson's disease. Adv Neurol. 1993;60:288-91.
Schroder, et al., Evaluation of RAG1 mutations in an adult with combined immunodeficiency and progressive multifocal leukoencephalopathy. Clinical Immunology 179 (2017) 1-7.
Schule, et al. Can cellular models revolutionize drug discovery in Parkinson's disease? Biochim Biophys Acta. Nov. 2009;1792(11):1043-51. Epub Sep. 3, 2009.
Schwarz, et al. Asymmetry in the assembly of the RNAi enzyme complex. Cell. Oct. 17, 2003;115(2):199-208.
Sebat, et al. Large-scale copy number polymorphism in the human genome. Science. 2004; 305(5683):525-8.
Sebat, et al.Strong association of de novo copy numbers mutations with autism. Science. Apr. 20, 2007;316(5823):445-9.
Seshan VE and Olshen A (2017). DNAcopy: DNA copy number data analysis. R package version 1.50.1. Available at: http://www.bioconductor.org/packages/release/bioc/html/DNAcopy.html.
Sharp. RNA interference-2001. Genes Dev 15(5):485-490 (2001).
Sheftel, et al., Human Ind1, an Iron-Sulfur Cluster Assembly Factor for Respiratory Complex I. Molecular and Cellular Biology, Nov. 2009, p. 6059-6073.
Shi, Y. Mammalian RNAi for the masses. Trends Genet. Jan. 2003;19(1):9-12.
Shuey, et al. RNAi: gene-silencing in therapeutic intervention. Drug Discov Today. Oct. 15, 2002;7(20):1040-6.

Sidransky, et al., Multicenter analysis of glucocerebrosidase mutations in Parkinson's disease.N Engl J Med. Oct. 22, 2009;361(17):1651-61. doi: 10.1056/NEJMoa0901281.
Sidrasky, E. Gaucher Disease: Insights from a Rare Mendelian Disorder. Discov Med. Author manuscript; available in PMC Aug. 22, 2014.
Simon-Sanchez, et al. Genome-wide association study reveals genetic risk underlying Parkinson's disease. Nat Genet. Dec. 2009;41(12):1308-12. doi: 10.1038/ng.487. Epub Nov 15, 2009. with supplemental information.
Siolas, et al. Synthetic shRNAs as potent RNAi triggers. Nat Biotechnol. Feb. 2005;23(2):227-31. Epub Dec. 26, 2004.
Smith, et al. A high-density admixture map for disease gene discovery in african americans. Am J Hum Genet. May 2004;74(5):1001-13. Epub Apr. 14, 2004.
Snijders, et al. Assembly of microarrays for genome-wide measurement of DNA copy number. Nat Genet. Nov. 2001;29(3):263-4.
Snijders, et al. BAC microarray-based comparative genomic hybridization. Methods Mol Biol. 2004;256:39-56.
Snijders, et al. Mapping segmental and sequence variations among laboratory mice using BAC array CGH. Genome Res. Feb. 2005;15(2):302-11.
Soni, et al. Progress toward ultrafast DNA sequencing using solid-state nanopores. Clin Chem. Nov. 2007;53(11):1996-2001. Epub Sep. 21, 2007.
Stark, et al. De novo 325 kb microdeletion in chromosome band 10q25.3 including ATRNL1 in a boy with cognitive impairment, autism and dysmorphic features. Eur J Med Genet. Sep.-Oct. 2010;53(5):337-9. doi: 10.1016/j.ejmg.2010.07.009. Epub Jul. 27, 2010.
Stefansson, et al. Large recurrent microdeletions associated with schizophrenia. Nature. Sep. 11, 2008;455(7210):232-6.
Stephens, et al. Antisense oligonucleotide therapy in cancer. Curr Opin Mol Ther. Apr. 2003;5(2):118-22.
Streubel, et al. Gastroretentive drug delivery systems. Expert Opin Drug Deliv. Mar. 2006;3(2):217-33.
String. Search single protein by name/identifier. String consortium 2017. Available at:https://string-db.org/.
Sudhof. Neuroligins and neurexins link synaptic function to cognitive disease. Nature. Oct. 16, 2008;455(7215):903-11. doi: 10.1038/nature07456.
Summary of NRSP-8 Accomplishments: 2003-2008. Available at http://www.lgu.umd.edu/lgu_v2/pages/attachs/9956_Attach1%20%202003-08%20ACCOMPLISHMENTS.doc. Published on Feb. 9, 2008. (6 pages).
Suryawanshi, S., et al., "Plasma microRNAs as novel biomarkers for endometriosis and endometriosis-associated ovarian cancer", Clin Cancer Res., 19(5), (Mar. 1, 2013), 1213-24.
Szoka et al. Procedure for preparation of liposomes with large internal aqueous space and high capture by reverse-phase evaporation. PNAS. 1978;75:4194-4198.
Tabara, et al. The dsRNA binding protein RDE-4 interacts with RDE-1, DCR-1, and a DExH-box helicase to direct RNAi in C. elegans. Cell. Jun. 28, 2002;109(7):861-71.
Tabuchi, et al. A neuroligin-3 mutation implicated in autism increases inhibitory synaptic transmission in mice. Science. Oct. 5, 2007;318(5847):71-6. Epub Sep. 6, 2007.
Tam, et al. The role of DNA copy number variation in schizophrenia. Biol Psychiatry. Dec. 1, 2009;66(11):1005-12. doi: 10.1016/j.biopsych.2009.07.027. Epub Sep. 12, 2009.
Tenisch, et al., Massive and exclusive pontocerebellar damage in mitochondrial disease and NUBPL mutations.Neurology. Jul. 24, 2012;79(4):391. doi: 10.1212/WNL.0b013e3182611232.
Teo, et al. Statistical challenges associated with detecting copy number variations with next-generation sequencing. Bioinformatics. Aug. 31, 2012.
The 1000 Genomes project consortium. An integrated map of genetic variation from 1,092 human genomes. 56 | Nature | vol. 491 | Nov. 1, 2012.
The International Schizophrenia Consortium. Rare chromosomal deletions and duplications increase risk of schizophrenia. Nature. Sep. 11, 2008;455(7210):237-41. Epub Jul. 30, 2008.

(56) References Cited

OTHER PUBLICATIONS

The Merck Manual of Diagnosis and Therapy, 18th Edition, published by Merck Research Laboratories, 2006 (ISBN 0-911910-18-2).
Thompson. Applications of antisense and siRNAs during preclinical drug development. Drug Discov Today. Sep. 1, 2002;7(17):912-7.
Thorpe, et al. Improved antitumor effects of immunotoxins prepared with deglycosylated ricin A-chain and hindered disulfide linkages. Cancer Res. Nov. 15, 1988;48(22):6396-403.
Tucker et al. Next-generation sequencing in molecular diagnosis: NUBPL mutations highlight the challenges of variant detection and interpretation. Human mutation, 2012; 33(2):411-418.
UK Parkinson's Disease Consortium et al., Dissection of the genetics of parkinson's disease identifies an additional association 5' of SNCA and multiple associated haplotypes at 17q21. Human Molecular genetics. Jan. 15, 2011; 20(2): 345-353.
Urnov, et al. Genome editing with engineered zinc finger nucleases. Nat Rev Genet. Sep. 2010;11(9):636-46.
Van Der Kolk, et al., Progressive multifocal leukoencephalopathy in an immunocompetent patient. Annals of Clinical and Translational Neurology 2016; 3(3): 226-232.
Van Goor, et al. Correction of the F508del-CFTR protein processing defect in vitro by the investigational drug VX-809. Proc Natl Acad Sci U S A. Nov. 15, 2011;108(46):18843-8. Epub Oct. 5, 2011.
Van Goor, et al. Rescue of CF airway epithelial cell function in vitro by a CFTR potentiator, VX-770. Proc Natl Acad Sci U S A. Nov. 3, 2009;106(44):18825-30. Epub Oct. 21, 2009.
Vaughan, et al. Genetics of Parkinsonism: a review. Ann Hum Genet. Mar. 2001;65(Pt 2):111-26.
Veensra-Vanderweele, et al. Networking in autism: leveraging genetic, biomarker and model system findings in the search for new treatments. Neuropsychopharmacology. Jan. 2012;37(1):196-212. doi: 10.1038/npp.2011.185. Epub Sep. 21, 2011.
Vickers, et al. Efficient reduction of target RNAs by small interfering RNA and RNase H-dependent antisense agents. A comparative analysis. J Biol Chem. Feb. 28, 2003;278(9):7108-18. Epub Dec. 23, 2002.
Vissers, et al. Array-based comparative genomic hybridization for the genomewide detection of submicroscopic chromosomal abnormalities. Am. J. Hum. Genet. 2003; 73:1261-70.
Vissers, et al. Identification of disease genes by whole genome CGH arrays. Hum Mol Genet. Oct. 15, 2005;14 Spec No. 2:R215-223.
Walker, et al. Genetic analysis of attractin homologs. Genesis. 2007; 45(12):744-756.
Walsh, et al. Detection of inherited mutations for breast and ovarian cancer using genomic capture and massively parallel sequencing. Proc Natl Acad Sci U S A. Jul. 13, 2010;107(28):12629-33. Epub Jun. 28, 2010.
Walsh, et al. Spectrum of mutations in BRCA1, BRCA2, CHEK2, and TP53 in families at high risk of breast cancer. JAMA. Mar. 22, 2006;295(12):1379-88.
Walters, et al. A novel highly penetrant form of obesity due to deletions on chromosome 16p11.2. Nature. Feb. 4, 2010;463(7281):671-5.
Wang, et al. Antisense anticancer oligonucleotide therapeutics. Curr Cancer Drug Targets. Nov. 2001;1(3):177-96.
Weiss, et al. Association between microdeletion and microduplication at 16p11.2 and autism. N Engl J Med. Feb. 14, 2008;358(7):667-75.
Westmark, C. What's hAPPening at synapses? The role of amyloid β-protein precursor and β-amyloid in neurological disorders. Mol Psychiatry. Aug. 28, 2012. doi: 10.1038/mp.2012.122.
Wilson, et al. DNA copy-number analysis in bipolar disorder and schizophrenia reveals aberrations in genes involved in glutamate signaling. Hum Mol Genet. Mar. 1, 2006;15(5):743-9. Epub Jan. 24, 2006.
Xia, et al. siRNA-mediated gene silencing in vitro and in vivo. Nat Biotechnol. Oct. 2002;20(10):1006-10. Epub Sep. 16, 2002.
Xiao, et al., Identification and optimization of small-molecule agonists of the human relaxin hormone receptor RXFP1. Nat Commun. 2013;4:1953. doi:10.1038/ncomms2953.
Xie, et al. CNV-seq, a new method to detect copy number variation using high-throughput sequencing. BMC Bioinformatics. Mar. 6, 2009;10:80.
Yusa, et al. Targeted gene correction of α1-antitrypsin deficiency in induced pluripotent stem cells. Nature. Oct. 12, 2011;478(7369):391-4. doi: 10.1038/nature10424.
Zapala, et al. Humanins, the neuroprotective and cytoprotective peptides with antiapoptotic and anti-inflammatory properties. Pharmacol Rep. Sep.-Oct. 2010;62(5):767-77.
Zeng, Li, et al. "A novel splice variant of the cell adhesion molecule contactin 4 (CNTN4) is mainly expressed in human brain." Journal of human genetics val. 47 (2002): pp. 497-499.
Zhang, et al. Copy number variation in human health, disease, and evolution. Annu Rev Genomics Hum Genet. 2009;10:451-81. doi: 10.1146/annurev.genom.9.081307.164217.
Zhang, et al. Detection of copy number variation from array intensity and sequencing read depth using a stepwise Bayesian model. BMC Bioinformatics. Oct. 31, 2010;11:539.
Zhao et al. (eds), Bacterial Artificial Chromosomes: Methods Protocols Methods in Molecular Biology, Humana Press, 2004.
Ziats, et al. Expression profiling of autism candidate genes during human brain development implicates central immune signaling pathways. PLoS One. 2011;6(9):e24691. doi: 10.1371/journal.pone.0024691. Epub Sep. 15, 2011.
Chen, et al., Correlation between SMN2 copies and the phenotype of spinal muscular atrophy. Chin J Neurol, Nov. 30, 2005; 38(11):673-676.
Gokcumen, et al., Copy number variants (CNVs) in primate species using array-based comparative genomic hybridization. Methods 2009;49:18-25.
Pokharel, S. et al., High-Throughput Screening for Functional Adenosine to Inosine RNA Editing Systems. ACS Chem Biol. Dec. 15, 2006;1(12):761-5.
U.S. Appl. No. 12/449,566 Notice of Allowance dated Sep. 27, 2018.
U.S. Appl. No. 14/039,770 Notice of Allowance dated Sep. 27, 2018.
U.S. Appl. No. 14/090,932 Office Action dated Sep. 27, 2018.
Gheuens, et al., Role of human leukocyte antigen class I alleles in progressive multifocal leukoencephalopathy. Journal of NeuroVirology, 2010; 1-7.
Munoz-Amatriain et al., Distribution, functional impact, and origin mechanisms of copy number variation in the barley genome. Genome Biology, 2013; 14:r58 pp. 1-17.
Sundqvist, et al., JC Polyomavirus infection is strongly controlled by human leucocyte antigen class II variants. PLOS Pathog, 2014;10(4): e1004084. doi:10.1371/journal.ppat.1004084.
U.S. Appl. No. 13/763,550 Office Action dated Jun. 6, 2018.
U.S. Appl. No. 14/806,131 Office Action dated Jun. 21, 2018.

\* cited by examiner

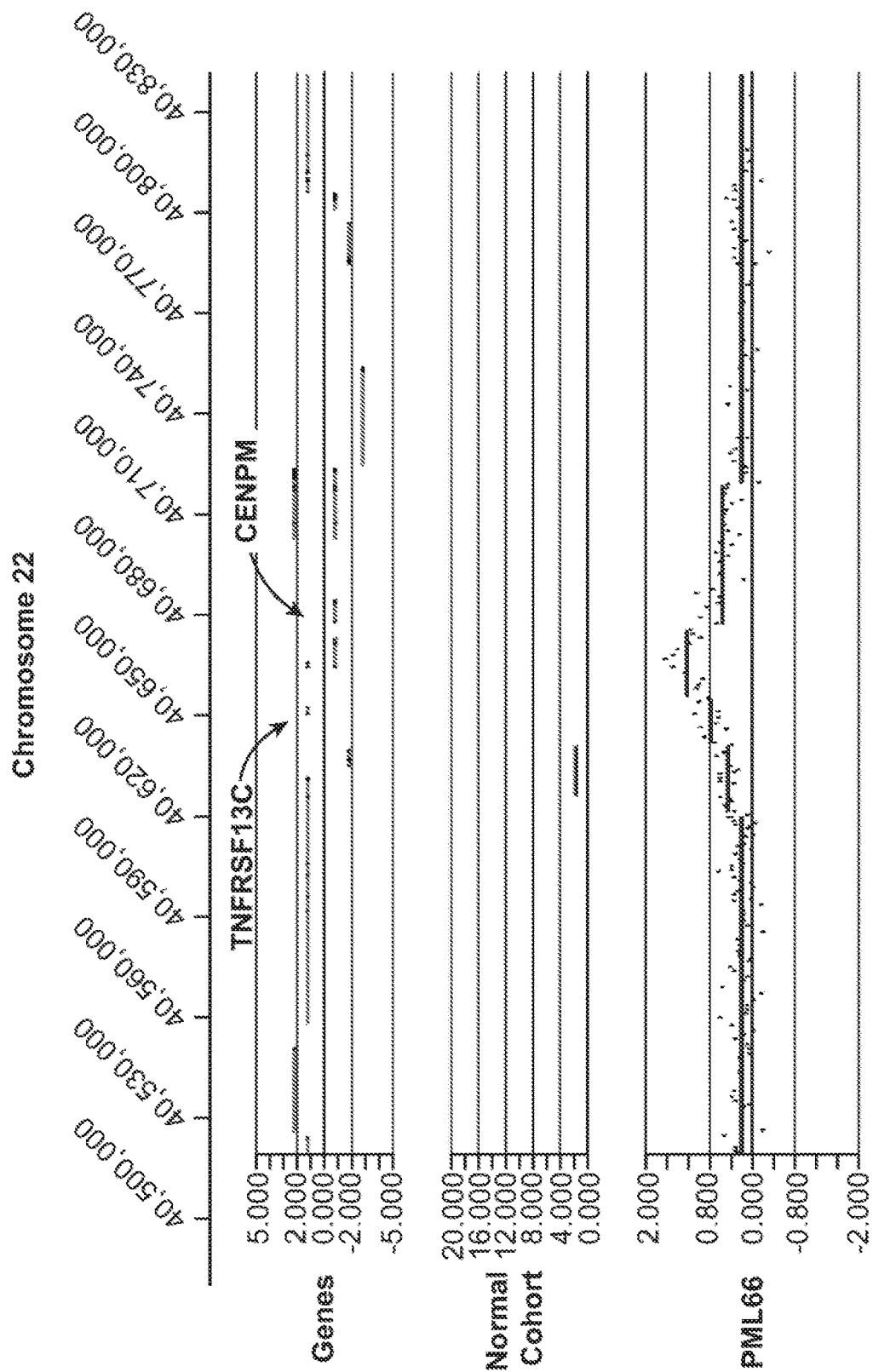
FIG. 2 (Cont. 1)

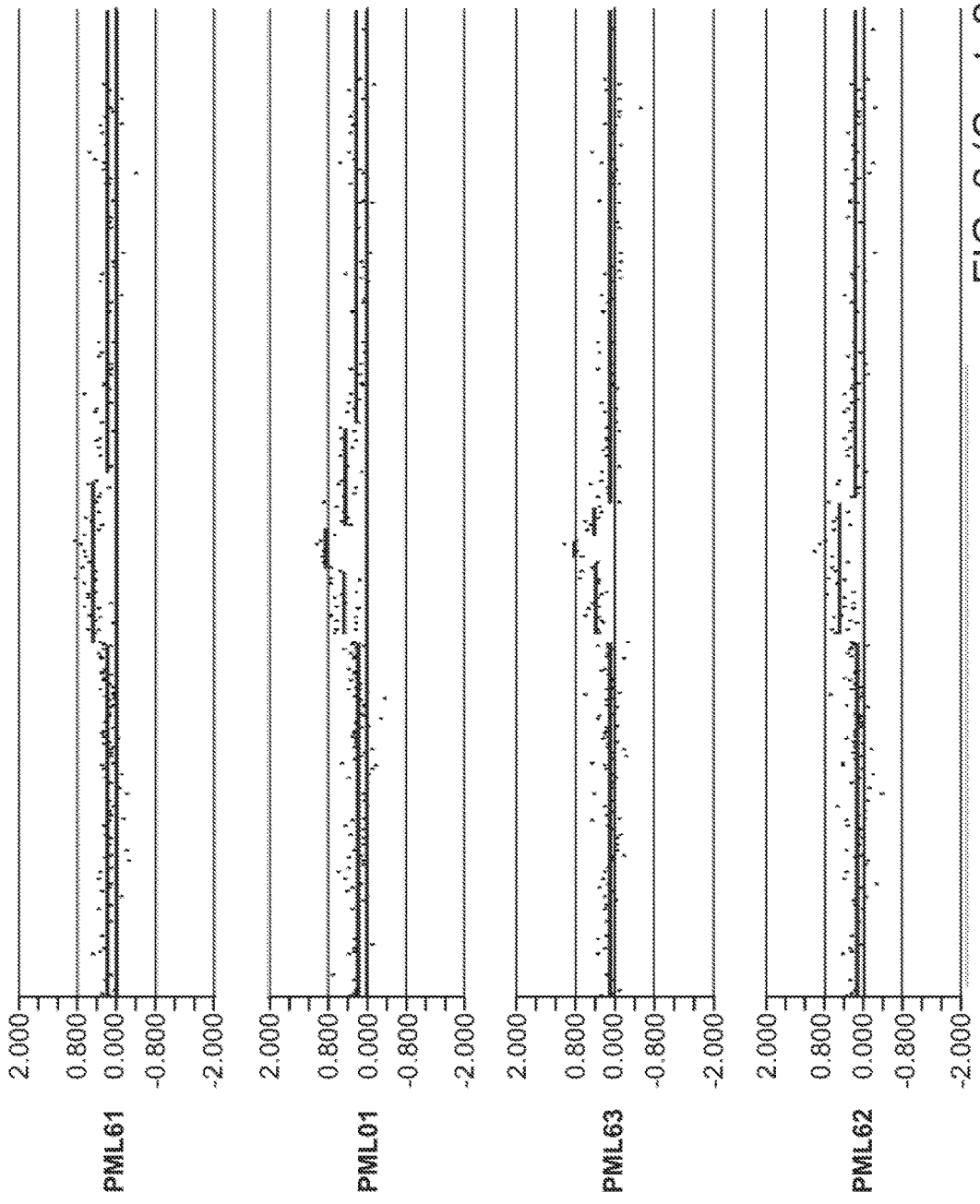
FIG. 2 (Cont. 2)

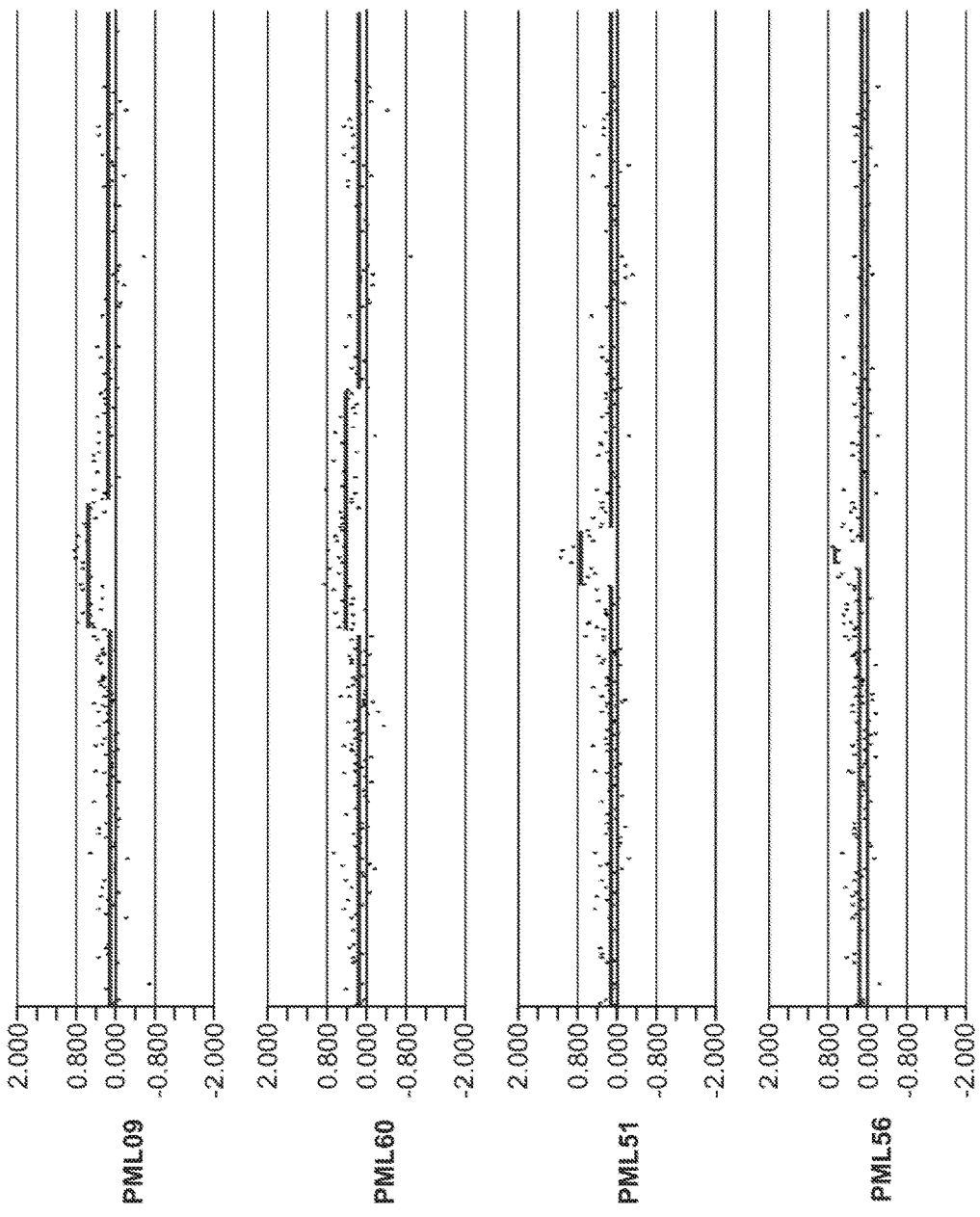
FIG. 2 (Cont. 3)

METHODS FOR ASSESSING RISK OF DEVELOPING A VIRAL DISEASE USING A GENETIC TEST

CROSS-REFERENCE

This application claims the benefit of U.S. Provisional Application No. 62/454,676, filed Feb. 3, 2017, and U.S. Provisional Application No. 62/524,324, filed Jun. 23, 2017, both of which are incorporated herein by reference in their entireties.

REFERENCE TO A SEQUENCE LISTING

The instant application contains a Sequence Listing which has been submitted in ASCII format via EFS-Web and is hereby incorporated by reference in its entirety. Said ASCII copy, created on Jun. 29, 2017, is named 33655-710.201_ST25.txt and is 103,456,855 bytes in size.

BACKGROUND OF THE DISCLOSURE

Progressive multifocal leukoencephalopathy (PML) is a rare and potentially fatal opportunistic infection of the central nervous system that is caused by a ubiquitous polyomavirus, the JC virus (JCV). While JCV is present at very high rates in the general population, PML remains a rare disorder, albeit an important one because of the poor survival and the severe neurological sequelae, and the recently demonstrated association with a variety of useful therapies, for example, natalizumab in multiple sclerosis (MS). A number of risk factors for PML have been described but these are better viewed as necessary but not sufficient. While these risk factors are highly relevant, they do not, on their own, predict who will develop PML, since the vast majority of individuals with these risk factors will not develop the disorder. Other factors need to be considered and there is growing evidence for the role of host genetic factors in susceptibility to PML.

The ability to more accurately predict who is at risk of developing PML will be of enormous benefit in the context of drug treatment with compounds that are highly effective in their disease context (natalizumab in MS, for example) but carry a small risk of a devastating disorder. There is a need to develop a companion diagnostic testing, in order to effectively exclude those that were at risk of PML, in the process reassuring those with negative tests about their dramatically reduced risk of developing PML.

INCORPORATION BY REFERENCE

All publications, patents, and patent applications mentioned in this specification are herein incorporated by reference to the same extent as if each individual publication, patent, or patent application was specifically and individually indicated to be incorporated by reference. In the event of a conflict between a term herein and a term incorporated by reference, the term herein controls.

BRIEF DESCRIPTION OF THE DRAWINGS

The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings.

FIG. 2 represents an example of genes (TNFRSF13C and CENPM) impacted by acquired CNVs.

SUMMARY OF THE INVENTION

Figure 1:
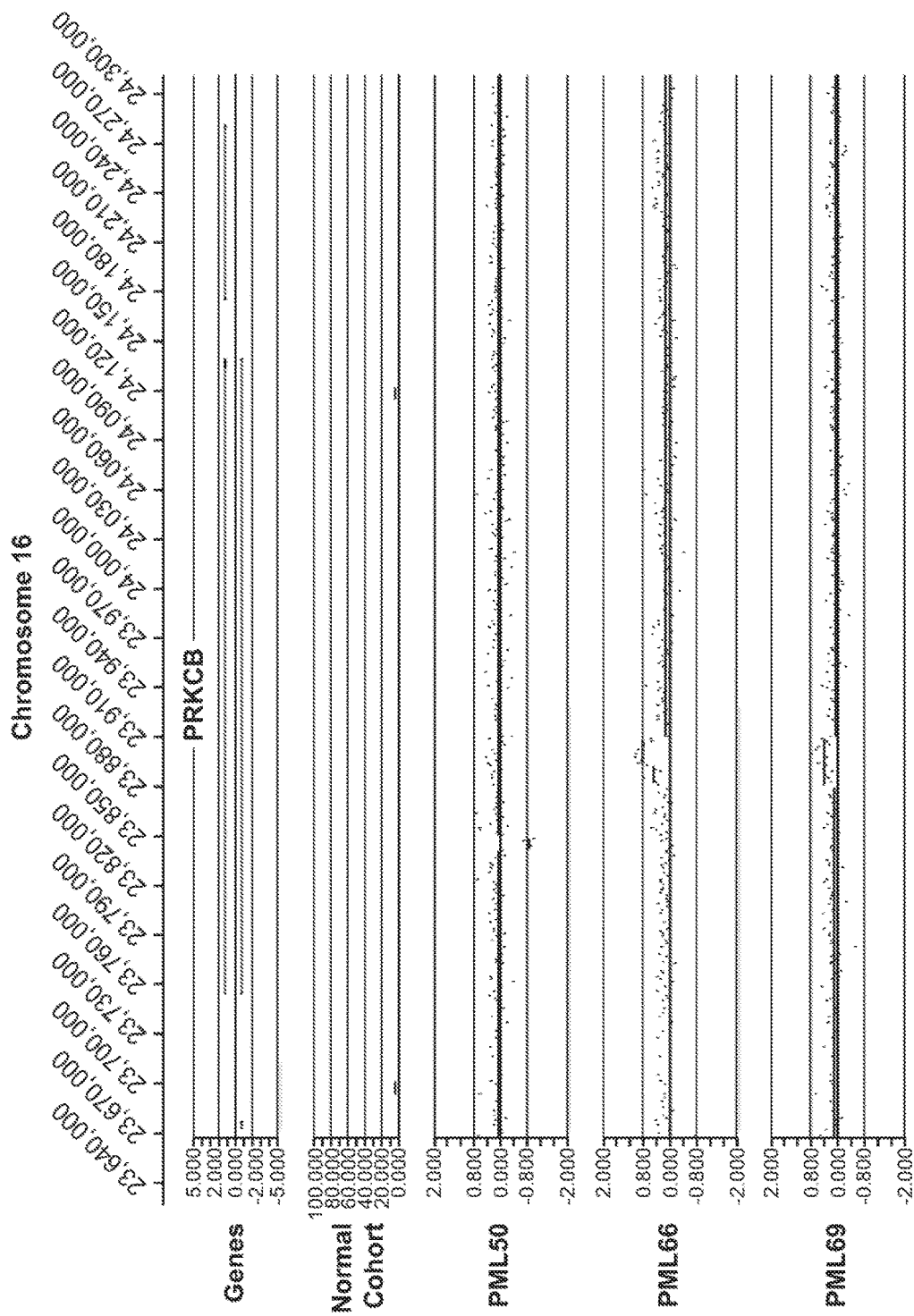
FIG. 1 represents an example of a gene (PRKCB) impacted by germline and acquired CNVs.
Figure 1:
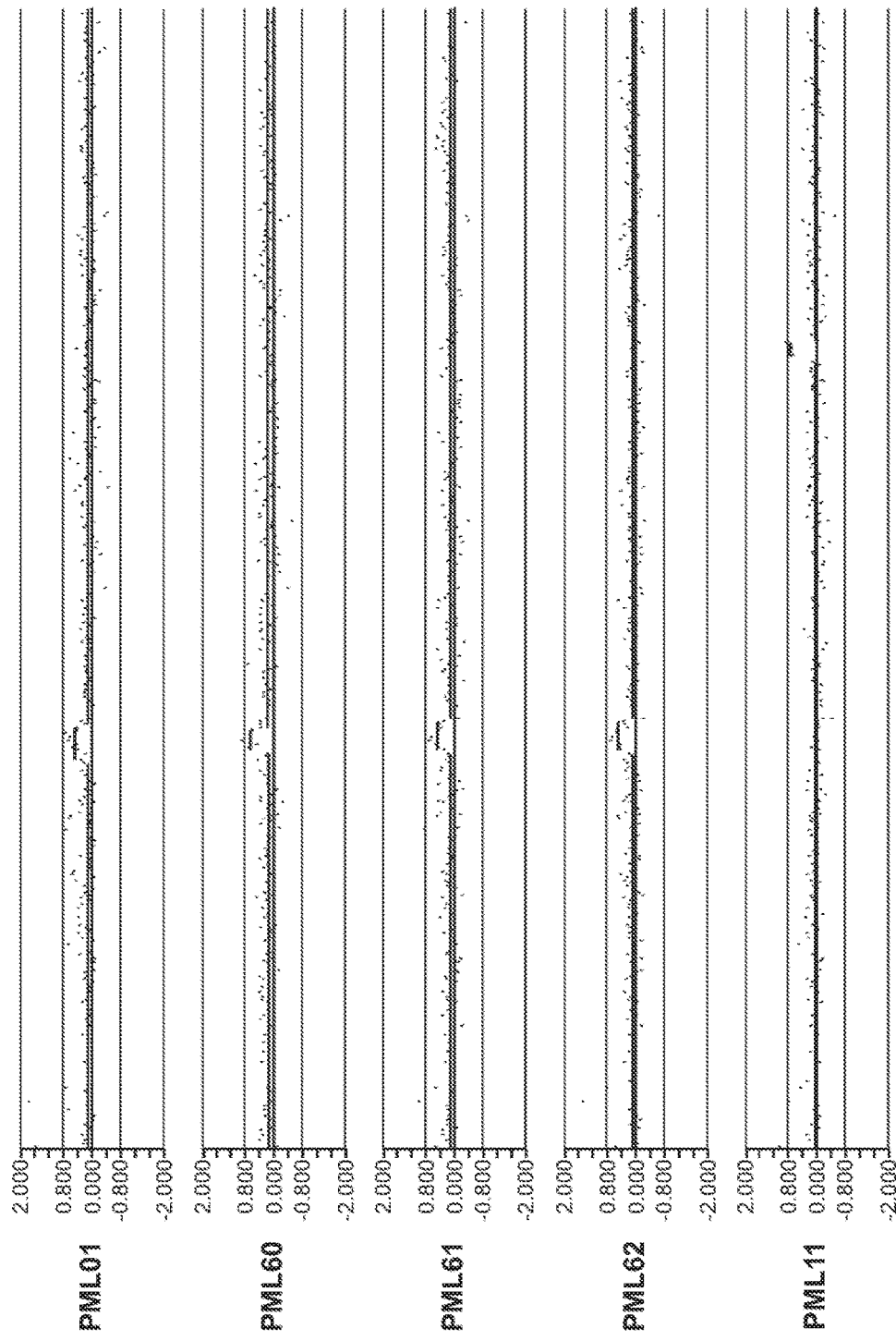

Provided herein is a method of treating a condition in a subject in need thereof, comprising: administering a therapeutically effective amount of one or more immunosuppressive medications to the subject, wherein the subject is identified as not having a risk of developing progressive multifocal leukoencephalopathy (PML) by a genetic test. In some embodiments, the subject is identified as not having a high risk of developing PML by a genetic test.

In some embodiments, the condition is a cancer, an organ transplant, or an autoimmune disease.

In some embodiments, the condition is an autoimmune disease.

In some embodiments, the autoimmune disease is selected from the group consisting of Addison disease, Anti-NMDA receptor encephalitis, antisynthetase syndrome, Aplastic anemia, autoimmune anemias, Autoimmune hemolytic anemia, Autoimmune pancreatitis, Behcet's Disease, bullous skin disorders, Celiac disease—sprue (gluten-sensitive enteropathy), chronic fatigue syndrome, Chronic inflammatory demyelinating polyneuropathy, chronic lymphocytic leukemia, Crohn's disease, Dermatomyositis, Devic's disease, Erythroblastopenia, Evans syndrome, Focal segmental glomerulosclerosis, Granulomatosis with polyangiitis, Graves disease, Graves' ophthalmopathy, Guillain-Barre syndrome, Hashimoto thyroiditis, idiopathic thrombocytopenic purpura (ITP), IgA nephropathy, IgA-mediated autoimmune diseases, IgG4-related disease, Inflammatory bowel disease, Juvenile idiopathic arthritis, Multiple sclerosis, Myasthenia gravis, myeloma, non-Hodgkin's lymphoma, Opsoclonus myoclonus syndrome (OMS), Pemphigoid, Pemphigus, pemphigus vulgaris, Pernicious anemia, polymyositis, Psoriasis, pure red cell aplasia, Reactive arthritis, Rheumatoid arthritis, Sarcoidosis, scleroderma, Sjögren syndrome, Systemic lupus erythematosus, Thrombocytopenic purpura, Thrombotic thrombocytopenic purpura, Type I diabetes, Ulcerative colitis, Vasculitis (e.g., vasculitis associated with anti-neutrophil cytoplasmic antibody), Vitiligo, and combinations thereof.

In some embodiments, the autoimmune disease is multiple sclerosis or Crohn's disease. In some embodiments, the autoimmune disease is multiple sclerosis. In some embodiments, the multiple sclerosis is a relapsing form of multiple sclerosis. In some embodiments, the multiple sclerosis is relapsing-remitting multiple sclerosis (RRMS). In some embodiments, the multiple sclerosis is primary progressive multiple sclerosis (PPMS). In some embodiments, the multiple sclerosis is secondary progressive multiple sclerosis (SPMS).

In some embodiments, the one or more immunosuppressive medications comprise a glucocorticoid, cytostatic, antibody, drug acting on immunophilins, interferon, opioid, TNF binding protein, mycophenolate, small biological agent, small molecule, organic compound, or any combination thereof.

In some embodiments, the one or more immunosuppressive medications comprise abatacept, adalimumab, alefacept, alemtuzumab, anakinra, azathioprine, belimumab, bendamustine, bevacizumab, bortezomib (e.g., Velcade), eculizumab (e.g., Soliris), leflunomide, brentuximab vedotin, capecitabine, carboplatin, cetuximab, chlorambucil, cladribine, cyclophosphamide, cyclosporine, daclizumab, doxorubicin, efalizumab, etanercept, etoposide, fludarabine, gemcitabine, ibritumomab tiuxetan, imatinib, infliximab, lenalidomide, methotrexate, mycophenolate mofetil, natalizumab, oxaliplatin, rituximab, tocilizumab, tofacitinib, ustekinumab, vedolizumab, vincristine, belatacept, cytotoxic chemotherapy, corticosteroids, antithymocyte Ig, basiliximab, muromonab-CD3, mycophenolic acid, prednisone/prednisolone, sirolimus (rapamycin), tacrolimus, dimethyl fumarate, fingolimod, ruxolitinib, interferon beta-1a, interferon beta-1b, glatiramer acetate, peginterferon beta-1a, teriflunomide, mitoxantrone, ocrelizumab, asparaginase, bleomycin, busulfan, carmustine, certolizumab, ibrutinib, idarubicin, idelalisib, hydrocortisone, ifosfamide, levamisole, mercaptopurine, mizoribine, obinutuzumab, ofatumumab, tegafur/gimeracil/oteracil, thiotepa, vinblastine, or any combination thereof.

In some embodiments, the one or more immunosuppressive medications comprise interferon beta-1a, interferon beta-1b, glatiramer acetate, peginterferon beta-1a, teriflunomide, fingolimod, dimethyl fumarate, alemtuzumab, mitoxantrone, natalizumab, daclizumab, ocrelizumab, or any combination thereof.

In some embodiments, the subject has not taken the one or more immunosuppressive medications. In some embodiments, the subject has taken the one or more immunosuppressive medications. In some embodiments, the subject is taking the one or more immunosuppressive medications.

In some embodiments, the one or more immunosuppressive medications comprise natalizumab (Tysabri). In some embodiments, at least about 10 mg of the natalizumab is administered, for example, at least about 10 mg, at least about 15 mg, at least about 20 mg, at least about 30 mg, at least about 40 mg, at least about 50 mg, at least about 60 mg, at least about 70 mg, at least about 80 mg, at least about 90 mg, at least about 100 mg, at least about 150 mg, at least about 200 mg, at least about 250 mg, or at least about 300 mg of the natalizumab is administered. In some embodiments, at least about 10 mg of the natalizumab is administered via intravenous infusion. In some embodiments, at least about 10 mg of the natalizumab is administered via intravenous infusion in four weeks.

In some embodiments, about 100 mg to about 500 mg of the natalizumab is administered, for example, about 100 mg to about 200 mg, about 100 mg to about 300 mg, about 100 mg to about 400 mg, about 100 mg to about 500 mg, about 200 mg to about 300 mg, about 200 mg to about 400 mg, about 200 mg to about 500 mg, about 300 mg to about 400 mg, about 300 mg to about 500 mg, or about 400 mg to about 500 mg of the natalizumab is administered. In some embodiments, about 100 mg to about 500 mg of the natalizumab is administered via intravenous infusion. In some embodiments, about 100 mg to about 500 mg of the natalizumab is administered via intravenous infusion in four weeks. In some embodiments, about 300 mg of the natalizumab is administered. In some embodiments, about 300 mg of the natalizumab is administered via intravenous infusion. In some embodiments, about 300 mg of the natalizumab is administered via intravenous infusion in four weeks.

In some embodiments, the subject does not have one or more genetic variations associated with a risk of developing PML. In some embodiments, the subject does not have one or more genetic variations associated with a high risk of developing PML.

In some embodiments, the genetic test comprises detecting one or more genetic variations associated with a risk of developing PML in a polynucleic acid sample from the subject. In some embodiments, the genetic test comprises detecting one or more genetic variations associated with a high risk of developing PML in a polynucleic acid sample from the subject.

In some embodiments, the one or more genetic variations comprise a point mutation, polymorphism, single nucleotide polymorphism (SNP), single nucleotide variation (SNV), translocation, insertion, deletion, amplification, inversion, interstitial deletion, copy number variation (CNV), loss of heterozygosity, or any combination thereof.

In some embodiments, the one or more genetic variations disrupt or modulate a corresponding gene according to Tables 3 and 6.

Provided herein is a method of treating a condition in a subject in need of natalizumab therapy, comprising: administering a therapeutically effective amount of natalizumab to the subject, wherein the subject is identified as not having one or more genetic variations that disrupt or modulate a corresponding gene according to Tables 3 and 6.

Provided herein is a method of reducing a risk of a subject developing progressive multifocal leukoencephalopathy (PML) comprising administering a therapeutically effective amount of natalizumab to the subject, wherein the subject is identified as not having one or more genetic variations that disrupt or modulate a corresponding gene according to Tables 3 and 6.

In some embodiments, the condition is multiple sclerosis.

In some embodiments, the condition is Crohn's disease.

Provided herein is a method of treating multiple sclerosis comprising administering natalizumab to a subject with multiple sclerosis, wherein the subject is identified as not having one or more genetic variations that disrupt or modulate a corresponding gene according to Tables 3 and 6.

Provided herein is a method of treating Crohn's disease comprising administering natalizumab to a subject with Crohn's disease, wherein the subject is identified as not having one or more genetic variations that disrupt or modulate a corresponding gene according to Tables 3 and 6.

Provided herein is a method of treating multiple sclerosis comprising testing a subject with multiple sclerosis for the presence of one or more genetic variations that disrupt or modulate a corresponding gene according to Tables 3 and 6, determining that the subject does not have the one or more genetic variations that disrupt or modulate a corresponding gene according to Tables 3 and 6, and administering natalizumab to the subject that was determined not to have the one or more genetic variations that disrupt or modulate a corresponding gene according to Tables 3 and 6.

Provided herein is a method of treating Crohn's disease comprising testing a subject with Crohn's disease for the presence of one or more genetic variations that disrupt or modulate a corresponding gene according to Tables 3 and 6, determining that the subject does not have the one or more genetic variations that disrupt or modulate a corresponding gene according to Tables 3 and 6, and administering natalizumab to the subject that was determined not to have the one or more genetic variations that disrupt or modulate a corresponding gene according to Tables 3 and 6.

Provided herein is a method of reducing a risk of a subject developing progressive multifocal leukoencephalopathy (PML) comprising testing a subject for the presence of one or more genetic variations that disrupt or modulate a corresponding gene according to Tables 3 and 6, determining that the subject has at least one of the one or more genetic variations that disrupt or modulate a corresponding gene according to Tables 3 and 6, and advising against administering natalizumab to the subject that was determined to have at least one of the one or more genetic variations that disrupt or modulate a corresponding gene according to Tables 3 and 6.

In some embodiments, the subject has multiple sclerosis.

In some embodiments, the subject has Crohn's disease.

Provided herein is a method of treating multiple sclerosis comprising testing a subject with multiple sclerosis for the presence of one or more genetic variations that disrupt or modulate a corresponding gene according to Tables 3 and 6, determining that the subject has at least one of the one or more genetic variations that disrupt or modulate a corresponding gene according to Tables 3 and 6, and advising against administering natalizumab to the subject that was determined to have at least one of the one or more genetic variations that disrupt or modulate a corresponding gene according to Tables 3 and 6.

Provided herein is a method of treating Crohn's disease comprising testing a subject with Crohn's disease for the presence of one or more genetic variations that disrupt or modulate a corresponding gene according to Tables 3 and 6, determining that the subject has at least one of the one or more genetic variations that disrupt or modulate a corresponding gene according to Tables 3 and 6, and advising against administering natalizumab to the subject that was determined to have at least one of the one or more genetic variations that disrupt or modulate a corresponding gene according to Tables 3 and 6.

In some embodiments, the advising comprises advising that administering natalizumab is contraindicated.

In some embodiments, the advising comprises advising that administering natalizumab increases the risk of the subject developing progressive multifocal leukoencephalopathy (PML)

In some embodiments, the advising comprises advising that administering natalizumab is a factor that increases the risk of the subject developing progressive multifocal leukoencephalopathy (PML).

In some embodiments, the testing comprises testing the subject for the presence of one or more genetic variations that disrupt or modulate a corresponding gene according to Table 13.

In some embodiments, the testing comprises testing the subject for the presence of one or more genetic variations that disrupt or modulate a corresponding gene according to Table 14.

In some embodiments, the testing comprises testing the subject for the presence of one or more genetic variations that disrupt or modulate a corresponding gene according to Table 15.

In some embodiments, the testing comprises testing the subject for the presence of one or more genetic variations that disrupt or modulate a corresponding gene according to Table 16.

In some embodiments, the testing comprises testing the subject for the presence of one or more genetic variations that disrupt or modulate a corresponding gene according to Table 17.

In some embodiments, the testing comprises testing the subject for the presence of one or more genetic variations that disrupt or modulate a corresponding gene according to Table 18.

In some embodiments, the testing comprises testing the subject for the presence of one or more genetic variations that disrupt or modulate a corresponding gene selected from the group consisting of ALG12, AP3B1, ASH1L, ATL2, ATM, ATR, BACH1, BLM, CHD7, CLCN7, CR2, CX3CR1, DOCK2, DOCK8, EHF, EPG5, FAS, FUK, GFI1, GOLGB1, GTPBP4, HIVEP1, HIVEP2, HIVEP3, IFIH1, IGLL1, IL10, IL12B, IL17F, ITK, ITSN2, JAGN1, KITLG, LRBA, LYST, MALT1, MAVS, MCEE, NHEJ1, NOD2, NRIP1, ORAI1, PGM3, PIK3CD, PLCG2, PNP, POLE, PRF1, RBCK1, RBFOX1, RNASEL, RTEL1, SALL2, SHARPIN, SNAP29, STIM2, STXBP2, TAP1, TBC1D16, TCIRG1, TICAM1, TMEM173, TNFRSF10A, TTC7A, VPS13B, and combinations thereof.

In some embodiments, the testing comprises testing the subject for the presence of one or more genetic variations that disrupt or modulate a corresponding gene selected from the group consisting of PLCG2, RBCK1, EPG5, IL17F, SHARPIN, PRF1, JAGN1, TAP1, POLE, LRBA, EHF, IL12B, ATL2, NHEJ1, LYST, HIVEP1, AP3B1, TNFRSF10A, PIK3CD, PNP, MCEE, DOCK2, ALG12, and combinations thereof.

In some embodiments, the testing comprises testing the subject for the presence of one or more genetic variations that disrupt or modulate a corresponding gene selected from the group consisting of PLCG2, IFIH1, TCIRG1, IGLL1, MAVS, SHARPIN, CHD7, CX3CR1, LRBA, HIVEP3, RNASEL, and combinations thereof.

In some embodiments, the testing comprises testing the subject for the presence of one or more genetic variations that disrupt or modulate a corresponding gene selected from the group consisting of SHARPIN, RTEL1, PGM3, TMEM173, CLCN7, MAVS, ORAI1, RBFOX1, MALT1, GFI1, DOCK2, ATM, SNAP29, TICAM1, GTPBP4, BACH1, STXBP2, FAS, GOLGB1, FUK, IL10, ITK, STIM2, ASH1L, TBC1D16, LYST, SALL2, CHD7, BLM, NOD2, IGLL1, TTC7A, KITLG, ATR, ATM, CR2, HIVEP2, ITSN2, DOCKS, VPS13B, NRIP1, and combinations thereof.

In some embodiments, the testing comprises testing the subject for the presence of one or more genetic variations that disrupt or modulate a corresponding gene selected from the group consisting of SHARPIN, IFIH1, PLCG2, CHD7, and combinations thereof.

In some embodiments, the testing comprises testing the subject for the presence of one or more genetic variations that disrupt or modulate a corresponding gene selected from the group consisting of PLCG2, POLE, LRBA, EPG5, SHARPIN, and combinations thereof.

In some embodiments, the testing comprises testing the subject for the presence of one or more genetic variations that disrupt or modulate a corresponding gene selected from the group consisting of PLCG2, CHD7, IFIH1, AP3B1, EPG5, PIK3CD, LRBA, SHARPIN, and combinations thereof.

In some embodiments, the subject is identified as not having a risk of developing progressive multifocal leukoencephalopathy (PML) by a genetic test. In some embodiments, the subject is identified as not having a high risk of developing progressive multifocal leukoencephalopathy (PML) by a genetic test.

In some embodiments, the testing comprises assaying a polynucleic acid sample from the subject for the one or more genetic variations.

In some embodiments, the one or more genetic variations result in a loss of function of the corresponding gene.

In some embodiments, the corresponding gene comprises a gene selected from the group consisting of gene numbers (GNs) GN1-GN490.

In some embodiments, the corresponding gene comprises a gene selected from the group consisting of gene numbers (GNs) 1-156 (in Table 3).

In some embodiments, the corresponding gene comprises a gene selected from the group consisting of gene numbers (GNs) in Table 6.

In some embodiments, the corresponding gene comprises a gene selected from the group consisting of PLCG2, RBCK1, EPG5, IL17F, SHARPIN, PRF1, JAGN1, TAP1, POLE, LRBA, EHF, IL12B, ATL2, NHEJ1, LYST, HIVEP1, AP3B1, TNFRSF10A, PIK3CD, PNP, MCEE, DOCK2 and ALG12 (see Table 13).

In some embodiments, the one or more genetic variations are encoded by a sequence with at least 60%, at least 70%, at least 80%, at least 90%, at least 95%, or at least 99% sequence identity to SEQ ID NOs 1-172 or SRN1-SRN363, with 100% sequence identity to SEQ ID NOs 1000-1329, or with at least 80% and less than 100% sequence identity to GN1-GN490, or complements thereof.

In some embodiments, the one or more genetic variations comprise a genetic variation encoded by a CNV with at least 60%, at least 70%, at least 80%, at least 90%, at least 95%, or at least 99% sequence identity to SEQ ID NOs 1-172, or complements thereof.

In some embodiments, the one or more genetic variations comprise a genetic variation encoded by a CNV sub-region (SRN) with at least 60%, at least 70%, at least 80%, at least 90%, at least 95%, or at least 99% sequence identity to SRN1-SRN363, or complements thereof.

In some embodiments, the one or more genetic variations comprise a genetic variation encoded by a single nucleotide variation (SNV) with a sequence of any one of SEQ ID NOs: 1000-1329, or complements thereof.

In some embodiments, the one or more genetic variations comprise a genetic variation encoded by a sequence with at least 80% and less than 100% sequence identity to GN1-GN490, or complements thereof.

In some embodiments, the one or more genetic variations comprise a genetic variation encoded by a single nucleotide variation (SNV) with a sequence of any one of SEQ ID NO: 1000, 1001, 1002, 1009, 1010, 1011, 1012, 1014, 1016, 1017, 1019, 1020, 1028, 1032, 1033, 1034, 1035, 1036, 1037, 1040, 1041, 1043, 1051, 1054, 1056, 1057, 1058, 1059, 1061, 1062, 1063, 1066, 1068, 1069, 1070, 1071, 1073, 1074, 1075, 1076, 1077, 1078, 1080, 1082, 1084, 1090, 1092, 1098, 1099, 1100, 1101, 1104, 1107, 1114, 1116, 1118, 1121, 1122, 1123, 1125, 1126, 1127, 1128, 1129, 1130, 1131, 1133, 1135, 1136, 1137, 1138, 1142, 1146, 1147, 1148, 1150, 1152, 1154, 1157, 1160, 1161, 1165, 1166, 1167, 1168, 1169, 1171, 1174, 1175, 1176, 1177, 1178, 1179, 1180, 1181, 1182, 1183, 1184, 1193, 1194, 1200, 1201, 1202, 1203, 1204, 1208, 1219, 1220, 1221, 1222, 1226, 1227, 1228, 1229, 1230, 1231, 1232, 1235, 1239, 1247, 1248, 1249, 1250, 1251, 1252, 1254, 1255, 1256, 1259, 1260, 1261, 1263, 1264, 1266, 1267, 1273, 1278, 1279, 1283, 1284, 1286, 1287, 1289, 1290, 1291, 1299, 1300, 1301, 1304, 1311, 1327 or 1328 (see Tables 7 and 8), or complements thereof.

In some embodiments, the one or more genetic variations comprise a genetic variation encoded by a single nucleotide variation (SNV) with a sequence of any one of SEQ ID NO: 1011, 1020, 1028, 1032, 1034, 1035, 1036, 1040, 1056, 1069, 1073, 1077, 1101, 1114, 1123, 1125, 1126, 1127, 1135, 1142, 1146, 1147, 1148, 1152, 1154, 1157, 1167, 1174, 1184, 1193, 1194, 1203, 1208, 1221, 1222, 1229, 1235, 1252, 1255, 1256, 1259, 1260, 1261, 1263, 1273, 1278, 1279, 1284, 1287, 1289, 1299 or 1311 (see Table 7), or complements thereof.

In some embodiments, the one or more genetic variations comprise a genetic variation encoded by a single nucleotide variation (SNV) with a sequence of any one of SEQ ID NO: 1000, 1001, 1002, 1009, 1010, 1012, 1014, 1016, 1017, 1019, 1033, 1037, 1041, 1043, 1051, 1054, 1057, 1058, 1059, 1061, 1062, 1063, 1066, 1068, 1070, 1071, 1074, 1075, 1076, 1078, 1080, 1082, 1084, 1090, 1092, 1098, 1099, 1100, 1104, 1107, 1116, 1118, 1121, 1122, 1128, 1129, 1130, 1131, 1133, 1136, 1137, 1138, 1146, 1147, 1150, 1152, 1160, 1161, 1165, 1166, 1168, 1169, 1171, 1175, 1176, 1177, 1178, 1179, 1180, 1181, 1182, 1183, 1200, 1201, 1202, 1204, 1219, 1220, 1226, 1227, 1228, 1230, 1231, 1232, 1239, 1247, 1248, 1249, 1250, 1251, 1252, 1254, 1264, 1266, 1267, 1278, 1279, 1283, 1286, 1290, 1291, 1300, 1301, 1304, 1327 or 1328 (see Table 8), or complements thereof.

In some embodiments, the one or more genetic variations comprise a genetic variation selected from the group consisting of chr16:81942175 A>G, chr2:163136505 C>G, chr11:67818269 G>A, chr22:23917192 G>T, chr20: 3846397 C>T, chr8:145154222, G>A chr8:61654298 T>A, chr3:39323163 A>C, chr4:151199080 G>A, chr1:42047208 C>G, chr2:163124051 C>T, chr1:182554557 C>T, chr8: 145154824 A>C, chr20:62305450 C>T, chr22:23915745 G>A, chr6:83884161 C>G, chr11:108202772 G>T, chr5: 138856923 C>T, chr16:1510535 C>T, chr20:3843027 C>A, chr12:122064788 G>GT, chr16:7714909 C>T, chr18: 56401523 C>T, chr1:92946625 G>C, chr5:169081453 G>C, chr11:108117787 C>T, chr22:21235389 A>G, chr19: 4817657 C>T, chr10:1060218 G>A, chr21:30698953 T>G, chr9:304628 G>A, chr19:7712287 G>C, chr10:90771767 G>A, chr3:121415370 T>C, chr16:70503095 A>G, chr1:

206945738 C>T, chr5:156593120 C>T, chr4:27019452 C>T, chr1:155317682 C>T, chr17:77926526 C>T, chr1: 235840495 G>T, chr14:21993359 G>A, chr8:61757805 C>T, chr15:91306241 G>A, chr16:50741791 C>T, chr22: 23915583 T>C, chr2:47205921 C>T, chr12:88900891 C>A, chr3:142281353 C>G, chr11:108123551 C>T, chr1: 207641950 C>T, chr6:143092151 T>C, chr2:24431184 C>T, chr2:24432937 C>T, chr9:312134 G>A, chr8: 100205255 G>A, chr21:16339852 T>C, and any combination thereof (see Tables 14 and 15).

In some embodiments, the one or more genetic variations comprise a genetic variation selected from the group consisting of chr16:81942175 A>G, chr2:163136505 C>G, chr11:67818269 G>A, chr22:23917192 G>T, chr20: 3846397 C>T, chr8:145154222, G>A chr8:61654298 T>A, chr3:39323163 A>C, chr4:151199080 G>A, chr1:42047208 C>G, chr2:163124051 C>T, chr1:182554557 C>T, and any combination thereof (see Table 14).

In some embodiments, the one or more genetic variations comprise a genetic variation selected from the group consisting of chr8:145154824 A>C, chr20:62305450 C>T, chr22:23915745 G>A, chr6:83884161 C>G, chr11: 108202772 G>T, chr5:138856923 C>T, chr16:1510535 C>T, chr20:3843027 C>A, chr12:122064788 G>GT, chr16: 7714909 C>T, chr18:56401523 C>T, chr1:92946625 G>C, chr5:169081453 G>C, chr11:108117787 C>T, chr22: 21235389 A>G, chr19:4817657 C>T, chr10:1060218 G>A, chr21:30698953 T>G, chr9:304628 G>A, chr19:7712287 G>C, chr10:90771767 G>A, chr3:121415370 T>C, chr16: 70503095 A>G, chr1:206945738 C>T, chr5:156593120 C>T, chr4:27019452 C>T, chr1:155317682 C>T, chr17: 77926526 C>T, chr1:235840495 G>T, chr14:21993359 G>A, chr8:61757805 C>T, chr15:91306241 G>A, chr16: 50741791 C>T, chr22:23915583 T>C, chr2:47205921 C>T, chr12:88900891 C>A, chr3:142281353 C>G, chr11: 108123551 C>T, chr1:207641950 C>T, chr6:143092151 T>C, chr2:24431184 C>T, chr2:24432937 C>T, chr9: 312134 G>A, chr8:100205255 G>A, chr21:16339852 T>C, and any combination thereof (see Table 15).

In some embodiments, the SNV is a heterozygous SNV.

In some embodiments, the SNV is a homozygous SNV.

In some embodiments, the one or more genetic variations comprise a pair of single nucleotide variations (SNVs), wherein the pair of SNVs are encoded by any one of SEQ ID NO pairs: 1003 and 1004, 1003 and 1005, 1006 and 1007, 1024 and 1025, 1030 and 1031, 1047 and 1048, 1049 and 1050, 1063 and 1064, 1063 and 1065, 1063 and 1066, 1075 and 1076, 1091 and 1093, 1091 and 1096, 1093 and 1095, 1094 and 1097, 1098 and 1099, 1098 and 1100, 1099 and 1100, 1102 and 1103, 1104 and 1106, 1104 and 1107, 1104 and 1108, 1104 and 1109, 1104 and 1110, 1104 and 1111, 1104 and 1112, 1110 and 1111, 1112 and 1113, 1119 and 1120, 1124 and 1125, 1124 and 1126, 1125 and 1126, 1140 and 1141, 1142 and 1144, 1146 and 1151, 1147 and 1148, 1147 and 1149, 1153 and 1146, 1153 and 1147, 1155 and 1156, 1160 and 1161, 1165 and 1166, 1186 and 1187, 1188 and 1193, 1189 and 1193, 1191 and 1192, 1191 and 1193, 1191 and 1195, 1192 and 1193, 1192 and 1195, 1196 and 1197, 1206 and 1207, 1210 and 1218, 1211 and 1213, 1212 and 1213, 1213 and 1215, 1213 and 1216, 1213 and 1217, 1233 and 1238, 1242 and 1243, 1245 and 1246, 1263 and 1260, 1269 and 1279, 1270 and 1279, 1270 and 1282, 1271 and 1279, 1274 and 1279, 1278 and 1279, 1278 and 1281, 1279 and 1280, 1279 and 1281, 1279 and 1282, 1292 and 1293, 1296 and 1297, 1305 and 1314, 1306 and 1310, 1313 and 1321 or 1315 and 1322 (see Table 9 or Tables 9 and 7 for a subset), or complements thereof.

In some embodiments, the one or more genetic variations comprise a genetic variation encoded by a CNV with at least 60%, at least 70%, at least 80%, at least 90%, at least 95%, or at least 99% sequence identity to any one of SEQ ID NOs 157, 2, 140, 65, 26, 14 or 45 (see Tables 7 and 8), or complements thereof.

In some embodiments, the one or more genetic variations comprise a genetic variation encoded by a CNV with at least 60%, at least 70%, at least 80%, at least 90%, at least 95%, or at least 99% sequence identity to any one of SEQ ID NOs 2, 140, 65, 26, 14 or 45 (see Table 7), or complements thereof.

In some embodiments, the one or more genetic variations comprise a genetic variation encoded by a CNV with at least 60%, at least 70%, at least 80%, at least 90%, at least 95%, or at least 99% sequence identity to SEQ ID NO 157 (see Table 8), or a complement thereof.

In some embodiments, the one or more genetic variations comprise a CNV-SNV pair comprising a CNV and a single nucleotide variation (SNV), wherein the SNV of the CNV-SNV pair is encoded by any one of SEQ ID NO pairs: 146 and 1301, 85 and 1173, 58 and 1107, 58 and 1104, 91 and 1199, 103 and 1225, 103 and 1086 or 41 and 1223 (see Tables 1 and 10), or complements thereof.

In some embodiments, the one or more genetic variations comprise a genetic variation selected from the group consisting of: chr8:145154222 G>A, chr2:163136505 C>G, chr16:81942175 A>G, chr8:61654298 T>A, and combinations thereof (see Tables 14 and 16).

In some embodiments, the one or more genetic variations disrupt or modulate one or more of the following genes: PLCG2, POLE, LRBA, EPG5 and SHARPIN (see Table 17).

In some embodiments, the one or more genetic variations disrupt or modulate one or more of the following genes: PLCG2, CHD7, IFIH1, AP3B1, EPG5, PIK3CD, LRBA and SHARPIN (see Table 18).

In some embodiments, the corresponding gene encodes a transcript with a sequence that has at least 60%, at least 70%, at least 80%, at least 90%, at least 95%, or at least 99% sequence identity to any one of SEQ ID NOs 173-455 or 1500-2177 (see Tables 4 and 12), or complements thereof.

In some embodiments, the corresponding gene encodes a transcript with a sequence that has at least 60%, at least 70%, at least 80%, at least 90%, at least 95%, or at least 99% sequence identity to any one of SEQ ID NOs 173-455 (see Table 4), or complements thereof.

In some embodiments, the corresponding gene encodes a transcript with a sequence that has at least 60%, at least 70%, at least 80%, at least 90%, at least 95%, or at least 99% sequence identity to any one of SEQ ID NOs 1500-2177 (see Table 12), or complements thereof.

In some embodiments, the one or more genetic variations comprise 2 or 3 or 4 or 5 or more genetic variations.

In some embodiments, the one or more genetic variations comprise 10 or more genetic variations.

In some embodiments, the one or more genetic variations comprise 20 or more genetic variations.

In some embodiments, the one or more genetic variations comprise 50 or more genetic variations.

In some embodiments, the genetic test or the testing comprises microarray analysis, PCR, sequencing, nucleic acid hybridization, or any combination thereof.

In some embodiments, the genetic test or the testing comprises microarray analysis selected from the group consisting of a Comparative Genomic Hybridization (CGH) array analysis and an SNP array analysis.

In some embodiments, the genetic test or the testing comprises sequencing, wherein the sequencing is selected from the group consisting of Massively Parallel Signature Sequencing (MPSS), polony sequencing, 454 pyrosequencing, Illumina sequencing, Illumina (Solexa) sequencing using 10× Genomics library preparation, SOLiD sequencing, ion semiconductor sequencing, DNA nanoball sequencing, heliscope single molecule sequencing, single molecule real time (SMRT) sequencing, RNAP sequencing, Nanopore DNA sequencing, sequencing by hybridization, and microfluidic Sanger sequencing.

In some embodiments, the genetic test or the testing comprises analyzing a whole genome of the subject.

In some embodiments, the genetic test or the testing comprises analyzing a whole exome of the subject.

In some embodiments, the genetic test or the testing comprises analyzing nucleic acid information that has already been obtained for a whole genome or a whole exome of the subject.

In some embodiments, the nucleic acid information is obtained from an in silico analysis.

In some embodiments, the subject is a human subject.

In some embodiments, the polynucleic acid sample comprises a polynucleic acid from blood, saliva, urine, serum, tears, skin, tissue, or hair of the subject.

In some embodiments, the method further comprises treating the subject with an agent that reduces a viral load in the subject.

In some embodiments, the immunosuppressive agent is administered after the viral load is reduced.

In some embodiments, the viral load is a JCV viral load.

In some embodiments, the agent that reduces the viral load is an agent that targets JCV.

In some embodiments, the method further comprises analyzing for a presence of JCV in a biological sample from the subject. In some embodiments, the method comprises a JCV-antibody test. In some embodiments, the JCV-antibody test has a negative result. In some embodiments, the JCV-antibody test does not detect a presence of JCV in the biological sample from the subject. In some embodiments, the JCV-antibody test detects a presence of JCV in the biological sample from the subject.

In some embodiments, the analyzing for a presence of JCV comprises contacting a JCV detection reagent to the biological sample.

In some embodiments, the JCV detection reagent is selected from the group consisting of an anti-JCV antibody, a JCV specific primer, and combinations thereof.

Provided herein is a method of treating a condition in a subject in need thereof, comprising: administering a therapeutically effective amount of one or more immunosuppressive medications to the subject, and one or more agents that reduce a viral load in the subject, wherein the subject is identified as not having a risk of developing progressive multifocal leukoencephalopathy (PML) by a genetic test. In some embodiments, the subject is identified as not having a high risk of developing progressive multifocal leukoencephalopathy (PML) by a genetic test.

Provided herein is a method of treating a condition in a subject in need thereof, comprising: analyzing a polynucleic acid sample from the subject for one or more genetic variations that disrupt or modulate a gene of GN1-GN490, wherein a genetic variation of the one or more genetic variations that disrupt or modulate a gene of GN1-GN490 is not present in the polynucleic acid sample; identifying the subject as not having a risk of developing PML; administering a therapeutically effective amount of one or more immunosuppressive medications to the subject. In some embodiments, the method comprises identifying the subject as not having a high risk of developing PML.

Provided herein is a method of identifying a subject as having a risk of developing PML, comprising: analyzing a polynucleic acid sample from the subject for one or more genetic variations that disrupt or modulate a gene of GN1-GN490, wherein a genetic variation of the one or more genetic variations that disrupt or modulate a gene of GN1-GN490 is not present in the polynucleic acid sample; identifying the subject as not having a risk of developing PML. In some embodiments, the method comprises identifying the subject as not having a high risk of developing PML.

Provided herein is a method of identifying a subject as having a risk of developing progressive multifocal leukoencephalopathy (PML) comprising obtaining a genetic test result from a polynucleic acid sample from a subject, and identifying the subject as having a risk of developing PML based on the genetic test result; wherein the subject is immunosuppressed.

Provided herein is a method of monitoring a subject as having a risk of developing progressive multifocal leukoencephalopathy (PML) comprising obtaining a genetic test result from a polynucleic acid sample from a subject, and identifying the subject as having an increased risk of developing PML based on the genetic test result; wherein the subject is immunosuppressed.

In some embodiments, the subject is on an immunosuppressive therapy.

Provided herein is a method of identifying a subject as having a risk of developing progressive multifocal leukoencephalopathy (PML) comprising detecting one or more genetic variations that disrupt or modulate a gene of GN1-GN490 in a polynucleic acid sample from a subject, and identifying the subject as having a risk of developing PML; wherein the subject is immunosuppressed.

Provided herein is a method of identifying a subject as having a risk of developing progressive multifocal leukoencephalopathy (PML) comprising: analyzing a polynucleic acid sample from the subject for one or more genetic variations that disrupt or modulate a gene of GN1-GN490, wherein a genetic variation of the one or more genetic variations that disrupt or modulate a gene of GN1-GN490 is present in the polynucleic acid sample; identifying the subject as having a risk of developing PML; wherein the subject is immunosuppressed. In some embodiments, the method comprises identifying the subject as having a high risk of developing PML.

In some embodiments, the subject has HIV. In some embodiments, the subject has HIV infection. In some embodiments, the subject is at risk of HIV infection.

In some embodiments, the condition is a cancer, a hematologic malignancy, an organ transplant, or an autoimmune disease. In some embodiments, the condition is idiopathic CD4+ lymphocytopenia (ICL).

In some embodiments, the condition is an autoimmune disease.

In some embodiments, the autoimmune disease is selected from the group consisting of Addison disease, Behcet's Disease, Inflammatory bowel disease, Celiac disease—sprue (gluten-sensitive enteropathy), Crohn's disease, Dermatomyositis, Focal segmental glomerulosclerosis, Graves disease, Hashimoto thyroiditis, Multiple sclerosis, Myasthenia gravis, Pemphigus, Pemphigoid, Aplastic anemia, Pernicious anemia, Autoimmune hemolytic anemia, Erythroblastopenia, Thrombocytopenic purpura, Evans syndrome, Vasculitis, Granulomatosis with polyangiitis, Chronic inflammatory demyelinating polyneuropathy, Guillain-Barre syndrome, Anti-NMDA receptor encephalitis, Devic's disease, Autoimmune pancreatitis, Opsoclonus myoclonus syndrome, IgG4-related disease, Psoriasis, Reactive arthritis, Rheumatoid arthritis, Juvenile idiopathic arthritis, Sarcoidosis, Sjögren syndrome, Systemic lupus erythematosus, Type I diabetes, Vitiligo, or Ulcerative colitis.

In some embodiments, the autoimmune disease is multiple sclerosis or Crohn's disease.

In some embodiments, the one or more immunosuppressive medications comprise a glucocorticoid, cytostatic, antibody, drug acting on immunophilins, interferon, opioid, TNF binding protein, mycophenolate, small biological agent, small molecule, organic compound, or any combination thereof.

In some embodiments, the one or more immunosuppressive medications comprise a interferon beta-1a, interferon beta-1b, glatiramer acetate, peginterferon beta-1a, teriflunomide, fingolimod, dimethyl fumarate, alemtuzumab, mitoxantrone, natalizumab, daclizumab, ocrelizumab, or any combination thereof.

In some embodiments, the one or more immunosuppressive medications comprise natalizumab (Tysabri).

In some embodiments, the one or more genetic variations comprise a point mutation, polymorphism, single nucleotide polymorphisms (SNP), single nucleotide variation (SNV), translocation, insertion, deletion, amplification, inversion, interstitial deletion, copy number variation (CNV), loss of heterozygosity, or any combination thereof.

In some embodiments, the one or more genetic variations result in a loss of function of the corresponding gene.

In some embodiments, the corresponding gene comprises a gene selected from the group consisting of gene numbers (GNs) GN1-GN490.

In some embodiments, the gene comprises a gene selected from the group consisting of gene numbers (GNs) 1-156 (in Table 3).

In some embodiments, the gene comprises a gene selected from the group consisting of gene numbers (GNs) in Table 6.

In some embodiments, the gene comprises a gene selected from the group consisting of PLCG2, RBCK1, EPG5, IL17F, SHARPIN, PRF1, JAGN1, TAP1, POLE, LRBA, EHF, IL12B, ATL2, NHEJ1, LYST, HIVEP1, AP3B1, TNFRSF10A, PIK3CD, PNP, MCEE, DOCK2 and ALG12 (see Table 13).

In some embodiments, the one or more genetic variations comprise a genetic variation encoded by a sequence with at least 60%, at least 70%, at least 80%, at least 90%, at least 95%, or at least 99% sequence identity to SEQ ID NOs 1-172 or SRN1-SRN363, with 100% sequence identity to SEQ ID NOs 1000-1329, or with at least 80% and less than 100% sequence identity to GN1-GN490, or complements thereof.

In some embodiments, the one or more genetic variations comprise a genetic variation encoded by a CNV with at least 60%, at least 70%, at least 80%, at least 90%, at least 95%, or at least 99% sequence identity to SEQ ID NOs 1-172, or complements thereof.

In some embodiments, the one or more genetic variations comprise a genetic variation encoded by a CNV sub-region (SRN) with at least 60%, at least 70%, at least 80%, at least 90%, at least 95%, or at least 99% sequence identity to SRN1-SRN363, or complements thereof.

In some embodiments, the one or more genetic variations are encoded by a single nucleotide variation (SNV) with a sequence of any one of SEQ ID NOs: 1000-1329, or complements thereof.

In some embodiments, the one or more genetic variations comprise a genetic variation encoded by a sequence with at least 80% and less than 100% sequence identity to GN1-GN490, or complements thereof.

In some embodiments, the one or more genetic variations comprise a genetic variation encoded by a single nucleotide variation (SNV) with a sequence of any one of SEQ ID NO: 1000, 1001, 1002, 1009, 1010, 1011, 1012, 1014, 1016, 1017, 1019, 1020, 1028, 1032, 1033, 1034, 1035, 1036, 1037, 1040, 1041, 1043, 1051, 1054, 1056, 1057, 1058, 1059, 1061, 1062, 1063, 1066, 1068, 1069, 1070, 1071, 1073, 1074, 1075, 1076, 1077, 1078, 1080, 1082, 1084, 1090, 1092, 1098, 1099, 1100, 1101, 1104, 1107, 1114, 1116, 1118, 1121, 1122, 1123, 1125, 1126, 1127, 1128, 1129, 1130, 1131, 1133, 1135, 1136, 1137, 1138, 1142, 1146, 1147, 1148, 1150, 1152, 1154, 1157, 1160, 1161, 1165, 1166, 1167, 1168, 1169, 1171, 1174, 1175, 1176, 1177, 1178, 1179, 1180, 1181, 1182, 1183, 1184, 1193, 1194, 1200, 1201, 1202, 1203, 1204, 1208, 1219, 1220, 1221, 1222, 1226, 1227, 1228, 1229, 1230, 1231, 1232, 1235, 1239, 1247, 1248, 1249, 1250, 1251, 1252, 1254, 1255, 1256, 1259, 1260, 1261, 1263, 1264, 1266, 1267, 1273, 1278, 1279, 1283, 1284, 1286, 1287, 1289, 1290, 1291, 1299, 1300, 1301, 1304, 1311, 1327 or 1328 (see Tables 7 and 8), or complements thereof.

In some embodiments, the one or more genetic variations comprise a genetic variation encoded by a single nucleotide variation (SNV) with a sequence of any one of SEQ ID NO: 1011, 1020, 1028, 1032, 1034, 1035, 1036, 1040, 1056, 1069, 1073, 1077, 1101, 1114, 1123, 1125, 1126, 1127, 1135, 1142, 1146, 1147, 1148, 1152, 1154, 1157, 1167, 1174, 1184, 1193, 1194, 1203, 1208, 1221, 1222, 1229, 1235, 1252, 1255, 1256, 1259, 1260, 1261, 1263, 1273, 1278, 1279, 1284, 1287, 1289, 1299 or 1311 (see Table 7), or complements thereof.

In some embodiments, the one or more genetic variations comprise a genetic variation encoded by a single nucleotide variation (SNV) with a sequence of any one of SEQ ID NO: 1000, 1001, 1002, 1009, 1010, 1012, 1014, 1016, 1017, 1019, 1033, 1037, 1041, 1043, 1051, 1054, 1057, 1058, 1059, 1061, 1062, 1063, 1066, 1068, 1070, 1071, 1074, 1075, 1076, 1078, 1080, 1082, 1084, 1090, 1092, 1098, 1099, 1100, 1104, 1107, 1116, 1118, 1121, 1122, 1128, 1129, 1130, 1131, 1133, 1136, 1137, 1138, 1146, 1147, 1150, 1152, 1160, 1161, 1165, 1166, 1168, 1169, 1171, 1175, 1176, 1177, 1178, 1179, 1180, 1181, 1182, 1183, 1200, 1201, 1202, 1204, 1219, 1220, 1226, 1227, 1228, 1230, 1231, 1232, 1239, 1247, 1248, 1249, 1250, 1251, 1252, 1254, 1264, 1266, 1267, 1278, 1279, 1283, 1286, 1290, 1291, 1300, 1301, 1304, 1327 or 1328 (see Table 8), or complements thereof.

In some embodiments, the one or more genetic variations comprise a genetic variation selected from the group consisting of chr16:81942175 A>G, chr2:163136505 C>G, chr11:67818269 G>A, chr22:23917192 G>T, chr20: 3846397 C>T, chr8:145154222, G>A chr8:61654298 T>A, chr3:39323163 A>C, chr4:151199080 G>A, chr1:42047208 C>G, chr2:163124051 C>T, chr1:182554557 C>T, chr8: 145154824 A>C, chr20:62305450 C>T, chr22:23915745 G>A, chr6:83884161 C>G, chr11:108202772 G>T, chr5: 138856923 C>T, chr16:1510535 C>T, chr20:3843027 C>A, chr12:122064788 G>GT, chr16:7714909 C>T, chr18: 56401523 C>T, chr1:92946625 G>C, chr5:169081453

G>C, chr11:108117787 C>T, chr22:21235389 A>G, chr19: 4817657 C>T, chr10:1060218 G>A, chr21:30698953 T>G, chr9:304628 G>A, chr19:7712287 G>C, chr10:90771767 G>A, chr3:121415370 T>C, chr16:70503095 A>G, chr1: 206945738 C>T, chr5:156593120 C>T, chr4:27019452 C>T, chr1:155317682 C>T, chr17:77926526 C>T, chr1: 235840495 G>T, chr14:21993359 G>A, chr8:61757805 C>T, chr15:91306241 G>A, chr16:50741791 C>T, chr22: 23915583 T>C, chr2:47205921 C>T, chr12:88900891 C>A, chr3:142281353 C>G, chr11:108123551 C>T, chr1: 207641950 C>T, chr6:143092151 T>C, chr2:24431184 C>T, chr2:24432937 C>T, chr9:312134 G>A, chr8: 100205255 G>A, chr21:16339852 T>C, and any combination thereof (see Tables 14 and 15).

In some embodiments, the one or more genetic variations comprise a genetic variation selected from the group consisting of chr16:81942175 A>G, chr2:163136505 C>G, chr11:67818269 G>A, chr22:23917192 G>T, chr20: 3846397 C>T, chr8:145154222, G>A chr8:61654298 T>A, chr3:39323163 A>C, chr4:151199080 G>A, chr1:42047208 C>G, chr2:163124051 C>T, chr1:182554557 C>T, and any combination thereof (see Table 14).

In some embodiments, the one or more genetic variations comprise a genetic variation selected from the group consisting of chr8:145154824 A>C, chr20:62305450 C>T, chr22:23915745 G>A, chr6:83884161 C>G, chr11: 108202772 G>T, chr5:138856923 C>T, chr16:1510535 C>T, chr20:3843027 C>A, chr12:122064788 G>GT, chr16: 7714909 C>T, chr18:56401523 C>T, chr1:92946625 G>C, chr5:169081453 G>C, chr11:108117787 C>T, chr22: 21235389 A>G, chr19:4817657 C>T, chr10:1060218 G>A, chr21:30698953 T>G, chr9:304628 G>A, chr19:7712287 G>C, chr10:90771767 G>A, chr3:121415370 T>C, chr16: 70503095 A>G, chr1:206945738 C>T, chr5:156593120 C>T, chr4:27019452 C>T, chr1:155317682 C>T, chr17: 77926526 C>T, chr1:235840495 G>T, chr14:21993359 G>A, chr8:61757805 C>T, chr15:91306241 G>A, chr16: 50741791 C>T, chr22:23915583 T>C, chr2:47205921 C>T, chr12:88900891 C>A, chr3:142281353 C>G, chr11: 108123551 C>T, chr1:207641950 C>T, chr6:143092151 T>C, chr2:24431184 C>T, chr2:24432937 C>T, chr9: 312134 G>A, chr8:100205255 G>A, chr21:16339852 T>C, and any combination thereof (see Table 15).

In some embodiments, the SNV is a heterozygous SNV.

In some embodiments, the SNV is a homozygous SNV.

In some embodiments, the one or more genetic variations comprise a pair of single nucleotide variations (SNVs), wherein the pair of SNVs are encoded by any one of SEQ ID NO pairs: 1003 and 1004, 1003 and 1005, 1006 and 1007, 1024 and 1025, 1030 and 1031, 1047 and 1048, 1049 and 1050, 1063 and 1064, 1063 and 1065, 1063 and 1066, 1075 and 1076, 1091 and 1093, 1091 and 1096, 1093 and 1095, 1094 and 1097, 1098 and 1099, 1098 and 1100, 1099 and 1100, 1102 and 1103, 1104 and 1106, 1104 and 1107, 1104 and 1108, 1104 and 1109, 1104 and 1110, 1104 and 1111, 1104 and 1112, 1110 and 1111, 1112 and 1113, 1119 and 1120, 1124 and 1125, 1124 and 1126, 1125 and 1126, 1140 and 1141, 1142 and 1144, 1146 and 1151, 1147 and 1148, 1147 and 1149, 1153 and 1146, 1153 and 1147, 1155 and 1156, 1160 and 1161, 1165 and 1166, 1186 and 1187, 1188 and 1193, 1189 and 1193, 1191 and 1192, 1191 and 1193, 1191 and 1195, 1192 and 1193, 1192 and 1195, 1196 and 1197, 1206 and 1207, 1210 and 1218, 1211 and 1213, 1212 and 1213, 1213 and 1215, 1213 and 1216, 1213 and 1217, 1233 and 1238, 1242 and 1243, 1245 and 1246, 1263 and 1260, 1269 and 1279, 1270 and 1279, 1270 and 1282, 1271 and 1279, 1274 and 1279, 1278 and 1279, 1278 and 1281, 1279 and 1280, 1279 and 1281, 1279 and 1282, 1292 and 1293, 1296 and 1297, 1305 and 1314, 1306 and 1310, 1313 and 1321 or 1315 and 1322 (see Table 9 or Tables 9 and 7 for a subset), or complements thereof.

In some embodiments, the one or more genetic variations comprise a genetic variation encoded by a CNV with at least 60%, at least 70%, at least 80%, at least 90%, at least 95%, or at least 99% sequence identity to any one of SEQ ID NOs 157, 2, 140, 65, 26, 14 or 45 (see Tables 7 and 8), or complements thereof.

In some embodiments, the one or more genetic variations comprise a genetic variation encoded by a CNV with at least 60%, at least 70%, at least 80%, at least 90%, at least 95%, or at least 99% sequence identity to any one of SEQ ID NOs 2, 140, 65, 26, 14 or 45 (see Table 7), or complements thereof.

In some embodiments, the one or more genetic variations comprise a genetic variation encoded by a CNV with at least 60%, at least 70%, at least 80%, at least 90%, at least 95%, or at least 99% sequence identity to SEQ ID NO 157 (see Table 8), or a complement thereof.

In some embodiments, the one or more genetic variations comprise a CNV-SNV pair comprising a CNV and a single nucleotide variation (SNV), wherein the SNV of the CNV-SNV pair is encoded by any one of SEQ ID NOs 1301, 1173, 1107, 1104, 1199, 1225, 1086 or 1223 (see Table 10), or complements thereof.

In some embodiments, the one or more genetic variations comprise a genetic variation selected from the group consisting of one or more of the following: chr8:145154222 G>A, chr2:163136505 C>G, chr16:81942175 A>G, and chr8:61654298 T>A (see Tables 14 and 16).

In some embodiments, the one or more genetic variations disrupt or modulate one or more of the following genes: PLCG2, POLE, LRBA, EPG5 and SHARPIN (see Table 17).

In some embodiments, the one or more genetic variations disrupt or modulate one or more of the following genes: PLCG2, CHD7, IFIH1, AP3B1, EPG5, PIK3CD, LRBA and SHARPIN (see Table 18).

In some embodiments, the gene encodes a transcript with a sequence that has at least 60%, at least 70%, at least 80%, at least 90%, at least 95%, or at least 99% sequence identity to any one of SEQ ID NOs 173-455 or 1500-2177 (see Tables 4 and 12), or complements thereof.

In some embodiments, the gene encodes a transcript with a sequence that has at least 60%, at least 70%, at least 80%, at least 90%, at least 95%, or at least 99% sequence identity to any one of SEQ ID NOs 173-455 (see Table 4), or complements thereof.

In some embodiments, the gene encodes a transcript with a sequence that has at least 60%, at least 70%, at least 80%, at least 90%, at least 95%, or at least 99% sequence identity to any one of SEQ ID NOs 1500-2177 (see Table 12), or complements thereof.

In some embodiments, the one or more genetic variations comprise 2 or 3 or 4 or 5 or more genetic variations.

In some embodiments, the one or more genetic variations comprise 10 or more genetic variations.

In some embodiments, the one or more genetic variations comprise 20 or more genetic variations.

In some embodiments, the one or more genetic variations comprise 50 or more genetic variations.

In some embodiments, the analyzing comprises microarray analysis, PCR, sequencing, nucleic acid hybridization, or any combination thereof.

In some embodiments, the genetic test result comprises a genetic test result from a microarray analysis, PCR, sequencing, nucleic acid hybridization, or any combination thereof.

In some embodiments, the detecting comprises a microarray analysis, PCR, sequencing, nucleic acid hybridization, or any combination thereof.

In some embodiments, the microarray analysis selected from the group consisting of a Comparative Genomic Hybridization (CGH) array analysis and an SNP array analysis.

In some embodiments, the sequencing is selected from the group consisting of Massively Parallel Signature Sequencing (MPSS), polony sequencing, 454 pyrosequencing, Illumina sequencing, Illumina (Solexa) sequencing using 10× Genomics library preparation, SOLiD sequencing, ion semiconductor sequencing, DNA nanoball sequencing, heliscope single molecule sequencing, single molecule real time (SMRT) sequencing, RNAP sequencing, Nanopore DNA sequencing, sequencing by hybridization, and microfluidic Sanger sequencing.

In some embodiments, the analyzing comprises analyzing a whole genome or a whole exome of the subject.

In some embodiments, the analyzing comprises analyzing nucleic acid information that has already been obtained for a whole genome or a whole exome of the subject.

In some embodiments, the nucleic acid information is obtained from an in silico analysis.

In some embodiments, the analyzing comprises analyzing a whole genome or a whole exome of the subject.

In some embodiments, the analyzing comprises analyzing nucleic acid information that has already been obtained for a whole genome or a whole exome of the subject.

In some embodiments, the nucleic acid information is obtained from an in silico analysis.

In some embodiments, the detecting comprises analyzing a whole genome or a whole exome of the subject.

In some embodiments, the detecting comprises analyzing nucleic acid information that has already been obtained for a whole genome or a whole exome of the subject.

In some embodiments, the nucleic acid information is obtained from an in silico analysis.

In some embodiments, the subject is a human subject.

In some embodiments, the polynucleic acid sample comprises a polynucleic acid from blood, saliva, urine, serum, tears, skin, tissue, or hair of the subject.

In some embodiments, the method further comprises analyzing for a presence of JCV in a biological sample from the subject.

In some embodiments, the analyzing for a presence of JCV comprises contacting a JCV detection reagent to the biological sample.

In some embodiments, the JCV detection reagent is selected from the group consisting of an anti-JCV antibody, a JCV specific primer, and combinations thereof.

Provided herein is a kit, comprising reagents for assaying a polynucleic acid sample from a subject in need thereof for the presence of one or more genetic variations that disrupt or modulate a gene of GN1-GN490.

In some embodiments, the reagents comprise at least one contiguous oligonucleotide that hybridizes to a fragment of the polynucleic acid sample.

In some embodiments, the reagents comprise at least one pair of oligonucleotides that hybridize to opposite strands of a fragment of the polynucleic acid sample.

In some embodiments, the kit further comprises one or more immunosuppressive medications.

In some embodiments, the one or more immunosuppressive medications comprise a glucocorticoid, cytostatic, antibody, drug acting on immunophilins, interferon, opioid, TNF binding protein, mycophenolate, small biological agent, or any combination thereof.

In some embodiments, the one or more immunosuppressive medications comprise a interferon beta-1a, interferon beta-1b, glatiramer acetate, peginterferon beta-1a, teriflunomide, fingolimod, dimethyl fumarate, alemtuzumab, mitoxantrone, natalizumab, daclizumab, ocrelizumab, or any combination thereof.

In some embodiments, the one or more immunosuppressive medications comprise natalizumab (Tysabri).

In some embodiments, the kit further comprises a JCV detection reagent.

In some embodiments, the JCV detection reagent is selected from the group consisting of an anti-JCV antibody, a JCV specific primer, and combinations thereof.

In some embodiments, the kit further comprises a set of instructions for administration of the one or more immunosuppressive medications.

In some embodiments, the one or more genetic variations comprise a point mutation, polymorphism, single nucleotide polymorphisms (SNP), single nucleotide variation (SNV), translocation, insertion, deletion, amplification, inversion, interstitial deletion, copy number variation (CNV), loss of heterozygosity, or any combination thereof.

In some embodiments, the one or more genetic variations result in a loss of function of the corresponding gene.

In some embodiments, the one or more genetic variations comprise 5 or more genetic variations.

In some embodiments, the one or more genetic variations comprise 10 or more genetic variations.

In some embodiments, the one or more genetic variations comprise 20 or more genetic variations.

In some embodiments, the one or more genetic variations comprise 50 or more genetic variations.

In some embodiments, the subject is a human subject.

In some embodiments, the polynucleic acid sample comprises a polynucleic acid from blood, saliva, urine, serum, tears, skin, tissue, or hair of the subject.

Provided herein is a panel of polynucleic acids for detecting one or more genetic variations that disrupt or modulate a gene of GN1-GN490, wherein each polynucleic acid of the panel comprises a sequence complementary to a sequence of one or more genetic variation or complements thereof that disrupts or modulates a gene selected from the group consisting of GN1-GN490.

In some embodiments, the one or more genetic variations comprise a genetic variation encoded by a sequence with at least 60%, at least 70%, at least 80%, at least 90%, at least 95%, or at least 99% sequence identity to SEQ ID NOs 1-172 or SRN1-SRN363, with 100% sequence identity to SEQ ID NOs 1000-1329, or with at least 80% and less than 100% sequence identity to GN1-GN490, or complements thereof.

In some embodiments, the one or more genetic variations comprise a genetic variation encoded by a CNV with at least 60%, at least 70%, at least 80%, at least 90%, at least 95%, or at least 99% sequence identity to SEQ ID NOs 1-172, or complements thereof.

In some embodiments, the one or more genetic variations comprise a genetic variation encoded by a CNV sub-region (SRN) with at least 60%, at least 70%, at least 80%, at least 90%, at least 95%, or at least 99% sequence identity to SRN1-SRN363, or complements thereof.

In some embodiments, the one or more genetic variations comprise a genetic variation encoded by a single nucleotide variation (SNV) with a sequence of any one of SEQ ID NOs: 1000-1329, or complements thereof.

In some embodiments, the one or more genetic variations comprise a genetic variation encoded by a sequence with at least 80% and less than 100% sequence identity to GN1-GN490, or complements thereof.

In some embodiments, the one or more genetic variations comprise a genetic variation encoded by a single nucleotide variation (SNV) with a sequence of any one of SEQ ID NO: 1000, 1001, 1002, 1009, 1010, 1011, 1012, 1014, 1016, 1017, 1019, 1020, 1028, 1032, 1033, 1034, 1035, 1036, 1037, 1040, 1041, 1043, 1051, 1054, 1056, 1057, 1058, 1059, 1061, 1062, 1063, 1066, 1068, 1069, 1070, 1071, 1073, 1074, 1075, 1076, 1077, 1078, 1080, 1082, 1084, 1090, 1092, 1098, 1099, 1100, 1101, 1104, 1107, 1114, 1116, 1118, 1121, 1122, 1123, 1125, 1126, 1127, 1128, 1129, 1130, 1131, 1133, 1135, 1136, 1137, 1138, 1142, 1146, 1147, 1148, 1150, 1152, 1154, 1157, 1160, 1161, 1165, 1166, 1167, 1168, 1169, 1171, 1174, 1175, 1176, 1177, 1178, 1179, 1180, 1181, 1182, 1183, 1184, 1193, 1194, 1200, 1201, 1202, 1203, 1204, 1208, 1219, 1220, 1221, 1222, 1226, 1227, 1228, 1229, 1230, 1231, 1232, 1235, 1239, 1247, 1248, 1249, 1250, 1251, 1252, 1254, 1255, 1256, 1259, 1260, 1261, 1263, 1264, 1266, 1267, 1273, 1278, 1279, 1283, 1284, 1286, 1287, 1289, 1290, 1291, 1299, 1300, 1301, 1304, 1311, 1327 or 1328 (see Tables 7 and 8), or complements thereof.

In some embodiments, the one or more genetic variations comprise a genetic variation encoded by a single nucleotide variation (SNV) with a sequence of any one of SEQ ID NO: 1011, 1020, 1028, 1032, 1034, 1035, 1036, 1040, 1056, 1069, 1073, 1077, 1101, 1114, 1123, 1125, 1126, 1127, 1135, 1142, 1146, 1147, 1148, 1152, 1154, 1157, 1167, 1174, 1184, 1193, 1194, 1203, 1208, 1221, 1222, 1229, 1235, 1252, 1255, 1256, 1259, 1260, 1261, 1263, 1273, 1278, 1279, 1284, 1287, 1289, 1299 or 1311 (see Table 7), or complements thereof.

In some embodiments, the one or more genetic variations comprise a genetic variation encoded by a single nucleotide variation (SNV) with a sequence of any one of SEQ ID NO: 1000, 1001, 1002, 1009, 1010, 1012, 1014, 1016, 1017, 1019, 1033, 1037, 1041, 1043, 1051, 1054, 1057, 1058, 1059, 1061, 1062, 1063, 1066, 1068, 1070, 1071, 1074, 1075, 1076, 1078, 1080, 1082, 1084, 1090, 1092, 1098, 1099, 1100, 1104, 1107, 1116, 1118, 1121, 1122, 1128, 1129, 1130, 1131, 1133, 1136, 1137, 1138, 1146, 1147, 1150, 1152, 1160, 1161, 1165, 1166, 1168, 1169, 1171, 1175, 1176, 1177, 1178, 1179, 1180, 1181, 1182, 1183, 1200, 1201, 1202, 1204, 1219, 1220, 1226, 1227, 1228, 1230, 1231, 1232, 1239, 1247, 1248, 1249, 1250, 1251, 1252, 1254, 1264, 1266, 1267, 1278, 1279, 1283, 1286, 1290, 1291, 1300, 1301, 1304, 1327 or 1328 (see Table 8), or complements thereof.

In some embodiments, the one or more genetic variations comprise a genetic variation selected from the group consisting of chr16:81942175 A>G, chr2:163136505 C>G, chr11:67818269 G>A, chr22:23917192 G>T, chr20: 3846397 C>T, chr8:145154222, G>A chr8:61654298 T>A, chr3:39323163 A>C, chr4:151199080 G>A, chr1:42047208 C>G, chr2:163124051 C>T, chr1:182554557 C>T, chr8: 145154824 A>C, chr20:62305450 C>T, chr22:23915745 G>A, chr6:83884161 C>G, chr11:108202772 G>T, chr5: 138856923 C>T, chr16:1510535 C>T, chr20:3843027 C>A, chr12:122064788 G>GT, chr16:7714909 C>T, chr18: 56401523 C>T, chr1:92946625 G>C, chr5:169081453 G>C, chr11:108117787 C>T, chr22:21235389 A>G, chr19: 4817657 C>T, chr10:1060218 G>A, chr21:30698953 T>G, chr9:304628 G>A, chr19:7712287 G>C, chr10:90771767 G>A, chr3:121415370 T>C, chr16:70503095 A>G, chr1: 206945738 C>T, chr5:156593120 C>T, chr4:27019452 C>T, chr1:155317682 C>T, chr17:77926526 C>T, chr1: 235840495 G>T, chr14:21993359 G>A, chr8:61757805 C>T, chr15:91306241 G>A, chr16:50741791 C>T, chr22: 23915583 T>C, chr2:47205921 C>T, chr12:88900891 C>A, chr3:142281353 C>G, chr11:108123551 C>T, chr1: 207641950 C>T, chr6:143092151 T>C, chr2:24431184 C>T, chr2:24432937 C>T, chr9:312134 G>A, chr8: 100205255 G>A, chr21:16339852 T>C, and any combination thereof (see Tables 14 and 15).

In some embodiments, the one or more genetic variations comprise a genetic variation selected from the group consisting of chr16:81942175 A>G, chr2:163136505 C>G, chr11:67818269 G>A, chr22:23917192 G>190, chr20: 3846397 C>T, chr8:145154222, G>A chr8:61654298 T>A, chr3:39323163 A>C, chr4:151199080 G>A, chr1:42047208 C>G, chr2:163124051 C>T, chr1:182554557 C>T, and any combination thereof (see Table 14).

In some embodiments, the one or more genetic variations comprise a genetic variation selected from the group consisting of chr8:145154824 A>C, chr20:62305450 C>T, chr22:23915745 G>A, chr6:83884161 C>G, chr11: 108202772 G>T, chr5:138856923 C>T, chr16:1510535 C>T, chr20:3843027 C>A, chr12:122064788 G>GT, chr16: 7714909 C>T, chr18:56401523 C>T, chr1:92946625 G>C, chr5:169081453 G>C, chr11:108117787 C>T, chr22: 21235389 A>G, chr19:4817657 C>T, chr10:1060218 G>A, chr21:30698953 T>G, chr9:304628 G>A, chr19:7712287 G>C, chr10:90771767 G>A, chr3:121415370 T>C, chr16: 70503095 A>G, chr1:206945738 C>T, chr5:156593120 C>T, chr4:27019452 C>T, chr1:155317682 C>T, chr17: 77926526 C>T, chr1:235840495 G>T, chr14:21993359 G>A, chr8:61757805 C>T, chr15:91306241 G>A, chr16: 50741791 C>T, chr22:23915583 T>C, chr2:47205921 C>T, chr12:88900891 C>A, chr3:142281353 C>G, chr11: 108123551 C>T, chr1:207641950 C>T, chr6:143092151 T>C, chr2:24431184 C>T, chr2:24432937 C>T, chr9: 312134 G>A, chr8:100205255 G>A, chr21:16339852 T>C, and any combination thereof (see Table 15).

In some embodiments, the SNV is a heterozygous SNV.

In some embodiments, the SNV is a homozygous SNV.

In some embodiments, the one or more genetic variations comprise a pair of single nucleotide variations (SNVs), wherein the pair of SNVs are encoded by any one of SEQ ID NO pairs: 1003 and 1004, 1003 and 1005, 1006 and 1007, 1024 and 1025, 1030 and 1031, 1047 and 1048, 1049 and 1050, 1063 and 1064, 1063 and 1065, 1063 and 1066, 1075 and 1076, 1091 and 1093, 1091 and 1096, 1093 and 1095, 1094 and 1097, 1098 and 1099, 1098 and 1100, 1099 and 1100, 1102 and 1103, 1104 and 1106, 1104 and 1107, 1104 and 1108, 1104 and 1109, 1104 and 1110, 1104 and 1111, 1104 and 1112, 1110 and 1111, 1112 and 1113, 1119 and 1120, 1124 and 1125, 1124 and 1126, 1125 and 1126, 1140 and 1141, 1142 and 1144, 1146 and 1151, 1147 and 1148, 1147 and 1149, 1153 and 1146, 1153 and 1147, 1155 and 1156, 1160 and 1161, 1165 and 1166, 1186 and 1187, 1188 and 1193, 1189 and 1193, 1191 and 1192, 1191 and 1193, 1191 and 1195, 1192 and 1193, 1192 and 1195, 1196 and 1197, 1206 and 1207, 1210 and 1218, 1211 and 1213, 1212 and 1213, 1213 and 1215, 1213 and 1216, 1213 and 1217, 1233 and 1238, 1242 and 1243, 1245 and 1246, 1263 and 1260, 1269 and 1279, 1270 and 1279, 1270 and 1282, 1271 and 1279, 1274 and 1279, 1278 and 1279, 1278 and 1281, 1279 and 1280, 1279 and 1281, 1279 and 1282, 1292 and 1293, 1296 and 1297, 1305 and 1314, 1306 and 1310, 1313 and 1321 or 1315 and 1322 (see Table 9 or Tables 9 and 7 for a subset), or complements thereof.

In some embodiments, the one or more genetic variations comprise a genetic variation encoded by a CNV with at least 60%, at least 70%, at least 80%, at least 90%, at least 95%, or at least 99% sequence identity to any one of SEQ ID NOs 157, 2, 140, 65, 26, 14 or 45 (see Tables 7 and 8), or complements thereof.

In some embodiments, the one or more genetic variations comprise a genetic variation encoded by a CNV with at least 60%, at least 70%, at least 80%, at least 90%, at least 95%, or at least 99% sequence identity to any one of SEQ ID NOs 2, 140, 65, 26, 14 or 45 (see Table 7), or complements thereof.

In some embodiments, the one or more genetic variations comprise a genetic variation encoded by a CNV with at least 60%, at least 70%, at least 80%, at least 90%, at least 95%, or at least 99% sequence identity to SEQ ID NO 157 (see Table 8), or a complement thereof.

In some embodiments, the one or more genetic variations comprise a CNV and a single nucleotide variations (SNV), wherein SNVs is encoded by any one of SEQ ID NOs 1301, 1173, 1107, 1104, 1199, 1225, 1086 or 1223 (see Table 10), or complements thereof.

In some embodiments, the one or more genetic variations comprise a genetic variation selected from the group consisting of one or more of the following: chr8:145154222 G>A, chr2:163136505 C>G, chr16:81942175 A>G, and chr8:61654298 T>A (see Tables 14 and 16).

In some embodiments, the one or more genetic variations disrupt or modulate one or more of the following genes: PLCG2, POLE, LRBA, EPG5 and SHARPIN (see Table 17).

In some embodiments, the one or more genetic variations disrupt or modulate one or more of the following genes: PLCG2, CHD7, IFIH1, AP3B1, EPG5, PIK3CD, LRBA and SHARPIN (see Table 18).

In some embodiments, the gene encodes a transcript with a sequence that has at least 60%, at least 70%, at least 80%, at least 90%, at least 95%, or at least 99% sequence identity to any one of SEQ ID NOs 173-455 or 1500-2177 (see Tables 4 and 12), or complements thereof.

In some embodiments, the gene encodes a transcript with a sequence that has at least 60%, at least 70%, at least 80%, at least 90%, at least 95%, or at least 99% sequence identity to any one of SEQ ID NOs 173-455 (see Table 4), or complements thereof.

In some embodiments, the gene encodes a transcript with a sequence that has at least 60%, at least 70%, at least 80%, at least 90%, at least 95%, or at least 99% sequence identity to any one of SEQ ID NOs 1500-2177 (see Table 12), or complements thereof.

In some embodiments, the one or more genetic variations comprise at least 5, at least 10, at least 20, or at least 50 genetic variations.

In some embodiments, panel of polynucleic acids comprises at least 5, at least 10, at least 20, or at least 50 polynucleic acids.

In some embodiments, the gene comprises a gene selected from the group consisting of gene numbers (GNs) 1-156 (in Table 3).

In some embodiments, the gene comprises a gene selected from the group consisting of gene numbers (GNs) in Table 6.

In some embodiments, the gene comprises a gene selected from the group consisting of PLCG2, RBCK1, EPG5, IL17F, SHARPIN, PRF1, JAGN1, TAP1, POLE, LRBA, EHF, IL12B, ATL2, NHEJ1, LYST, HIVEP1, AP3B1, TNFRSF10A, PIK3CD, PNP, MCEE, DOCK2 and ALG12 (see Table 13).

Provided herein is a method to predict an adverse responsiveness of a subject to a therapy, the method comprising detecting one or more genetic variations that disrupt or modulate a gene of GN1-GN490 in a polynucleic acid sample from the subject; and using that detection as a biomarker for predicting a response of the subject to the therapy to be adverse, wherein the therapy is an immunosuppressive therapy.

Provided herein is a method of screening for a PML biomarker comprising obtaining biological samples from subjects with PML; screening the biological samples to obtain nucleic acid information; detecting one or more genetic variations that disrupt or modulate a gene of GN1-GN490 in a polynucleic acid sample from a subject suspected of having PML; and using that detection as a biomarker for predicting a response of the subject to the therapy to be adverse, wherein the therapy is an immunosuppressive therapy.

Provided herein is a method of screening for a PML biomarker comprising obtaining biological samples from subjects with PML; screening the biological samples to obtain nucleic acid information; confirming each biological sample is not a duplicate of any other biological sample based on the nucleic acid information; detecting one or more genetic variations that disrupt or modulate a gene of GN1-GN490 in a polynucleic acid sample from a subject suspected of having PML; and using that detection as a biomarker for predicting a response of the subject to the therapy to be adverse, wherein the therapy is an immunosuppressive therapy.

Provided herein is a method of screening for a PML biomarker comprising obtaining biological samples from subjects with PML; screening the biological samples to obtain nucleic acid information; determining a sex genotype for each biological sample based on the nucleic acid information; confirming the sex genotype of each sample is the same as a sex phenotype of the subject from the subjects with PML; detecting one or more genetic variations that disrupt or modulate a gene of GN1-GN490 in a polynucleic acid sample from a subject suspected of having PML; and using that detection as a biomarker for predicting a response of the subject to the therapy to be adverse, wherein the therapy is an immunosuppressive therapy.

Provided herein is a method of treating a condition in a subject in need of natalizumab therapy, comprising: administering a therapeutically effective amount of natalizumab to the subject, wherein the subject has a decreased risk of progressive multifocal leukoencephalopathy (PML) due to an infection of the brain by John Cunningham virus (JCV), wherein the subject's decreased risk is due to the absence of one or more genetic variations that disrupt or modulate a corresponding gene according to Tables 3 and 6.

In some embodiments, the subject is identified as not having one or more genetic variations that disrupt or modulate a corresponding gene according to Tables 3 and 6. In some embodiments, the subject is known as not having one or more genetic variations that disrupt or modulate a corresponding gene according to Tables 3 and 6. In some embodiments, the subject is identified in a report (e.g., health report) as not having one or more genetic variations that disrupt or modulate a corresponding gene according to Tables 3 and 6.

In some embodiments, the condition is multiple sclerosis or Crohn's disease. In some embodiments, the condition is a relapsing form of multiple sclerosis. In some embodiments, the natalizumab is administered via intravenous infusion.

In some embodiments, about 100 mg to about 500 mg of the natalizumab is administered. In some embodiments, about 100 mg to about 500 mg of the natalizumab is administered, for example, about 100 mg to about 200 mg, about 100 mg to about 300 mg, about 100 mg to about 400 mg, about 100 mg to about 500 mg, about 200 mg to about 300 mg, about 200 mg to about 400 mg, about 200 mg to about 500 mg, about 300 mg to about 400 mg, about 300 mg to about 500 mg, or about 400 mg to about 500 mg of the natalizumab is administered. In some embodiments, about 100 mg to about 500 mg of the natalizumab is administered via intravenous infusion. In some embodiments, about 100 mg to about 500 mg of the natalizumab is administered via intravenous infusion in four weeks. In some embodiments, about 300 mg of the natalizumab is administered. In some embodiments, about 300 mg of the natalizumab is administered via intravenous infusion. In some embodiments, about 300 mg of the natalizumab is administered via intravenous infusion in four weeks.

In some embodiments, the one or more genetic variations are associated with a risk of developing PML in a polynucleic acid sample from the subject. In some embodiments, the one or more genetic variations comprises a first genetic variation and a second genetic variation, wherein the first genetic variation disrupts or modulates a corresponding gene according to Tables 3 and 6, and wherein the second genetic variation disrupts or modulates a corresponding gene according to Tables 25A, 25B, and 26.

In some embodiments, the method comprises testing the subject for a genetic predisposition for PML with a genetic assay. In some embodiments, the genetic assay has a diagnostic yield of at least 5%. In some cases, the genetic assay has a diagnostic yield of at least about 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, or 99%. In some cases, the genetic assay has a diagnostic yield of about 1%-5%, 1%-10%, 1%-20%, 5%-10%, 5%-20%, 10%-20%, 10%-30%, 20%-30%, 20%-40%, 30%-40%, 30%-50%, 40%-50%, 40%-60%, 50%-60%, 50%-70%, 60%-70%, 60%-80%, 70%-80%, 70%-90%, 80%-90%, 80%-95%, 90%-95%, 90%-99%, 90%-100%, 95%-99%, or 99%-100%. In some embodiments, the genetic assay has a diagnostic yield of at least 20%.

In some embodiments, the one or more genetic variations disrupt or modulate a corresponding gene according to Tables 13-18. In some embodiments, the one or more genetic variations disrupt or modulate a corresponding gene according to Tables 19-24.

In some embodiments, the subject's decreased risk is further due to the absence of one or more genetic variations that disrupt or modulate a corresponding gene according to Tables 25A, 25B, and 26.

In some embodiments, the one or more genetic variations disrupt or modulate a corresponding gene selected from the group consisting of *homo sapiens* chromodomain helicase DNA binding protein 7 (CHD7), *homo sapiens* interferon induced with helicase C domain 1 (IFIH1), *homo sapiens* immunoglobulin lambda like polypeptide 1 (IGLL1), *homo sapiens* mitochondrial antiviral signaling protein (MAVS), *homo sapiens* phospholipase C gamma 2 (PLCG2), *homo sapiens* SHANK-associated RH domain interactor (SHARPIN), *homo sapiens* T-cell immune regulator 1, ATPase H+ transporting VO subunit a3 (TCIRG1), and any combination thereof. In some embodiments, the one or more genetic variations comprise chr8:61654298 T>A, chr2:163136505 C>G, chr22:23917192 G>T, chr20:3846397 C>T, chr16:81942175 A>G, chr8:145154222 G>A, chr11:67818269 G>A, chr8:145154824 A>C, chr22:23915745 G>A, chr20:3843027 C>A, or any combination thereof.

In some embodiments, the corresponding gene comprises a gene selected from the group consisting of gene numbers (GNs) GN1-GN490. In some embodiments, the corresponding gene comprises a gene selected from the group consisting of gene numbers (GNs) GN1-GN241, GN243-GN369, and GN371-GN490.

In some embodiments, the one or more genetic variations are encoded by a sequence with at least 60% sequence identity to SEQ ID NOs 1-172 or SRN1-SRN363, with 100% sequence identity to SEQ ID NOs 1000-1329, or with at least 80% and less than 100% sequence identity to GN1-GN490, or complements thereof. In some embodiments, the one or more genetic variations comprise a genetic variation encoded by a CNV with at least 60% sequence identity to SEQ ID NOs 1-172, or complements thereof. In some embodiments, the one or more genetic variations comprise a genetic variation encoded by a CNV sub-region (SRN) with at least 60% sequence identity to SRN1-SRN363, or complements thereof. In some embodiments, the one or more genetic variations comprise a genetic variation encoded by a single nucleotide variation (SNV) with a sequence of any one of SEQ ID NOs: 1000-1329, or complements thereof. In some embodiments, the one or more genetic variations are encoded by a sequence with at least 40% sequence identity to SEQ ID NOs 1-172 or SRN1-SRN363, for example, at least 40%, 45%, 50%, 55%, 60%, 65%, 70%, 75%, 80%, 85%, 90%, 95%, 96%, 97%, 98%, 99%, or 100% sequence identity to SEQ ID NOs 1-172 or SRN1-SRN363, or complements thereof. In some embodiments, the one or more genetic variations are encoded by a sequence with at least 40% sequence identity to SEQ ID NOs 1000-1329, for example, at least 40%, 45%, 50%, 55%, 60%, 65%, 70%, 75%, 80%, 85%, 90%, 95%, 96%, 97%, 98%, 99%, or 100% sequence identity to SEQ ID NOs 1000-1329, or complements thereof. In some embodiments, the one or more genetic variations are encoded by a sequence with at least 40% and less than 100% sequence identity to GN1-GN490, for example, at least 40% and less than 50%, at least 50% and less than 60%, at least 60% and less than 70%, at least 70% and less than 80%, at least 80% and less than 90%, or at least 90% and less than 100% sequence identity to GN1-GN490, or complements thereof.

In some embodiments, the genetic assay comprises microarray analysis, PCR, sequencing, nucleic acid hybridization, or any combination thereof.

In some embodiments, the method comprises testing the subject with a JCV-antibody test, a CD62L test, or a CSF IgM oligoclonal bands test. In some embodiments, the method comprises testing the subject with the JCV-antibody test, wherein the JCV-antibody test does not detect a presence of JCV. In some embodiments, the method comprises testing the subject with the JCV-antibody test, wherein the JCV-antibody test detects a presence of JCV. In some embodiments, the JCV-antibody test comprises contacting a JCV detection reagent to a biological sample from the subject. In some embodiments, the JCV detection reagent is selected from the group consisting of an anti-JCV antibody, a JCV specific primer, and combinations thereof.

In some embodiments, the subject is identified as not having one or more genetic variations that disrupt or modulate a corresponding gene according to Tables 3 and 6.

Provided herein is a kit, comprising reagents for assaying a polynucleic acid sample from a subject in need thereof for the presence of one or more genetic variations that disrupt or modulate a gene of GN1-GN490. In some embodiments, the one or more genetic variations that disrupt or modulate a gene of GN1-GN241, GN243-GN369, and GN371-GN490.

Provided herein is a method of treating multiple sclerosis or Crohn's disease comprising: (a) testing a subject with multiple sclerosis or Crohn's disease for a genetic predisposition for PML with a genetic assay, wherein the genetic assay has a diagnostic yield of at least 20%, and (b) administering a therapeutically effective amount of natalizumab to the subject, wherein the testing does not identify the subject as having the genetic predisposition for PML.

In some embodiments, the method further comprises testing the subject with a JCV-antibody test. In some embodiments, the JCV-antibody test does not detect a presence of JCV. In some embodiments, the JCV-antibody test detects a presence of JCV. In some embodiments, the genetic assay tests the subject for the presence of one or more genetic variations that disrupt or modulate a corresponding gene according to Tables 3 and 6.

Provided herein is a method of identifying a subject as not having a risk of developing PML, comprising: (a) analyzing a polynucleic acid sample from the subject for one or more genetic variations that disrupt or modulate a corresponding gene according to Tables 3 and 6, wherein a genetic variation of the one or more genetic variations that disrupt or modulate a corresponding gene according to Tables 3 and 6 is not present in the polynucleic acid sample; and (b) identifying the subject as not having a risk of developing PML.

DETAILED DESCRIPTION OF THE DISCLOSURE

The details of one or more inventive embodiments are set forth in the accompanying drawings, the claims, and in the description herein. Other features, objects, and advantages of inventive embodiments disclosed and contemplated herein will be apparent from the description and drawings, and from the claims. As used herein, unless otherwise indicated, the article "a" means one or more unless explicitly otherwise provided for. As used herein, unless otherwise indicated, terms such as "contain," "containing," "include," "including," and the like mean "comprising." As used herein, unless otherwise indicated, the term "or" can be conjunctive or disjunctive. As used herein, unless otherwise indicated, any embodiment can be combined with any other embodiment. As used herein, unless otherwise indicated, some inventive embodiments herein contemplate numerical ranges. When ranges are present, the ranges include the range endpoints. Additionally, every subrange and value within the range is present as if explicitly written out. The term "about" and its grammatical equivalents in relation to a reference numerical value and its grammatical equivalents as used herein can include a range of values plus or minus 10% from that value, such as a range of values plus or minus 10%, 9%, 8%, 7%, 6%, 5%, 4%, 3%, 2%, or 1% from that value. For example, the amount "about 10" includes amounts from 9 to 11.

Progressive Multifocal Leukoencephalopathy (PML)

Progressive multifocal leukoencephalopathy (PML) is a rare and usually fatal viral disease characterized by progressive damage or inflammation of the white matter of the brain at multiple locations. The cause of PML can be a type of polyomavirus called the John Cunningham (JC) virus (or JCV), which can be harmless except in cases of weakened immune systems. While JCV is present at very high rates in the general population, PML remains a rare disorder, albeit an important one because of the clinical sequelae.

PML can occur in patients with severe immune deficiency, which allows reactivation of the JC virus, such as: 1) most commonly among patients with acquired immune deficiency syndrome (AIDS) that results from infection with human immunodeficiency virus (HIV), 2) patients on immunosuppressive medications like corticosteroids for organ transplant (e.g., renal, liver, lung, and heart) and in people with cancer (e.g., Hodgkin's disease, leukemia, or lymphoma, and myeloproliferative neoplasms such as myelofibrosis), and 3) individuals with autoimmune diseases (e.g., multiple sclerosis, rheumatoid arthritis, psoriasis, and systemic lupus erythematosus) with therapies that depress the immune response. Several immunosuppressive drugs have been reported in the context of drug-induced PML or drug-associated PML. For example, see: Melis et al. CNS Drugs. 2015; 29(10):879-91); Maas et al. J Neurol. 2016 October; 263(10):2004-21; Colin et al. Fundam Clin Pharmacol. 2016 Oct. 13. Immunosuppressive medications can include, but are not limited to, interferon beta-1a, interferon beta-1b, glatiramer acetate, peginterferon beta-1a, teriflunomide, mitoxantrone, ocrelizumab, abatacept, adalimumab, alefacept, alemtuzumab, anakinra, bortezomib (e.g., Velcade), eculizumab (e.g., Soliris), leflunomide, and various other transplant drugs such as antithymocyte Ig, asparaginase, azathioprine, basiliximab, belatacept, belimumab, bendamustine, bevacizumab, bleomycin, brentuximab vedotin, busulfan, capecitabine, carboplatin, carmustine, certolizumab, cetuximab, chlorambucil, cladribine, corticosteroids, cyclophosphamide, cyclosporine, cytotoxic chemotherapy, daclizumab, dimethyl fumarate, doxorubicin, efalizumab, etanercept, etoposide, fingolimod, fludarabine, gemcitabine, hydrocortisone, ibritumomab tiuxetan, ibrutinib, idarubicin, idelalisib, ifosfamide, imatinib, infliximab, lenalidomide, levamisole, mercaptopurine, methotrexate, mizoribine, muromonab-CD3, mycophenolate mofetil, mycophenolic acid, natalizumab, obinutuzumab, ofatumumab, oxaliplatin, prednisone/prednisolone, rituximab, ruxolitinib, sirolimus (also known as rapamycin), tacrolimus, tegafur/gimeracil/oteracil, thiotepa, tocilizumab, tofacitinib, ustekinumab, vedolizumab, vinblastine and vincristine. Exemplary small molecule immunosuppressive medications include dimethyl fumarate, fingolimod, and ruxolitinib. In some embodiments, an immunosuppressive therapy is classified as a Class 1 (high risk) therapeutic agent, such as efalizumab and natalizumab as reported in Calabrese L. H. et al., Nat Rev Rheumatol. (2015).

PML can be diagnosed in a patient with a progressive course of the disease, finding JC virus DNA in spinal fluid together with consistent white matter lesions on brain magnetic resonance imaging (MRI); alternatively, a brain biopsy can be diagnostic when the typical histopathology of demyelination, bizarre astrocytes, and enlarged oligodendroglial nuclei are present, coupled with techniques showing the presence of JC virus. Characteristic evidence of PML on brain CT scan images can be multifocal, non-contrast enhancing hypodense lesions without mass effect, but MRI can be more sensitive than CT. The most common area of involvement can be the cortical white matter of frontal and parieto-occipital lobes, but lesions may occur anywhere in the brain, like the basal ganglia, external capsule, and posterior cranial fossa structures like the brainstem and cerebellum.

In general, treatment of PML aims at reversing the immune deficiency to slow or stop the disease progress. Patients on an immunosuppression regime can stop taking the immunosuppressive medication or plasma exchange (PLEX) can be used to accelerate the removal of the immunosuppressive medication that put the person at risk for PML. HIV-infected patients can start highly active antiretroviral therapy (HAART). Occurrence of PML can also occur in the context of immune reconstitution inflammatory syndrome (IRIS), wherein onset of PML can occur or PML symptoms may get worse after cessation of immunosuppression (e.g., as reviewed by Pavlovic et al. Ther Adv Neurol Disord. 2015 November; 8(6):255-73 and Bowen et al. Nat Rev Neurol. 2016 Oct. 27; 12(11):662-674). For example, in MS patients that develop PML during treatment with natalizumab, IRIS often results when treatment is stopped and PLEX is used to remove natalizumab from the patient's circulation. Treatment of IRIS in PML patients can include administration of corticosteroids. Other potential treatments of PML can include cidofovir, cytarabine, anti-malaria drug mefloquine, interleukin-2, and 1-O-hexadecyloxypropyl-cidofovir (CMX001, aka brincidofovir). As reviewed by Pavlovic (Ther Adv Neurol Disord. 2015 November; 8(6):255-73), potential treatments for PML include antiviral agents (e.g., chlorpromazine, citalopram, mirtazapine, risperidone, ziprasidone, retro-2cycl, brefeldin A, cidofovir, brincidofovir, cytarabine, ganciclovir, leflunomide, topotecan, mefloquine, 3-aminobenzamide, imatinib, and Ag122), immune response modulators (e.g., IFN-alpha, IL-2, IL-7, maraviroc, and glucocorticoids), and immunization (e.g., recombinant human anti-JCV VP-1 monoclonal antibodies, JCV-specific cytotoxic T lymphocyte therapy, IL-7 plus JCV VP1 vaccine, and JCV oral vaccine).

The term "diagnostic yield" as used herein refers to the percentage of cases that would identify the presence of one or more genetic variations (e.g., CNV, SNV) in a PML cohort using an assay. For example, if 40 cases would identify the presence of one or more genetic variations (e.g., CNV, SNV) in a cohort of 100 PML patients, the diagnostic yield of the assay is 40%. In some cases, the patients in the PML cohort are clinically diagnosed with PML. In some cases, a patient is clinically diagnosed with PML when JC virus DNA is present in spinal fluid and consistent white matter lesions is present on brain magnetic resonance imaging (MRI). In some cases, a patient is clinically diagnosed with PML when typical histopathology of demyelination, bizarre astrocytes, and enlarged oligodendroglial nuclei are present in a brain biopsy, coupled with the presence of JC virus. In some cases, the PML cohort has at least 5 PML cases, for example, at least 5, 6, 7, 8, 9, 10, 20, 30, 40, 50, 60, 70, 80, 90, 100, 200, 300, 400, 500, 600, 700, 800, 900, or 1000 PML cases. In some cases, the PML cohort is a cohort listed herein. For example, the PML cohort is the PML patient cohort listed in Table 7. In some cases, the assay is JCV-antibody assay. In some cases, the assay is not JCV-antibody assay. In some cases, the assay is a genetic assay. In some cases, the genetic assay tests the genetic predisposition for PML.

The genetic assay can comprise any method disclosed herein. In some cases, the genetic assay has a diagnostic yield of at least about 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95%, or 99%. In some cases, the genetic assay has a diagnostic yield of about 1%-5%, 1%-10%, 1%-20%, 5%-10%, 5%-20%, 10%-20%, 10%-30%, 20%-30%, 20%-40%, 30%-40%, 30%-50%, 40%-50%, 40%-60%, 50%-60%, 50%-70%, 60%-70%, 60%-80%, 70%-80%, 70%-90%, 80%-90%, 80%-95%, 90%-95%, 90%-99%, 90%-100%, 95%-99%, or 99%-100%.

Genetic Variations Associated with PML

Described herein, are methods that can be used to detect genetic variations. Detecting specific genetic variations, for example polymorphic markers and/or haplotypes, copy number, absence or presence of an allele, or genotype associated with a condition (e.g., disease or disorder) as described herein, can be accomplished by methods known in the art for analyzing nucleic acids and/or detecting sequences at polymorphic or genetically variable sites, for example, amplification techniques, hybridization techniques, sequencing, microarrays/arrays, or any combination thereof. Thus, by use of these methods disclosed herein or other methods available to the person skilled in the art, one or more alleles at polymorphic markers, including microsatellites, single nucleotide polymorphisms (SNPs), single nucleotide variations (SNVs), insertions/deletions (indels), copy number variations (CNVs), or other types of genetic variations, can be identified in a sample obtained from a subject.

Genomic sequences within populations exhibit variability between individuals at many locations in the genome. For example, the human genome exhibits sequence variations that occur on average every 500 base pairs. Such genetic variations in polynucleic acid sequences are commonly referred to as polymorphisms or polymorphic sites. As used herein, a polymorphism, e.g., genetic variation, includes a variation in the sequence of the genome amongst a population, such as allelic variations and other variations that arise or are observed. Thus, a polymorphism refers to the occurrence of two or more genetically determined alternative sequences or alleles in a population. These differences can occur in coding (e.g., exonic) and non-coding (e.g., intronic or intergenic) portions of the genome, and can be manifested or detected as differences in polynucleic acid sequences, gene expression, including, for example transcription, processing, translation, transport, protein processing, trafficking, DNA synthesis; expressed proteins, other gene products or products of biochemical pathways or in post-translational modifications and any other differences manifested amongst members of a population. Polymorphisms that arise as the result of a single base change, such as single nucleotide polymorphisms (SNPs) or single nucleotide variations (SNVs), can include an insertion, deletion or change in one nucleotide. A polymorphic marker or site is the locus at which divergence occurs. Such sites can be as small as one base pair (an SNP or SNV). Polymorphic markers include, but are not limited to, restriction fragment length polymorphisms (RFLPs), variable number of tandem repeats (VNTRs), hypervariable regions, minisatellites, dinucleotide repeats, trinucleotide repeats, tetranucleotide repeats and other repeating patterns, simple sequence repeats and insertional elements, such as Alu. Polymorphic forms also are manifested as different mendelian alleles for a gene. Polymorphisms can be observed by differences in proteins, protein modifications, RNA expression modification, DNA and RNA methylation, regulatory factors that alter gene expression and DNA replication, and any other manifestation of alterations in genomic polynucleic acid or organelle polynucleic acids. Those skilled in the art can appreciate that polymorphisms are sometimes considered to be a subclass of variations, defined on the basis of a particular frequency cutoff in a population. For example, in some embodiments, polymorphisms are considered to genetic variants/variations that occur at >1%, or >5%, frequency in the population.

In some embodiments, these genetic variations can be found to be associated with one or more disorders and/or diseases using the methods disclosed herein. In some embodiments, these genetic variations can be found to be associated with absence of one or more disorders and/or diseases (i.e. the one or more variants are protective against development of the disorder and/or diseases) using the methods disclosed herein.

In some embodiments, these genetic variations comprise point mutations, polymorphisms, single nucleotide polymorphisms (SNPs), single nucleotide variations (SNVs), translocations, insertions, deletions, amplifications, inversions, interstitial deletions, copy number variations (CNVs), loss of heterozygosity, or any combination thereof. As genetic variation includes any deletion, insertion or base substitution of the genomic DNA of one or more individuals in a first portion of a total population which thereby results in a difference at the site of the deletion, insertion or base substitution relative to one or more individuals in a second portion of the total population. Thus, the term "genetic variation" encompasses "wild type" or the most frequently occurring variation, and also includes "mutant," or the less frequently occurring variation. In some embodiments, a wild type allele may be referred to as an ancestral allele.

As used herein, a target molecule that is "associated with" or "correlates with" a particular genetic variation is a molecule that can be functionally distinguished in its structure, activity, concentration, compartmentalization, degradation, secretion, and the like, as a result of such genetic variation. In some embodiments polymorphisms (e.g., polymorphic markers, genetic variations, or genetic variants) can comprise any nucleotide position at which two or more sequences are possible in a subject population. In some embodiments, each version of a nucleotide sequence, with respect to the polymorphism/variation, can represent a specific allele of the polymorphism/variation. In some embodiments, genomic DNA from a subject can contain two alleles for any given polymorphic marker, representative of each copy of the marker on each chromosome. In some embodiments, an allele can be a nucleotide sequence of a given location on a chromosome. Polymorphisms/variations can comprise any number of specific alleles. In some embodiments of the disclosure, a polymorphism/variation can be characterized by the presence of two or more alleles in a population. In some embodiments, the polymorphism/variation can be characterized by the presence of three or more alleles. In some embodiments, the polymorphism/variation can be characterized by four or more alleles, five or more alleles, six or more alleles, seven or more alleles, nine or more alleles, or ten or more alleles. In some embodiments an allele can be associated with one or more diseases or disorders, for example, a PML risk allele can be an allele that is associated with increased or decreased risk of developing PML. In some embodiments, genetic variations and alleles can be used to associate an inherited phenotype with a responsible genotype. In some embodiments, a PML risk allele can be a variant allele that is statistically associated with a screening of PML. In some embodiments, genetic variations can be of any measurable frequency in the population, for example, a frequency higher than 10%, a frequency from 5-10%, a frequency from 1-5%, a frequency from 0.1-1%, or a frequency below 0.1%. As used herein, variant alleles can be alleles that differ from a reference allele. As used herein, a variant can be a segment of DNA that differs from the reference DNA, such as a genetic variation. In some embodiments, genetic variations can be used to track the inheritance of a gene that has not yet been identified, but whose approximate location is known.

As used herein, a "haplotype" can be information regarding the presence or absence of one or more genetic markers in a given chromosomal region in a subject. In some embodiments, a haplotype can be a segment of DNA characterized by one or more alleles arranged along the segment, for example, a haplotype can comprise one member of the pair of alleles for each genetic variation or locus. In some embodiments, the haplotype can comprise two or more alleles, three or more alleles, four or more alleles, five or more alleles, or any combination thereof, wherein, each allele can comprise one or more genetic variations along the segment.

In some embodiments, a genetic variation can be a functional aberration that can alter gene function, gene expression, polypeptide expression, polypeptide function, or any combination thereof. In some embodiments, a genetic variation can be a loss-of-function mutation, gain-of-function mutation, dominant negative mutation, or reversion. In some embodiments, a genetic variation can be part of a gene's coding region or regulatory region. Regulatory regions can control gene expression and thus polypeptide expression. In some embodiments, a regulatory region can be a segment of DNA wherein regulatory polypeptides, for example, transcription or splicing factors, can bind. In some embodiments a regulatory region can be positioned near the gene being regulated, for example, positions upstream or downstream of the gene being regulated. In some embodiments, a regulatory region (e g, enhancer element) can be several thousands of base pairs upstream or downstream of a gene.

In some embodiments, variants can include changes that affect a polypeptide, such as a change in expression level, sequence, function, localization, binding partners, or any combination thereof. In some embodiments, a genetic variation can be a frameshift mutation, nonsense mutation, missense mutation, neutral mutation, or silent mutation. For example, sequence differences, when compared to a reference nucleotide sequence, can include the insertion or deletion of a single nucleotide, or of more than one nucleotide, resulting in a frame shift; the change of at least one nucleotide, resulting in a change in the encoded amino acid; the change of at least one nucleotide, resulting in the generation of a premature stop codon; the deletion of several nucleotides, resulting in a deletion of one or more amino acids encoded by the nucleotides; the insertion of one or several nucleotides, such as by unequal recombination or gene conversion, resulting in an interruption of the coding sequence of a reading frame; duplication of all or a part of a sequence; transposition; or a rearrangement of a nucleotide sequence. Such sequence changes can alter the polypeptide encoded by the nucleic acid, for example, if the change in the nucleic acid sequence causes a frame shift, the frame shift can result in a change in the encoded amino acids, and/or can result in the generation of a premature stop codon, causing generation of a truncated polypeptide. In some embodiments, a genetic variation associated with PML can be a synonymous change in one or more nucleotides, for example, a change that does not result in a change in the amino acid sequence. Such a polymorphism can, for example, alter splice sites, affect the stability or transport of mRNA, or otherwise affect the transcription or translation of an encoded polypeptide. In some embodiments, a synonymous mutation can result in the polypeptide product having an altered structure due to rare codon usage that impacts polypeptide folding during translation, which in some cases may alter its function and/or drug binding properties if it is a drug target. In some embodiments, the changes that can alter DNA increase the possibility that structural changes, such as amplifications or deletions, occur at the somatic level. A polypeptide encoded by the reference nucleotide sequence can be a reference polypeptide with a particular reference amino acid sequence, and polypeptides encoded by variant nucleotide sequences can be variant polypeptides with variant amino acid sequences.

The most common sequence variants comprise base variations at a single base position in the genome, and such sequence variants, or polymorphisms, are commonly called single nucleotide polymorphisms (SNPs) or single nucleotide variants (SNVs). In some embodiments, a SNP represents a genetic variant present at greater than or equal to 1% occurrence in a population and in some embodiments a SNP or an SNV can represent a genetic variant present at any frequency level in a population. A SNP can be a nucleotide sequence variation occurring when a single nucleotide at a location in the genome differs between members of a species or between paired chromosomes in a subject. SNPs can include variants of a single nucleotide, for example, at a given nucleotide position, some subjects can have a 'G', while others can have a 'C'. SNPs can occur in a single mutational event, and therefore there can be two possible alleles possible at each SNP site; the original allele and the mutated allele. SNPs that are found to have two different bases in a single nucleotide position are referred to as biallelic SNPs, those with three are referred to as triallelic, and those with all four bases represented in the population are quadallelic. In some embodiments, SNPs can be considered neutral. In some embodiments SNPs can affect susceptibility to a condition (e.g., PML). SNP polymorphisms can have two alleles, for example, a subject can be homozygous for one allele of the polymorphism wherein both chromosomal copies of the individual have the same nucleotide at the SNP location, or a subject can be heterozygous wherein the two sister chromosomes of the subject contain different nucleotides. The SNP nomenclature as reported herein is the official Reference SNP (rs) ID identification tag as assigned to each unique SNP by the National Center for Biotechnological Information (NCBI).

Another genetic variation of the disclosure can be copy number variations (CNVs). As used herein, "CNVs" include alterations of the DNA of a genome that results in an abnormal number of copies of one or more sections of DNA. In some embodiments, a CNV comprises a CNV-subregion. As used herein, a "CNV-subregion" includes a continuous nucleotide sequence within a CNV. In some embodiments, the nucleotide sequence of a CNV-subregion can be shorter than the nucleotide sequence of the CNV, and in another embodiment the CNV-subregion can be equivalent to the CNV (e.g., such as for some recurrent CNVs). CNVs can be inherited or caused by de novo mutation and can be responsible for a substantial amount of human phenotypic variability, behavioral traits, and disease susceptibility. In some embodiments, CNVs of the current disclosure can be associated with susceptibility to one or more conditions, for example, PML. In some embodiments, CNVs can include a single gene or include a contiguous set of genes. In some embodiments, CNVs can be caused by structural rearrangements of the genome, for example, unbalanced translocations or inversions, insertions, deletions, amplifications, and interstitial deletions. In some embodiments, these structural rearrangements occur on one or more chromosomes. Low copy repeats (LCRs), which are region-specific repeat sequences (also known as segmental duplications), can be susceptible to these structural rearrangements, resulting in CNVs. Factors such as size, orientation, percentage similarity and the distance between the copies can influence the susceptibility of LCRs to genomic rearrangement. In addition, rearrangements may be mediated by the presence of high copy number repeats, such as long interspersed elements (LINES) and short interspersed elements (SINEs), often via non-homologous recombination. For example, chromosomal rearrangements can arise from non-allelic homologous recombination during meiosis or via a replication-based mechanism such as fork stalling and template switching (FoSTeS) (Zhang F. et al., Nat. Genet. (2009)) or microhomology-mediated break-induced repair (MMBIR) (Hastings P. J. et al., PLoS Genetics (2009)). In some embodiments, CNVs are referred to as structural variants, which are a broader class of variant that also includes copy number neutral alterations such as balanced inversions and balanced translocations.

CNVs can account for genetic variation affecting a substantial proportion of the human genome, for example, known CNVs can cover over 15% of the human genome sequence (Estivill and Armengol, PLoS Genetics (2007)). CNVs can affect gene expression, phenotypic variation and adaptation by disrupting or impairing gene dosage, and can cause disease, for example, microdeletion and microduplication disorders, and can confer susceptibility to diseases and disorders. Updated information about the location, type, and size of known CNVs can be found in one or more databases, for example, the Database of Genomic Variants (See, MacDonald J R et al., Nucleic Acids Res., 42, D986-92 (2014), which currently contains data for over 500,000 CNVs (as of May, 2016).

Other types of sequence variants can be found in the human genome and can be associated with a disease or disorder, including but not limited to, microsatellites. Microsatellite markers are stable, polymorphic, easily analyzed, and can occur regularly throughout the genome, making them especially suitable for genetic analysis. A polymorphic microsatellite can comprise multiple small repeats of bases, for example, CA repeats, at a particular site wherein the number of repeat lengths varies in a population. In some embodiments, microsatellites, for example, variable number of tandem repeats (VNTRs), can be short segments of DNA that have one or more repeated sequences, for example, about 2 to 5 nucleotides long, that can occur in non-coding DNA. In some embodiments, changes in microsatellites can occur during genetic recombination of sexual reproduction, increasing or decreasing the number of repeats found at an allele, or changing allele length.

The genetic variations disclosed herein can be associated with a risk of developing PML in a subject. In some cases, the subject can have a decreased risk due to the absence of one or more genetic variations that disrupt or modulate a corresponding gene according to Tables 1 to 26. For example, the subject can have a decreased risk due to the absence of one or more genetic variations that disrupt or modulate a corresponding gene according to Tables 3 and 6. In some cases, the subject can have an increased risk due to the presence of one or more genetic variations that disrupt or modulate a corresponding gene according to Tables 1 to 26. For example, the subject can have an increased risk due to the presence of one or more genetic variations that disrupt or modulate a corresponding gene according to Tables 3 and 6. In some cases, one or more genes listed in Tables 25A, 25B, and 26 can be removed from any one of the Tables 1-24. In some cases, one or more genes listed in Tables 25A, 25B, and 26 can be added to any one of the Tables 1-24.

TABLE 25A exemplary 8-gene panel

| RefSeq Gene Symbol | Disease Model | Gene Source | Source Annotation | Gene Number (GN) |
|---|---|---|---|---|
| BAG3 | AR | Public_db | PMID: 19229298, 19282432, 22984599, 27042682 | 175 |
| BTK | XLR | Public_db | PMID: 18281276, 23765059, 25930993, 26029204 | 180 |
| CD40LG | XLR | Public_db | PMID: 17360404, 21455173, 23765059, 26008899, 26029204 | 206 |
| DOCK8 | AR | Public_db | PMID: 23765059, 23887241, 26029204, 26454313 | 242 |
| MAGT1 | XLR | Public_db | PMID: 23887241, 25504528, 27873163 | 326 |
| RAG1 | AD_AR | Public_db | PMID: 23122631, 23765059, 23887241, 25976673, 26029204, 26454313, 27484032, 27808398 | 370 |
| STAT1 | AD_AR | Public_db | PMID: 23887241, 25645939, 26029204, 26513235, 26743090, 27821552, 27873163 | 436 |
| WAS | XLR | Both | PMID: 12874226, 14647476, 19782549, 20008220, 24753205, 26029204, 26371186 | 483 |

TABLE 25B exemplary 16-gene panel

| RefSeq Gene Symbol | Disease Model | Gene Source | Source Annotation | Gene Number (GN) |
|---|---|---|---|---|
| ADA | AR | Both | PMID: 23765059, 24135998, 25930993, 26029204, 26454313 | 1 |
| BAG3 | AR | Public_db | PMID: 19229298, 19282432, 22984599, 27042682 | 175 |
| BTK | XLR | Public_db | PMID: 18281276, 23765059, 25930993, 26029204 | 180 |
| CD40LG | XLR | Public_db | PMID: 14647476, 17360404, 21455173, 23765059, 26008899, 26029204 | 206 |
| DNMT3B | AR | Public_db | PMID: 23486536, 23765059, 26029204, 26851945 | 240 |
| DOCK8 | AR | Public_db | PMID: 23765059, 23887241, 26029204, 26454313 | 242 |
| ITK | AR | Public_db | PMID: 14647476, 23765059, 26029204, 26454313 | 308 |
| LCK | AR | Public_db | PMID: 14647476, 23765059, 26029204, 26454313 | 316 |
| PNP | AR | Both | PMID: 26029204, 26454313 | 354 |
| RAG1 | AD_AR | Public_db | PMID: 23122631, 23765059, 23887241, 25976673, 26029204, 26454313, 27484032, 27808398 | 370 |
| STAT1 | AD_AR | Public_db | PMID: 23887241, 25645939, 26029204, 26513235, 26743090, 27821552, 27873163 | 436 |
| STAT3 | AD | Public_db | PMID: 23765059, 23887241, 25645939, 25930993, 26029204, 27658964, 27873163 | 438 |
| STK3 | unknown | Both | PMID: 26029204 | 135 |
| TYK2 | AR | Public_db | PMID: 26029204, 26513235, 27821552 | 144 |
| WAS | XLR | Both | PMID: 12874226, 19782549, 20008220, 24753205, 26029204, 26371186 | 483 |
| WIPF1 | AR | Public_db | PMID: 23765059, 26029204, 26453379 | 485 |

TABLE 26 exemplary 2-gene panel

| RefSeq Gene Symbol | Exon overlap | NCBI Gene ID | Gene Description | RefSeq_Summary | Gene # (GN) |
|---|---|---|---|---|---|
| ADA | intronic | 100 | adenosine deaminase | This gene encodes an enzyme that catalyzes the hydrolysis of adenosine to inosine. Various mutations have been described for this gene and have been linked to human diseases. Deficiency in this enzyme causes a form of severe combined immunodeficiency disease (SCID), in which there is dysfunction of both B and T lymphocytes with impaired cellular immunity and decreased production of immunoglobulins, whereas elevated levels of this enzyme have been associated with congenital hemolytic anemia. [provided by RefSeq, July 2008]. Publication Note: This RefSeq record includes a subset of the publications that are available for this gene. Please see the Gene record to access additional publications. ##Evidence-Data-START## | 1 |

TABLE 26-continued exemplary 2-gene panel

| RefSeq Gene Symbol | Exon overlap | NCBI Gene ID | Gene Description | RefSeq_Summary | Gene # (GN) |
|---|---|---|---|---|---|
| STK3 | intronic | 6788 | serine/threonine-protein kinase 3 isoform 1 | Transcript exon combination :: BC040226.1, X02994.1 [ECO: 0000332] RNAseq introns :: mixed/partial sample support ERS025081, ERS025082 [ECO: 0000350] ##Evidence-Data-END## This gene encodes a serine/threonine protein kinase activated by proapoptotic molecules indicating the encoded protein functions as a growth suppressor. Cleavage of the protein product by caspase removes the inhibitory C-terminal portion. The N-terminal portion is transported to the nucleus where it homodimerizes to form the active kinase which promotes the condensation of chromatin during apoptosis. Multiple transcript variants encoding different isoforms have been found for this gene. [provided by RefSeq, January 2012]. Transcript Variant: This variant (1) encodes isoform 1. Publication Note: This RefSeq record includes a subset of the publications that are available for this gene. Please see the Gene record to access additional publications. ##Evidence-Data-START## Transcript exon combination :: U26424.1, BC010640.2 [ECO: 0000332] RNAseq introns :: single sample supports all introns ERS025084, ERS025088 [ECO: 0000348] ##Evidence-Data-END## | 135 |

Subjects

A "subject", as used herein, can be an individual of any age or sex from whom a sample containing polynucleotides is obtained for analysis by one or more methods described herein so as to obtain polynucleic acid information; for example, a male or female adult, child, newborn, or fetus. In some embodiments, a subject can be any target of therapeutic administration. In some embodiments, a subject can be a test subject or a reference subject.

As used herein, a "cohort" can represent an ethnic group, a patient group, a particular age group, a group not associated with a particular condition (e.g., disease or disorder), a group associated with a particular condition (e.g., disease or disorder), a group of asymptomatic subjects, a group of symptomatic subjects, or a group or subgroup of subjects associated with a particular response to a treatment regimen or enrolled in a clinical trial. In some embodiments, a patient can be a subject afflicted with a condition (e.g., disease or disorder). In some embodiments, a patient can be a subject not afflicted with a condition (e.g., disease or disorder) and is considered apparently healthy, or a normal or control subject. In some embodiments, a subject can be a test subject, a patient or a candidate for a therapeutic, wherein genomic DNA from the subject, patient, or candidate is obtained for analysis by one or more methods of the present disclosure herein, so as to obtain genetic variation information of the subject, patient or candidate.

In some embodiments, the polynucleic acid sample can be obtained prenatally from a fetus or embryo or from the mother, for example, from fetal or embryonic cells in the maternal circulation. In some embodiments, the polynucleic acid sample can be obtained with the assistance of a health care provider, for example, to draw blood. In some embodiments, the polynucleic acid sample can be obtained without the assistance of a health care provider, for example, where the polynucleic acid sample is obtained non-invasively, such as a saliva sample, or a sample comprising buccal cells that is obtained using a buccal swab or brush, or a mouthwash sample.

The present disclosure also provides methods for assessing genetic variations in subjects who are members of a target population. Such a target population is in some embodiments a population or group of subjects at risk of developing the condition (e.g., disease or disorder), based on, for example, other genetic factors, biomarkers, biophysical parameters, diagnostic testing such as magnetic resonance imaging (MRI), family history of the condition, previous screening or medical history, or any combination thereof.

The genetic variations of the present disclosure found to be associated with a condition (e.g., disease or disorder) can show similar association in other human populations. Particular embodiments comprising subject human populations are thus also contemplated and within the scope of the disclosure. Such embodiments relate to human subjects that are from one or more human populations including, but not limited to, Caucasian, Ashkenazi Jewish, Sephardi Jewish, European, American, Eurasian, Asian, Central/South Asian, East Asian, Middle Eastern, African, Hispanic, Caribbean, and Oceanic populations. European populations include, but are not limited to, Swedish, Norwegian, Finnish, Russian, Danish, Icelandic, Irish, Kelt, English, Scottish, Dutch, Belgian, French, German, Spanish, Portuguese, Italian, Polish, Bulgarian, Slavic, Serbian, Bosnian, Czech, Greek and Turkish populations. The ethnic contribution in subjects can also be determined by genetic analysis, for example, genetic analysis of ancestry can be carried out using unlinked microsatellite markers or single nucleotide polymorphisms (SNPs) such as those set out in Smith et al., (Smith M. W. et al., Am. J. Hum. Genet., 74:1001 (2004)).

Certain genetic variations can have different population frequencies in different populations, or are polymorphic in one population but not in another. The methods available and as thought herein can be applied to practice the present disclosure in any given human population. This can include assessment of genetic variations of the present disclosure, so as to identify those markers that give strongest association within the specific population. Thus, the at-risk variants of the present disclosure can reside on different haplotype background and in different frequencies in various human populations.

Conditions and Immunosuppressive Medications

In some embodiments, a subject can be diagnosed or undiagnosed with a condition (e.g., disease or disorder), can be asymptomatic or symptomatic, can have increased or decreased susceptibility to a condition (e.g., disease or disorder), can be currently under or previously under or not under a treatment for a condition (e.g., disease or disorder), or any combination thereof. In some embodiments, the condition can be AIDS, cancer, organ transplant, or an autoimmune disease. In some embodiments, the condition is PML.

In some embodiments, a subject can be diagnosed or undiagnosed with PML, can be asymptomatic or symptomatic, can have increased or decreased susceptibility to PML, can be currently under or previously under or not under a treatment for PML, or any combination thereof. In some embodiments, a subject can be diagnosed or undiagnosed with AIDS (e.g., individuals infected with HIV), can be asymptomatic or symptomatic, can have increased or decreased susceptibility to AIDS, can be currently under or previously under or not under a treatment for AIDS, or any combination thereof. In some embodiments, a subject can be diagnosed or undiagnosed with cancer (e.g., Hodgkin's disease, leukemia, lymphoma, or myelofibrosis), can be asymptomatic or symptomatic, can have increased or decreased susceptibility to cancer, can be currently under or previously under or not under a treatment for cancer, or any combination thereof. In some embodiments, a subject can be currently diagnosed or previously diagnosed or undiagnosed with an autoimmune disease (e.g., multiple sclerosis, rheumatoid arthritis, psoriasis, systemic lupus erythematosus), can be asymptomatic or symptomatic, can have increased or decreased susceptibility to an autoimmune disease, can be currently under or previously under or not under a treatment for an autoimmune disease, or any combination thereof.

The term "cancer" is meant to include all types of cancerous growths or oncogenic processes, metastatic tissues or malignantly transformed cells, tissues, or organs, irrespective of histopathologic type or stage of invasiveness. A metastatic tumor can arise from a multitude of primary tumor types, including but not limited to those of breast, lung, liver, colon and ovarian origin. Examples of cancers include, but are not limited to, a fibrosarcoma, myosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastric cancer, esophageal cancer, rectal cancer, pancreatic cancer, ovarian cancer, prostate cancer, uterine cancer, cancer of the head and neck, skin cancer, brain cancer, squamous cell carcinoma, sebaceous gland carcinoma, papillary carcinoma, papillary adenocarcinoma, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular cancer, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma, leukemia, lymphoma, myelofibrosis, or Kaposi sarcoma.

The term "autoimmune disease" is meant to include all types of pathological states arising from abnormal immune responses of the body to substances and tissues that are normally present in the body. Examples of autoimmune diseases include, but are not limited to, Addison disease, Anti-NMDA receptor encephalitis, antisynthetase syndrome, Aplastic anemia, autoimmune anemias, Autoimmune hemolytic anemia, Autoimmune pancreatitis, Behcet's Disease, bullous skin disorders, Celiac disease—sprue (gluten-sensitive enteropathy), chronic fatigue syndrome, Chronic inflammatory demyelinating polyneuropathy, chronic lymphocytic leukemia, Crohn's disease, Dermatomyositis, Devic's disease, Erythroblastopenia, Evans syndrome, Focal segmental glomerulosclerosis, Granulomatosis with polyangiitis, Graves disease, Graves' ophthalmopathy, Guillain-Barre syndrome, Hashimoto thyroiditis, idiopathic thrombocytopenic purpura (ITP), IgA nephropathy, IgA-mediated autoimmune diseases, IgG4-related disease, Inflammatory bowel disease, Juvenile idiopathic arthritis, Multiple sclerosis, Myasthenia gravis, myeloma, non-Hodgkin's lymphoma, Opsoclonus myoclonus syndrome (OMS), Pemphigoid, Pemphigus, pemphigus vulgaris, Pernicious anemia, polymyositis, Psoriasis, pure red cell aplasia, Reactive arthritis, Rheumatoid arthritis, Sarcoidosis, scleroderma, Sjögren syndrome, Systemic lupus erythematosus, Thrombocytopenic purpura, Thrombotic thrombocytopenic purpura, Type I diabetes, Ulcerative colitis, Vasculitis (e.g., vasculitis associated with anti-neutrophil cytoplasmic antibody) and Vitiligo.

In some embodiments, a subject can be currently treated with an immunosuppressive medication. In some embodiments, a subject can be previously treated with an immunosuppressive medication. In some embodiments, a subject can be not yet treated with an immunosuppressive medication. The immunosuppressive medication can include but not limited to glucocorticoids, cytostatics, antibodies, drugs acting on immunophilins, interferons, opioids, TNF binding proteins, mycophenolate, or other small biological agents. For example, glucocorticoids can include but not limited to cortisol (hydrocortisone), cortisone, prednisone, prednisolone, methylprednisolone, dexamethasone, betamethasone, triamcinolone, beclometasone, fludrocortisone acetate, deoxycorticosterone acetate (DOCA), or aldosterone. Cytostatics can include but not limited to nitrogen mustards (cyclophosphamide), nitrosoureas, platinum compounds, folic acid analogues such as methotrexate, purine analogues such as azathioprine and mercaptopurine, pyrimidine analogues such as fluorouracil, protein synthesis inhibitors, cytotoxic antibiotics such as dactinomycin, anthracyclines, mitomycin C, bleomycin, or mithramycin. Antibodies can include but not limited to polyclonal antibodies such as atgam and thymoglobuline, monoclonal antibodies such as CD25- and CD3-directed antibodies, muromonab-CD3, basiliximab (Simulect), and daclizumab (Zenapax). Drugs acting on immunophilins can include but not limited to ciclosporin, tacrolimus, sirolimus, or everolimus. TNF binding proteins can include but not limited to infliximab (Remicade), etanercept (Enbrel), or adalimumab (Humira). Other small biological agents can include but not limited to fingolimod and myriocin.

In some embodiments, the immunosuppressive medication can be drugs for treating multiple sclerosis include but not limited to interferon beta-1a (e.g., Avonex, Rebif), interferon beta-1b (e.g., Betaseron, Extavia), glatiramer acetate (Copaxone, Glatopa), peginterferon beta-1a (e.g., Plegridy), teriflunomide (Aubagio), fingolimod (Gilenya), dimethyl fumarate (Tecfidera), alemtuzumab (Lemtrada), mitoxantrone (e.g., Novantrone), natalizumab (e.g., Tysabri), daclizumab (e.g., Zinbryta), or ocrelizumab (e.g., Ocrevus).

In some embodiments, the immunosuppressive medication can be adalimumab (e.g., Humira), alemtuzumab (e.g., Lemtrada), alentuzumab (e.g., Campath), azathioprine (e.g., Imuran), belimumab (e.g., Benlysta), bevacizumab (e.g., Avastatin), bortezomib (e.g., Velcade), eculizumab (e.g., Soliris), leflunomide, brentuximab vedotin (e.g., Adcetris), cetuximab (e.g., Erbitux), cyclophosphamid, cimethyl fumarate (e.g., Tecfidera), efalizumab (e.g., Raptiva), fingolimod (e.g., Gilenya), fludarabine (e.g., Fludara), fumaric acid, imatinib (e.g., Gleevec, Glivec), infliximab (e.g., Remicade), methotrexate (e.g., Trexall, Rheumatrex), mycophenolate mofetil (e.g., Cellcept), natalizumab (e.g., Tysabri), daclizumab (e.g., Zinbryta), rituximab (e.g., Rituxin), vedolizumab (Entyvio), ruxolitinib (e.g., Jakafi, Jakavi), or ocrelizumab (e.g., Ocrevus).

In some embodiments, a method of treating a condition in a subject in need of natalizumab therapy, comprises administering a therapeutically effective amount of natalizumab to the subject, wherein the subject is identified as not having one or more genetic variations that disrupt or modulate a corresponding gene according to Tables 3 and 6. In some embodiments, a method of reducing a risk of a subject developing PML comprises administering a therapeutically effective amount of natalizumab to the subject, wherein the subject is identified as not having one or more genetic variations that disrupt or modulate a corresponding gene according to Tables 3 and 6. In some embodiments, the condition is multiple sclerosis. In some embodiments, the condition is Crohn's disease. In some embodiments, a method of treating multiple sclerosis comprises administering natalizumab to a subject with multiple sclerosis, wherein the subject is identified as not having one or more genetic variations that disrupt or modulate a corresponding gene according to Tables 3 and 6. In some embodiments, a method of treating Crohn's disease comprises administering natalizumab to a subject with Crohn's disease, wherein the subject is identified as not having one or more genetic variations that disrupt or modulate a corresponding gene according to Tables 3 and 6. In some embodiments, a method of treating multiple sclerosis comprises testing a subject with multiple sclerosis for the presence of one or more genetic variations that disrupt or modulate a corresponding gene according to Tables 3 and 6, determining that the subject does not have the one or more genetic variations that disrupt or modulate a corresponding gene according to Tables 3 and 6, and administering natalizumab to the subject that was determined not to have the one or more genetic variations that disrupt or modulate a corresponding gene according to Tables 3 and 6. In some embodiments, a method of treating Crohn's disease comprises testing a subject with Crohn's disease for the presence of one or more genetic variations that disrupt or modulate a corresponding gene according to Tables 3 and 6, determining that the subject does not have the one or more genetic variations that disrupt or modulate a corresponding gene according to Tables 3 and 6, and administering natalizumab to the subject that was determined not to have the one or more genetic variations that disrupt or modulate a corresponding gene according to Tables 3 and 6. In some embodiments, a method of reducing a risk of a subject developing PML comprises testing a subject for the presence of one or more genetic variations that disrupt or modulate a corresponding gene according to Tables 3 and 6, determining that the subject has at least one of the one or more genetic variations that disrupt or modulate a corresponding gene according to Tables 3 and 6, and advising against administering natalizumab to the subject that was determined to have at least one of the one or more genetic variations that disrupt or modulate a corresponding gene according to Tables 3 and 6. In some embodiments, the subject has multiple sclerosis. In some embodiments, the subject has Crohn's disease. In some embodiments, a method of treating multiple sclerosis comprises testing a subject with multiple sclerosis for the presence of one or more genetic variations that disrupt or modulate a corresponding gene according to Tables 3 and 6, determining that the subject has at least one of the one or more genetic variations that disrupt or modulate a corresponding gene according to Tables 3 and 6, and advising against administering natalizumab to the subject that was determined to have at least one of the one or more genetic variations that disrupt or modulate a corresponding gene according to Tables 3 and 6. In some embodiments, a method of treating Crohn's disease comprises testing a subject with Crohn's disease for the presence of one or more genetic variations that disrupt or modulate a corresponding gene according to Tables 3 and 6, determining that the subject has at least one of the one or more genetic variations that disrupt or modulate a corresponding gene according to Tables 3 and 6, and advising against administering natalizumab to the subject that was determined to have at least one of the one or more genetic variations that disrupt or modulate a corresponding gene according to Tables 3 and 6. In some embodiments, the advising comprises advising that administering natalizumab is contraindicated. In some embodiments, the advising comprises advising that administering natalizumab increases the risk of the subject developing PML. In some embodiments, the advising comprises advising that administering natalizumab is a factor that increases the risk of the subject developing PML.

Samples

Samples that are suitable for use in the methods described herein can be polynucleic acid samples from a subject. A "polynucleic acid sample" as used herein can include RNA or DNA, or a combination thereof. In another embodiment, a "polypeptide sample" (e.g., peptides or proteins, or fragments therefrom) can be used to ascertain information that an amino acid change has occurred, which is the result of a genetic variant. Polynucleic acids and polypeptides can be extracted from one or more samples including but not limited to, blood, saliva, urine, mucosal scrapings of the lining of the mouth, expectorant, serum, tears, skin, tissue, or hair. A polynucleic acid sample can be assayed for polynucleic acid information. "Polynucleic acid information," as used herein, includes a polynucleic acid sequence itself, the presence/absence of genetic variation in the polynucleic acid sequence, a physical property which varies depending on the polynucleic acid sequence (e.g., Tm), and the amount of the polynucleic acid (e.g., number of mRNA copies). A "polynucleic acid" means any one of DNA, RNA, DNA including artificial nucleotides, or RNA including artificial nucleotides. As used herein, a "purified polynucleic acid" includes cDNAs, fragments of genomic polynucleic acids, polynucleic acids produced using the polymerase chain reaction (PCR), polynucleic acids formed by restriction enzyme treatment of genomic polynucleic acids, recombinant polynucleic acids, and chemically synthesized polynucleic acid molecules. A "recombinant" polynucleic acid molecule includes a polynucleic acid molecule made by an artificial combination of two otherwise separated segments of sequence, e.g., by chemical synthesis or by the manipulation of isolated segments of polynucleic acids by genetic engineering techniques. As used herein, a "polypeptide" includes proteins, fragments of proteins, and peptides, whether isolated from natural sources, produced by recombinant techniques, or chemically synthesized. A polypeptide may have one or more modifications, such as a post-translational modification (e.g., glycosylation, phosphorylation, etc.) or any other modification (e.g., pegylation, etc.). The polypeptide may contain one or more non-naturally-occurring amino acids (e.g., such as an amino acid with a side chain modification).

In some embodiments, the polynucleic acid sample can comprise cells or tissue, for example, cell lines. Exemplary cell types from which nucleic acids can be obtained using the methods described herein include, but are not limited to, the following: a blood cell such as a B lymphocyte, T lymphocyte, leukocyte, erythrocyte, macrophage, or neutrophil; a muscle cell such as a skeletal cell, smooth muscle cell or cardiac muscle cell; a germ cell, such as a sperm or egg; an epithelial cell; a connective tissue cell, such as an adipocyte, chondrocyte; fibroblast or osteoblast; a neuron; an astrocyte; a stromal cell; an organ specific cell, such as a kidney cell, pancreatic cell, liver cell, or a keratinocyte; a stem cell; or any cell that develops therefrom. A cell from which nucleic acids can be obtained can be a blood cell or a particular type of blood cell including, for example, a hematopoietic stem cell or a cell that arises from a hematopoietic stem cell such as a red blood cell, B lymphocyte, T lymphocyte, natural killer cell, neutrophil, basophil, eosinophil, monocyte, macrophage, or platelet. Generally, any type of stem cell can be used including, without limitation, an embryonic stem cell, adult stem cell, or pluripotent stem cell.

In some embodiments, a polynucleic acid sample can be processed for RNA or DNA isolation, for example, RNA or DNA in a cell or tissue sample can be separated from other components of the polynucleic acid sample. Cells can be harvested from a polynucleic acid sample using standard techniques, for example, by centrifuging a cell sample and resuspending the pelleted cells, for example, in a buffered solution, for example, phosphate-buffered saline (PBS). In some embodiments, after centrifuging the cell suspension to obtain a cell pellet, the cells can be lysed to extract DNA. In some embodiments, the nucleic acid sample can be concentrated and/or purified to isolate DNA. All nucleic acid samples obtained from a subject, including those subjected to any sort of further processing, are considered to be obtained from the subject. In some embodiments, standard techniques and kits known in the art can be used to extract RNA or DNA from a nucleic acid sample, including, for example, phenol extraction, a QIAamp® Tissue Kit (Qiagen, Chatsworth, Calif.), a Wizard® Genomic DNA purification kit (Promega), or a Qiagen Autopure method using Puregene chemistry, which can enable purification of highly stable DNA well-suited for archiving.

In some embodiments, determining the identity of an allele or determining copy number can, but need not, include obtaining a polynucleic acid sample comprising RNA and/or DNA from a subject, and/or assessing the identity, copy number, presence or absence of one or more genetic variations and their chromosomal locations within the genomic DNA (i.e. subject's genome) derived from the polynucleic acid sample.

The individual or organization that performs the determination need not actually carry out the physical analysis of a nucleic acid sample from a subject. In some embodiments, the methods can include using information obtained by analysis of the polynucleic acid sample by a third party. In some embodiments, the methods can include steps that occur at more than one site. For example, a polynucleic acid sample can be obtained from a subject at a first site, such as at a health care provider or at the subject's home in the case of a self-testing kit. The polynucleic acid sample can be analyzed at the same or a second site, for example, at a laboratory or other testing facility.

Nucleic Acids

The nucleic acids and polypeptides described herein can be used in methods and kits of the present disclosure. In some embodiments, aptamers that specifically bind the nucleic acids and polypeptides described herein can be used in methods and kits of the present disclosure. As used herein, a nucleic acid can comprise a deoxyribonucleotide (DNA) or ribonucleotide (RNA), whether singular or in polymers, naturally occurring or non-naturally occurring, double-stranded or single-stranded, coding, for example a translated gene, or non-coding, for example a regulatory region, or any fragments, derivatives, mimetics or complements thereof. In some embodiments, nucleic acids can comprise oligonucleotides, nucleotides, polynucleotides, nucleic acid sequences, genomic sequences, complementary DNA (cDNA), antisense nucleic acids, DNA regions, probes, primers, genes, regulatory regions, introns, exons, open-reading frames, binding sites, target nucleic acids and allele-specific nucleic acids.

A "probe," as used herein, includes a nucleic acid fragment for examining a nucleic acid in a specimen using the hybridization reaction based on the complementarity of nucleic acid.

A "hybrid" as used herein, includes a double strand formed between any one of the abovementioned nucleic acid, within the same type, or across different types, including DNA-DNA, DNA-RNA, RNA-RNA or the like.

"Isolated" nucleic acids, as used herein, are separated from nucleic acids that normally flank the gene or nucleotide sequence (as in genomic sequences) and/or has been completely or partially purified from other transcribed sequences (e.g., as in an RNA library). For example, isolated nucleic acids of the disclosure can be substantially isolated with respect to the complex cellular milieu in which it naturally occurs, or culture medium when produced by recombinant techniques, or chemical precursors or other chemicals when chemically synthesized. In some instances, the isolated material can form part of a composition, for example, a crude extract containing other substances, buffer system or reagent mix. In some embodiments, the material can be purified to essential homogeneity using methods known in the art, for example, by polyacrylamide gel electrophoresis (PAGE) or column chromatography (e.g., HPLC). With regard to genomic DNA (gDNA), the term "isolated" also can refer to nucleic acids that are separated from the chromosome with which the genomic DNA is naturally associated. For example, the isolated nucleic acid molecule can contain less than about 250 kb, 200 kb, 150 kb, 100 kb, 75 kb, 50 kb, 25 kb, 10 kb, 5 kb, 4 kb, 3 kb, 2 kb, 1 kb, 0.5 kb or 0.1 kb of the nucleotides that flank the nucleic acid molecule in the gDNA of the cell from which the nucleic acid molecule is derived.

Nucleic acids can be fused to other coding or regulatory sequences can be considered isolated. For example, recombinant DNA contained in a vector is included in the definition of "isolated" as used herein. In some embodiments, isolated nucleic acids can include recombinant DNA molecules in heterologous host cells or heterologous organisms, as well as partially or substantially purified DNA molecules in solution. Isolated nucleic acids also encompass in vivo and in vitro RNA transcripts of the DNA molecules of the present disclosure. An isolated nucleic acid molecule or nucleotide sequence can be synthesized chemically or by recombinant means. Such isolated nucleotide sequences can be useful, for example, in the manufacture of the encoded polypeptide, as probes for isolating homologous sequences (e.g., from other mammalian species), for gene mapping (e.g., by in situ hybridization with chromosomes), or for detecting expression of the gene, in tissue (e.g., human tissue), such as by Northern blot analysis or other hybridization techniques disclosed herein. The disclosure also pertains to nucleic acid sequences that hybridize under high stringency hybridization conditions, such as for selective hybridization, to a nucleotide sequence described herein Such nucleic acid sequences can be detected and/or isolated by allele- or sequence-specific hybridization (e.g., under high stringency conditions). Stringency conditions and methods for nucleic acid hybridizations are well known to the skilled person (see, e.g., Current Protocols in Molecular Biology, Ausubel, F. et al., John Wiley & Sons, (1998), and Kraus, M. and Aaronson, S., Methods Enzymol., 200:546-556 (1991), the entire teachings of which are incorporated by reference herein.

Calculations of "identity" or "percent identity" between two or more nucleotide or amino acid sequences can be determined by aligning the sequences for optimal comparison purposes (e.g., gaps can be introduced in the sequence of a first sequence). The nucleotides at corresponding positions are then compared, and the percent identity between the two sequences is a function of the number of identical positions shared by the sequences (i.e. % identity=# of identical positions/total # of positions×100). For example, a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which need to be introduced for optimal alignment of the two sequences.

In some embodiments, the length of a sequence aligned for comparison purposes is at least 30%, at least 40%, at least 50%, at least 60%, at least 70%, at least 80%, at least 90%, or at least 95%, of the length of the reference sequence. The actual comparison of the two sequences can be accomplished by well-known methods, for example, using a mathematical algorithm. A non-limiting example of such a mathematical algorithm is described in Karlin, S. and Altschul, S., Proc. Natl. Acad. Sci. USA, 90-5873-5877 (1993). Such an algorithm is incorporated into the NBLAST and XBLAST programs (version 2.0), as described in Altschul, S. et al., Nucleic Acids Res., 25:3389-3402 (1997). When utilizing BLAST and Gapped BLAST programs, any relevant parameters of the respective programs (e.g., NBLAST) can be used. For example, parameters for sequence comparison can be set at score=100, word length=12, or can be varied (e.g., W=5 or W=20). Other examples include the algorithm of Myers and Miller, CABIOS (1989), ADVANCE, ADAM, BLAT, and FASTA. In some embodiments, the percent identity between two amino acid sequences can be accomplished using, for example, the GAP program in the GCG software package (Accelrys, Cambridge, UK).

"Probes" or "primers" can be oligonucleotides that hybridize in a base-specific manner to a complementary strand of a nucleic acid molecule. Probes can include primers, which can be a single-stranded oligonucleotide probe that can act as a point of initiation of template-directed DNA synthesis using methods including but not limited to, polymerase chain reaction (PCR) and ligase chain reaction (LCR) for amplification of a target sequence. Oligonucleotides, as described herein, can include segments or fragments of nucleic acid sequences, or their complements. In some embodiments, DNA segments can be between 5 and 10,000 contiguous bases, and can range from 5, 10, 12, 15, 20, or 25 nucleotides to 10, 15, 20, 25, 30, 40, 50, 100, 200, 500, 1000 or 10,000 nucleotides. In addition to DNA and RNA, probes and primers can include polypeptide nucleic acids (PNA), as described in Nielsen, P. et al., Science 254: 1497-1500 (1991). A probe or primer can comprise a region of nucleotide sequence that hybridizes to at least about 15, typically about 20-25, and in certain embodiments about 40, 50, 60 or 75, consecutive nucleotides of a nucleic acid molecule.

The present disclosure also provides isolated nucleic acids, for example, probes or primers, that contain a fragment or portion that can selectively hybridize to a nucleic acid that comprises, or consists of, a nucleotide sequence, wherein the nucleotide sequence can comprise at least one polymorphism or polymorphic allele contained in the genetic variations described herein or the wild-type nucleotide that is located at the same position, or the complements thereof. In some embodiments, the probe or primer can be at least 70% identical, at least 80% identical, at least 85% identical, at least 90% identical, or at least 95% identical, to the contiguous nucleotide sequence or to the complement of the contiguous nucleotide sequence.

In some embodiments, a nucleic acid probe can be an oligonucleotide capable of hybridizing with a complementary region of a gene associated with a condition (e.g., PML) containing a genetic variation described herein. The nucleic acid fragments of the disclosure can be used as probes or primers in assays such as those described herein.

The nucleic acids of the disclosure, such as those described above, can be identified and isolated using standard molecular biology techniques well known to the skilled person. In some embodiments, DNA can be amplified and/or can be labeled (e.g., radiolabeled, fluorescently labeled) and used as a probe for screening, for example, a cDNA library derived from an organism. cDNA can be derived from mRNA and can be contained in a suitable vector. For example, corresponding clones can be isolated, DNA obtained following in vivo excision, and the cloned insert can be sequenced in either or both orientations by art-recognized methods to identify the correct reading frame encoding a polypeptide of the appropriate molecular weight. Using these or similar methods, the polypeptide and the DNA encoding the polypeptide can be isolated, sequenced and further characterized.

In some embodiments, nucleic acid can comprise one or more polymorphisms, variations, or mutations, for example, single nucleotide polymorphisms (SNPs), single nucleotide variations (SNVs), copy number variations (CNVs), for example, insertions, deletions, inversions, and translocations. In some embodiments, nucleic acids can comprise analogs, for example, phosphorothioates, phosphoramidates, methyl phosphonate, chiralmethyl phosphonates, 2-0-methyl ribonucleotides, or modified nucleic acids, for example, modified backbone residues or linkages, or nucleic acids combined with carbohydrates, lipids, polypeptide or other materials, or peptide nucleic acids (PNAs), for example, chromatin, ribosomes, and transcriptosomes. In some embodiments nucleic acids can comprise nucleic acids in various structures, for example, A DNA, B DNA, Z-form DNA, siRNA, tRNA, and ribozymes. In some embodiments, the nucleic acid may be naturally or non-naturally polymorphic, for example, having one or more sequence differences, for example, additions, deletions and/or substitutions, as compared to a reference sequence. In some embodiments, a reference sequence can be based on publicly available information, for example, the U.C. Santa Cruz Human Genome Browser Gateway (genome.ucsc.edu/cgi-bin/hg-Gateway) or the NCBI website (www.ncbi.nlm.nih.gov). In some embodiments, a reference sequence can be determined by a practitioner of the present disclosure using methods well known in the art, for example, by sequencing a reference nucleic acid.

In some embodiment a probe can hybridize to an allele, SNP, SNV, or CNV as described herein. In some embodiments, the probe can bind to another marker sequence associated with PML as described herein.

One of skill in the art would know how to design a probe so that sequence specific hybridization can occur only if a particular allele is present in a genomic sequence from a test nucleic acid sample. The disclosure can also be reduced to practice using any convenient genotyping method, including commercially available technologies and methods for genotyping particular genetic variations Control probes can also be used, for example, a probe that binds a less variable sequence, for example, a repetitive DNA associated with a centromere of a chromosome, can be used as a control. In some embodiments, probes can be obtained from commercial sources. In some embodiments, probes can be synthesized, for example, chemically or in vitro, or made from chromosomal or genomic DNA through standard techniques. In some embodiments sources of DNA that can be used include genomic DNA, cloned DNA sequences, somatic cell hybrids that contain one, or a part of one, human chromosome along with the normal chromosome complement of the host, and chromosomes purified by flow cytometry or microdissection. The region of interest can be isolated through cloning, or by site-specific amplification using PCR.

One or more nucleic acids for example, a probe or primer, can also be labeled, for example, by direct labeling, to comprise a detectable label. A detectable label can comprise any label capable of detection by a physical, chemical, or a biological process for example, a radioactive label, such as $^{32}P$ or $^{3}H$, a fluorescent label, such as FITC, a chromophore label, an affinity-ligand label, an enzyme label, such as alkaline phosphatase, horseradish peroxidase, or I2 galactosidase, an enzyme cofactor label, a hapten conjugate label, such as digoxigenin or dinitrophenyl, a Raman signal generating label, a magnetic label, a spin label, an epitope label, such as the FLAG or HA epitope, a luminescent label, a heavy atom label, a nanoparticle label, an electrochemical label, a light scattering label, a spherical shell label, semiconductor nanocrystal label, such as quantum dots (described in U.S. Pat. No. 6,207,392), and probes labeled with any other signal generating label known to those of skill in the art, wherein a label can allow the probe to be visualized with or without a secondary detection molecule. A nucleotide can be directly incorporated into a probe with standard techniques, for example, nick translation, random priming, and PCR labeling. A "signal," as used herein, include a signal suitably detectable and measurable by appropriate means, including fluorescence, radioactivity, chemiluminescence, and the like.

Non-limiting examples of label moieties useful for detection include, without limitation, suitable enzymes such as horseradish peroxidase, alkaline phosphatase, beta-galactosidase, or acetylcholinesterase; members of a binding pair that are capable of forming complexes such as streptavidin/biotin, avidin/biotin or an antigen/antibody complex including, for example, rabbit IgG and anti-rabbit IgG; fluorophores such as umbelliferone, fluorescein, fluorescein isothiocyanate, rhodamine, tetramethyl rhodamine, eosin, green fluorescent protein, erythrosin, coumarin, methyl coumarin, pyrene, malachite green, stilbene, lucifer yellow, Cascade Blue, Texas Red, dichlorotriazinylamine fluorescein, dansyl chloride, phycoerythrin, fluorescent lanthanide complexes such as those including Europium and Terbium, cyanine dye family members, such as Cy3 and Cy5, molecular beacons and fluorescent derivatives thereof, as well as others known in the art as described, for example, in Principles of Fluorescence Spectroscopy, Joseph R. Lakowicz (Editor), Plenum Pub Corp, 2nd edition (July 1999) and the 6th Edition of the Molecular Probes Handbook by Richard P. Hoagland; a luminescent material such as luminol; light scattering or plasmon resonant materials such as gold or silver particles or quantum dots; or radioactive material include $^{14}C$, $^{123}I$, $^{124}I$, $^{125}I$, Tc99m, $^{32}P$, $^{33}P$, $^{35}S$ or $^{3}H$.

Other labels can also be used in the methods of the present disclosure, for example, backbone labels. Backbone labels comprise nucleic acid stains that bind nucleic acids in a sequence independent manner. Non-limiting examples include intercalating dyes such as phenanthridines and acridines (e.g., ethidium bromide, propidium iodide, hexidium iodide, dihydroethidium, ethidium homodimer-1 and -2, ethidium monoazide, and ACMA); some minor grove binders such as indoles and imidazoles (e.g., Hoechst 33258, Hoechst 33342, Hoechst 34580 and DAPI); and miscellaneous nucleic acid stains such as acridine orange (also capable of intercalating), 7-AAD, actinomycin D, LDS751, and hydroxystilbamidine. All of the aforementioned nucleic acid stains are commercially available from suppliers such as Molecular Probes, Inc. Still other examples of nucleic acid stains include the following dyes from Molecular Probes: cyanine dyes such as SYTOX Blue, SYTOX Green, SYTOX Orange, POPO-1, POPO-3, YOYO-1, YOYO-3, TOTO-1, TOTO-3, JOJO-1, LOLO-1, BOBO-1, BOBO-3, PO-PRO-1, PO-PRO-3, BO-PRO-1, BO-PRO-3, TO-PRO-1, TO-PRO-3, TO-PRO-5, JO-PRO-1, LO-PRO-1, YO-PRO-1, YO-PRO-3, PicoGreen, OliGreen, RiboGreen, SYBR Gold, SYBR Green I, SYBR Green II, SYBR DX, SYTO-40, -41, -42, -43, -44, -45 (blue), SYTO-13, -16, -24, -21, -23, -12, -11, -20, -22, -15, -14, -25 (green), SYTO-81, -80, -82, -83, -84, -85 (orange), SYTO-64, -17, -59, -61, -62, -60, -63 (red).

In some embodiments, fluorophores of different colors can be chosen, for example, 7-amino-4-methylcoumarin-3-acetic acid (AMCA), 5-(and-6)-carboxy-X-rhodamine, lissamine rhodamine B, 5-(and-6)-carboxyfluorescein, fluorescein-5-isothiocyanate (FITC), 7-diethylaminocoumarin-3-carboxylic acid, tetramethylrhodamine-5-(and-6)-isothiocyanate, 5-(and-6)-carboxytetramethylrhodamine, 7-hydroxycoumarin-3-carboxylic acid, 6-[fluorescein 5-(and-6)-carboxamido]hexanoic acid, N-(4,4-difluoro-5,7-dimethyl-4-bora-3a,4a diaza-3-indacenepropionic acid, eosin-5-isothiocyanate, erythrosin-5-isothiocyanate, TRITC, rhodamine, tetramethylrhodamine, R-phycoerythrin, Cy-3, Cy-5, Cy-7, Texas Red, Phar-Red, allophycocyanin (APC), and CASCADE™ blue acetylazide, such that each probe in or not in a set can be distinctly visualized. In some embodiments, fluorescently labeled probes can be viewed with a fluorescence microscope and an appropriate filter for each fluorophore, or by using dual or triple bandpass filter sets to observe multiple fluorophores. In some embodiments, techniques such as flow cytometry can be used to examine the hybridization pattern of the probes.

In other embodiments, the probes can be indirectly labeled, for example, with biotin or digoxygenin, or labeled with radioactive isotopes such as $^{32}P$ and/or $^{3}H$. As a non-limiting example, a probe indirectly labeled with biotin can be detected by avidin conjugated to a detectable marker. For example, avidin can be conjugated to an enzymatic marker such as alkaline phosphatase or horseradish peroxidase. In some embodiments, enzymatic markers can be detected using colorimetric reactions using a substrate and/or a catalyst for the enzyme. In some embodiments, catalysts for alkaline phosphatase can be used, for example, 5-bromo-4-chloro-3-indolylphosphate and nitro blue tetrazolium. In some embodiments, a catalyst can be used for horseradish peroxidase, for example, diaminobenzoate.

One or more genes disclosed herein can be in conditions or molecular pathways related to various aspects of immune function including, but not limited to, Type I interferon response (e.g., PMID 26052098), B cell receptor pathway (e.g., Wikipathways WP23; PMID 22566564), RANKL/RANK signaling pathway (e.g., Wikipathways WP2018), TCR signaling pathway (e.g., Wikipathways WP69), NF-kB signaling (e.g., PMID 28362430), JAK-STAT pathway (e.g., PMID 28255960), post-translational modification biology such as ubiquitination via LUBAC (e.g., PMID 23104095, 24958845, 25086647, 26085218, 26111062, 26525107, 26848516, 26877205, 27178468, 27786304, 27892465), Aicardi-Goutieres syndrome (e.g., PMID 26052098), eosinophilia (e.g., PMID 27222657), congenital neutropenia (e.g., PMID 24753205), T cell receptor defects (e.g., PMID 25452106, 25636200, 26246585, 26379669, 26453379, 28400082), and autophagy defects (e.g., 19229298, 22984599, 23222957, 26917586, 26953272, 27588602). In some embodiments, one or more genes disclosed herein can be related to JC virus biology (e.g., PMID 15327898, 19282432, 19903823, 22984599, 25910481). In some embodiments, one or more genes disclosed herein can be antibiral immune response genes.

TABLE 27

Examplary pathways and biology for PML risk genes (96-gene panel)*

| Genes | Autoinflammatory disease | Autophagy defects | B cell defects | B cell receptor pathway | Deubiquitinase pathway | Eosinophilia-associated immunodeficiency | JC virus biology |
|---|---|---|---|---|---|---|---|
| AP3B1 | | | | | | | |
| APOL1 | | | | | | | 27042682 |
| ASH1L | | | | | | | |
| ATM | | | 23765059 | | | 27222657 | 19903823, 25910481, 27042682 |
| ATR | | | | | | | 19903823, 25910481 |
| BLM | | | | | | | |
| CARD11 | | | 23765059 | 23765059, WP23 | | 27222657 | |
| CDKN1B | | | | | | | |
| CHD7 | | | | | | 27222657 | |
| CLCN7 | | | | | | | |
| DCLRE1C | | | | | | | |
| DDX58 | | | | | | | |
| DOCK8 | | | 23765059 | | | 27222657 | |
| EGR1 | | | | | | | |
| EPG5 | | 23222957, 26917586 | | | | | |
| ETF1 | | | | | | | |
| FPR2 | | | | | | | |
| GATA2 | | | 23765059 | | | | |
| GFI1 | | | | | | | |
| HIVEP1 | | | | | | | |
| HIVEP2 | | | | | | | |
| HTR2A | | | | | | | 27042682 |
| IDO2 | | | | | | | |
| IFIH1 | | | | | | | |
| IFNGR2 | | | | | | | |
| IFNLR1 | | | | | | | |
| IGLL1 | | | 23765059 | 23765059 | | | |
| IKBKB | 28469620 | | 23765059 | 23765059, WP23 | 26877205, 28362430 | | |
| IL17F | | | | | | | |
| IL1B | | | | | 27892465 | | 15327898 |
| IL21R | | | 23765059 | | | | |
| IRAK4 | | | 23765059 | 23765059 | 28362430 | | |
| ITSN2 | | | | | | | |
| JUN | | | | WP23 | | | 27042682 |
| KAT6B | | | | | | | |
| KCTD7 | | | | | | | |
| LIG4 | | | | | | 27222657 | |
| LRBA | | 26707784 | 23765059 | | | | |
| MALL | | | | | | | |

TABLE 27-continued

Examplary pathways and biology for PML risk genes (96-gene panel)*

| Genes | | | | | | | |
|---|---|---|---|---|---|---|---|
| MAPK3 | | | | | | | 27042682 |
| MAVS | | | | | | | |
| MCEE | | | | | | | |
| MKL1 | | | | | | | |
| MYD88 | | | 23765059 | | 28362430 | | |
| NBN | | | | | | | |
| NFKB1 | 28469620 | | 23765059 | WP23 | 26877205, 28362430 | | |
| NOD2 | 28421071 | 26953272 | | | 28362430 | 27222657 | |
| NRIP1 | | | | | | | |
| PIAS1 | | | | | | | |
| PIAS2 | | | | | | | |
| PIK3CD | | | | | | | |
| PIK3CD-AS1 | | | | | | | |
| PIK3R1 | | | 23765059 | WP23 | | | |
| PKHD1 | | | | | | | |
| PLCG2 | | | 23765059 | WP23 | | | |
| PNPT1 | | | | | | | |
| POLA1 | | | | | | | |
| POLE | | | 23765059 | | | | |
| PRF1 | | | | | | | |
| PRKCB | | | | WP23 | | | |
| PRKCD | | | | WP23 | | | |
| PRKCH | | | | | | | |
| PRKDC | | | | | | | |
| PSTPIP1 | 28421071 | | | | | | |
| PTEN | | | | | | | |
| PTPRC | | | | WP23 | | | |
| RABGEF1 | | | | | | | |
| RAD51 | | | | | | | 27042682 |
| RAG1 | | | 23765059 | | | 27222657 | |
| RAG2 | | | 23765059 | | | 27222657 | |
| RIPK1 | 28469620 | | | | 26877205, 27892465, 28362430 | | |
| RIPK3 | | | | | 26877205, 27892465, 28362430 | | |
| RNF168 | | | | | | | |
| RTEL1 | | | | | | | |
| SHARPIN | 28469620 | | 23765059 | | 26877205, 27892465, 28362430 | | |
| SKIV2L | | | | | | | |
| SMAD4 | | | | | | | 27042682 |
| STIM1 | | | 23765059 | | | | |
| STIM2 | | | | | | | |
| STXBP2 | | | | | | | |
| TAP2 | | | | | | | |
| TBK1 | | | | | | | |
| TCIRG1 | | | | | | | |
| TICAM1 | | | | | 28362430 | | |
| TLR3 | 28469620 | | | | 28362430 | | |
| TLR4 | 28469620 | | | | 28362430 | | |
| TNFRSF11A | 28421071 | | | | 28362430 | | |
| TNFRSF13B | | | 23765059 | | | | |
| TNFRSF8 | | | | | | | |
| TP53 | | | | | | | |
| TRAF3 | | | | | | | |
| TRAFD1 | | | | | | | |
| TRPM2 | | | | | | | |
| VPS45 | | | | | | | |
| WEE1 | | | | | | | 27042682 |
| ZAP70 | | | 23765059 | | | 27222657 | |

| Genes | Osteopetrosis | PI3K signaling | RANKL/RANK pathway | T cell defects | T cell receptor pathway | TLR signaling | Type I interferon pathway |
|---|---|---|---|---|---|---|---|
| AP3B1 | 19782549, 24753205 | | | | | | |
| APOL1 | | | | | | | |
| ASH1L | | | | | | | |
| ATM | | | | | | | 25692705 |
| ATR | | | | | | | 24799566 |
| BLM | | | | | | | |

TABLE 27-continued

Examplary pathways and biology for PML risk genes (96-gene panel)*

| Gene | | | | | | | |
|---|---|---|---|---|---|---|---|
| CARD11 | | | | | WP69 | 25930993 | |
| CDKN1B | | | | | | | |
| CHD7 | | | | | | | |
| CLCN7 | 23877423, 24753205 | | | | | | |
| DCLRE1C | | | | | | | |
| DDX58 | | | | | | | 25145756, 26052098, 26763980, 27821552 |
| DOCK8 | | | | 26379669 | | | |
| EGR1 | | | | | | | |
| EPG5 | | | | | | | |
| ETF1 | | | | | | | |
| FPR2 | | | | | | | |
| GATA2 | | | | | | | |
| GFI1 | 19782549, 24753205 | | | | | | |
| HIVEP1 | | | | | | | |
| HIVEP2 | | | | | | | |
| HTR2A | | | | | | | |
| IDO2 | | | | | | | |
| IFIH1 | | | | | | | 26052098, 27821552 |
| IFNGR2 | | | | | | | |
| IFNLR1 | | | | | | | |
| IGLL1 | | | | | | | |
| IKBKB | 21079651 | | WP2018 | | WP69 | 20404851, 25930993 | 17047224, 25145756 |
| IL17F | | | | | | | |
| IL1B | | | | | WP69 | 25930993 | 25145756, 26763980 |
| IL21R | | | | | | | |
| IRAK4 | | | | | | 20404851, 25930993 | 25737587 |
| ITSN2 | | | | | | | |
| JUN | | | | | | | 25888367 |
| KAT6B | | | | | | | |
| KCTD7 | | | | | | | |
| LIG4 | | | | | | | |
| LRBA | | | | 26707784 | | | |
| MALL | | | | | | | |
| MAPK3 | | | WP2018 | | WP69 | 25930993 | |
| MAVS | | | | | | | 19120474, 22626058, 22901541, 25145756, 26763980 |
| MCEE | | | | | | | |
| MKL1 | | | | | | | 26098208, 26098211 |
| MYD88 | | | | | | 20404851, 25930993 | 16474425, 18573338, 25145756 |
| NBN | | | | | | | |
| NFKB1 | 21079651 | 27616589 | WP2018 | | WP69 | 20404851, 25930993 | 17047224, 25145756, 26763980 |
| NOD2 | | | | | | | 26763980 |
| NRIP1 | | | | | | | |
| PIAS1 | | | | | | | 24036127 |
| PIAS2 | | | | | | | 21156324, 24036127 |
| PIK3CD | | 27616589 | | | | | 20231019 |
| PIK3CD-AS1 | | 27616589 | | | | | |
| PIK3R1 | | 27616589 | WP2018 | | WP69 | | 26196376 |
| PKHD1 | | | | | | | |
| PLCG2 | | 27616589 | WP2018 | 26379669 | WP69 | 25930993 | |
| PNPT1 | | | | | | | |
| POLA1 | | | | | | | 27019227, 27821552 |
| POLE | | | | | | | |
| PRF1 | | | | | | | |
| PRKCB | | | | | | | |
| PRKCD | | | | | WP69 | | 11839738 |
| PRKCH | | | | | | | |
| PRKDC | | | | | | | 23251783 |
| PSTPIP1 | | | | | | | |

TABLE 27-continued

Examplary pathways and biology for PML risk genes (96-gene panel)*

| Gene | | | | |
|---|---|---|---|---|
| PTEN | 27616589 | | | |
| PTPRC | 27616589 | | | 19673688, 25869642 |
| RABGEF1 | | | | |
| RAD51 | | | | |
| RAG1 | 27616589 | | | |
| RAG2 | 27616589 | | | |
| RIPK1 | | | 20404851 | 25145756 |
| RIPK3 | | | | 25145756 |
| RNF168 | | | | |
| RTEL1 | | | | |
| SHARPIN | 25930993 | | 20404851 | 22901541, 25145756 |
| SKIV2L | | | | 25064072, 27821552 |
| SMAD4 | | | | |
| STIM1 | | | | 22144678 |
| STIM2 | | | | |
| STXBP2 | | | | |
| TAP2 | | | | |
| TBK1 | | | 25930993 | 18573338, 22626058, 25145756, 26763980, 28049150 |
| TCIRG1 | 23877423, 24753205 | | | |
| TICAM1 | | | 20404851, 25930993 | 19120474, 25145756, 28049150 |
| TLR3 | | | 20404851, 25930993 | 19120474, 25145756, 28049150 |
| TLR4 | | | 20404851, 25930993 | 25145756 |
| TNFRSF11A | 21079651, 23877423 | WP2018 | 25930993 | 21527253, 25407789 |
| TNFRSF13B | | | 25930993 | |
| TNFRSF8 | | | | |
| TP53 | | | | |
| TRAF3 | 21079651 | WP2018 | 25930993 | 22901541, 25723057, 26763980 |
| TRAFD1 | 25992615 | | 16221674 | 18849341 |
| TRPM2 | | | | |
| VPS45 | | | | |
| WEE1 | | | | |
| ZAP70 | 27616589 | | WP69 | |

*PMID numbers are listed for curated PubMed references or Wikipathway ID number

Table 27 contains an exemplary pathways and biology for PML risk genes based on the 96-gene panel listed in Table 19. The genes disclosed herein, such as the genes in the 96-gene panel, can be grouped based on the pathway or biological processes they are involved in.

Methods of Screening

As used herein, screening a subject comprises diagnosing or determining, theranosing, or determining the susceptibility to developing (prognosing) a condition, for example, PML. In particular embodiments, the disclosure is a method of determining a presence of, or a susceptibility to, PML, by detecting at least one genetic variation in a sample from a subject as described herein. In some embodiments, detection of particular alleles, markers, variations, or haplotypes is indicative of a presence or susceptibility to a condition (e.g., PML).

While means for screening PML using a JCV antibody test exist, PML risk is not adequately assessed by the JCV antibody test alone. Thus there exists a need for an improved screening test for assessing the risk of developing PML. Described herein are methods of screening an individual for a risk of developing PML, including but not limited to, determining the identity and location of genetic variations, such as variations in nucleotide sequence and copy number, and the presence or absence of alleles or genotypes in one or more samples from one or more subjects using any of the methods described herein. In some embodiments, determining an association to having or developing PML can be performed by detecting particular variations that appear more frequently in test subjects compared to reference subjects and analyzing the molecular and physiological pathways these variations can affect.

Within any given population, there can be an absolute susceptibility of developing a disease or trait, defined as the chance of a person developing the specific disease or trait over a specified time-period. Susceptibility (e.g., being at-risk) is typically measured by looking at very large numbers of people, rather than at a particular individual. As described herein, certain copy number variations (genetic variations) and/or single nucleotide variations are found to be useful for susceptibility assessment of PML. Susceptibility assessment can involve detecting particular genetic variations in the genome of individuals undergoing assessment. Particular genetic variations are found more frequently in individuals with PML, than in individuals without PML. Therefore, these genetic variations have predictive value for detecting PML, or a susceptibility to PML, in an individual. Without intending to be limited by theory, it is believed that the genetic variations described herein to be associated with susceptibility of PML represent functional variants predisposing to the disease. In some embodiments, a genetic variation can confer a susceptibility of the condition, for example carriers of the genetic variation are at a different risk of the condition than non-carriers. In some embodiments, the presence of a genetic variation is indicative of increased susceptibility to PML.

In some embodiments, screening can be performed using any of the methods disclosed, alone or in combination. In some embodiments, screening can be performed using Polymerase Chain Reaction (PCR). In some embodiments screening can be performed using Array Comparative Genomic Hybridization (aCGH) to detect CNVs. In another preferred embodiment screening can be performed using exome sequencing to detect SNVs, indels, and in some cases CNVs using appropriate analysis algorithms. In another preferred embodiment screening is performed using high-throughput (also known as next generation) whole genome sequencing methods and appropriate algorithms to detect all or nearly all genetic variations present in a genomic DNA sample. In some embodiments, the genetic variation information as it relates to the current disclosure can be used in conjunction with any of the above mentioned symptomatic screening tests to screen a subject for PML, for example, using a combination of aCGH and/or sequencing with a JCV screening test, such as the JCV antibody test, CD62L test, or CSF IgM oligoclonal band test. In some embodiments, the L-selectin (CD62L) expressed by $CD3^+CD4^+$ T cells in, for example, cryopreserved peripheral blood mononuclear cells (PBMCs), can be a biomarker for JCV screening. A CD62L expression can be correlated with the risk of PML.

In some embodiments, information from any of the above screening methods (e.g., specific symptoms, scoring matrix, or genetic variation data) can be used to define a subject as a test subject or reference subject. In some embodiments, information from any of the above screening methods can be used to associate a subject with a test or reference population, for example, a subject in a population.

In one embodiment, an association with PML can be determined by the statistical likelihood of the presence of a genetic variation in a subject with PML, for example, an unrelated individual or a first or second-degree relation of the subject. In some embodiments, an association with PML can be decided by determining the statistical likelihood of the absence of a genetic variation in an unaffected reference subject, for example, an unrelated individual or a first or second-degree relation of the subject. The methods described herein can include obtaining and analyzing a nucleic acid sample from one or more suitable reference subjects.

In the present context, the term screening comprises diagnosis, prognosis, and theranosis. Screening can refer to any available screening method, including those mentioned herein. As used herein, susceptibility can be proneness of a subject towards the development of PML, or towards being less able to resist PML than one or more control subjects. In some embodiments, susceptibility can encompass increased susceptibility. For example, particular nucleic acid variations of the disclosure as described herein can be characteristic of increased susceptibility to PML. In some embodiments, particular nucleic acid variations can confer decreased susceptibility, for example particular nucleic acid variations of the disclosure as described herein can be characteristic of decreased susceptibility to development of PML.

As described herein, a genetic variation predictive of susceptibility to or presence of PML can be one where the particular genetic variation is more frequently present in a group of subjects with the condition (affected), compared to the frequency of its presence in a reference group (control), such that the presence of the genetic variation is indicative of susceptibility to or presence of PML. In some embodiments, the reference group can be a population nucleic acid sample, for example, a random nucleic acid sample from the general population or a mixture of two or more nucleic acid samples from a population. In some embodiments, disease-free controls can be characterized by the absence of one or more specific disease-associated symptoms, for example, individuals who have not experienced symptoms associated with PML. In some embodiments, the disease-free control group is characterized by the absence of one or more disease-specific risk factors, for example, at least one genetic and/or environmental risk factor. In some embodiments, a reference sequence can be referred to for a particular site of genetic variation. In some embodiments, a reference allele can be a wild-type allele and can be chosen as either the first sequenced allele or as the allele from a control individual. In some embodiments, one or more reference subjects can be characteristically matched with one or more affected subjects, for example, with matched aged, gender or ethnicity.

A person skilled in the art can appreciate that for genetic variations with two or more alleles present in the population being studied, and wherein one allele can be found in increased frequency in a group of individuals with PML in the population, compared with controls, the other allele of the marker can be found in decreased frequency in the group of individuals with the trait or disease, compared with controls. In such a case, one allele of the marker, for example, the allele found in increased frequency in individuals with PML, can be the at-risk allele, while the other allele(s) can be a neutral or protective allele.

A genetic variant associated with PML can be used to predict the susceptibility of the disease for a given genotype. For any genetic variation, there can be one or more possible genotypes, for example, homozygote for the at-risk variant (e.g., in autosomal recessive disorders), heterozygote, and non-carrier of the at-risk variant. Autosomal recessive disorders can also result from two distinct genetic variants impacting the same gene such that the individual is a compound heterozygote (e.g., the maternal allele contains a different mutation than the paternal allele). Compound heterozygosity may result from two different SNVs, two different CNVs, an SNV and a CNV, or any combination of two different genetic variants but each present on a different allele for the gene. For X-linked genes, males who possess one copy of a variant-containing gene may be affected, while carrier females, who also possess a wild-type gene, may remain unaffected. In some embodiments, susceptibility associated with variants at multiple loci can be used to estimate overall susceptibility. For multiple genetic variants, there can be k ($k=3^n*2^P$) possible genotypes; wherein n can be the number of autosomal loci and p can be the number of gonosomal (sex chromosomal) loci. Overall susceptibility assessment calculations can assume that the relative susceptibilities of different genetic variants multiply, for example, the overall susceptibility associated with a particular genotype combination can be the product of the susceptibility values for the genotype at each locus. If the susceptibility presented is the relative susceptibility for a person, or a specific genotype for a person, compared to a reference population, then the combined susceptibility can be the product of the locus specific susceptibility values and can correspond to an overall susceptibility estimate compared with a population. If the susceptibility for a person is based on a comparison to non-carriers of the at-risk allele, then the combined susceptibility can correspond to an estimate that compares the person with a given combination of genotypes at all loci to a group of individuals who do not carry at-risk variants at any of those loci. The group of non-carriers of any at-risk variant can have the lowest estimated susceptibility and can have a combined susceptibility, compared with itself, for example, non-carriers, of 1.0, but can have an overall susceptibility, compared with the population, of less than 1.0.

Overall risk for multiple risk variants can be performed using standard methodology. Genetic variations described herein can form the basis of risk analysis that combines other genetic variations known to increase risk of PML, or other genetic risk variants for PML. In certain embodiments of the disclosure, a plurality of variants (genetic variations, variant alleles, and/or haplotypes) can be used for overall risk assessment. These variants are in some embodiments selected from the genetic variations as disclosed herein. Other embodiments include the use of the variants of the present disclosure in combination with other variants known to be useful for screening a susceptibility to PML. In such embodiments, the genotype status of a plurality of genetic variations, markers and/or haplotypes is determined in an individual, and the status of the individual compared with the population frequency of the associated variants, or the frequency of the variants in clinically healthy subjects, such as age-matched and sex-matched subjects.

Methods such as the use of available algorithms and software can be used to identify, or call, significant genetic variations, including but not limited to, algorithms of DNA Analytics or DNAcopy, iPattern and/or QuantiSNP. In some embodiments, a threshold log ratio value can be used to determine losses and gains. For example, using DNA Analytics, a $\log_2$ ratio cutoff of $\geq 0.5$ and $\leq 0.5$ to classify CNV gains and losses respectively can be used. For example, using DNA Analytics, a $\log_2$ ratio cutoff of $\geq 0.25$ and $\leq 0.25$ to classify CNV gains and losses respectively can be used. As a further example, using DNAcopy, a $\log_2$ ratio cutoff of $\geq 0.35$ and $\leq 0.35$ to classify CNV gains and losses respectively can be used. For example, an Aberration Detection Module 2 (ADM2) algorithm, such as that of DNA Analytics 4.0.85 can be used to identify, or call, significant genetic variations. In some embodiments, two or more algorithms can be used to identify, or call, significant genetic variations. For example, 2, 3, 4, 5, 6, 7, 8, 9, or 10 or more algorithms can be used to identify, or call, significant genetic variations. In another embodiment, the log 2 ratio of one or more individual probes on a microarray can be used to identify significant genetic variations, such as the presence of homozygously deleted regions in a subject's genome. In some embodiments, significant genetic variations can be CNVs.

CNVs detected by two or more algorithms can be defined as stringent and can be utilized for further analyses. In some embodiments, the information and calls from two or more of the methods described herein can be compared to each other to identify significant genetic variations more or less stringently. For example, CNV calls generated by two or more of DNA Analytics, Aberration Detection Module 2 (ADM2) algorithms, and DNAcopy algorithms can be defined as stringent CNVs. In some embodiments significant or stringent genetic variations can be tagged as identified or called if it can be found to have a minimal reciprocal overlap to a genetic variation detected by one or more platforms and/or methods described herein. For example, a minimum of 50% reciprocal overlap can be used to tag the CNVs as identified or called. For example, significant or stringent genetic variations can be tagged as identified or called if it can be found to have a reciprocal overlap of more than about 50%, 55% 60%, 65%, 70%, 75%, 80%, 85%, 90%, or 95%, 99%, or equal to 100%, to a genetic variation detected by one or more platforms and/or methods described herein. For example, significant or stringent genetic variations can be tagged as identified or called if it can be found to have a reciprocal overlap of more than about 50% reciprocal overlap to a genetic variation detected by one or more platforms and/or methods described herein. In another embodiment, genetic variations can be detected from the log 2 ratio values calculated for individual probes present on an aCGH microarray via a statistical comparison of the probe's log 2 ratio value in a cohort of subjects with PML to the probe's log 2 ratio value in a cohort of subjects without PML.

In some embodiments, a threshold log ratio value can be used to determine losses and gains. A log ratio value can be any log ratio value; for example, a log ratio value can be a log 2 ratio or a log 10 ratio. In some embodiments, a CNV segment whose median log 2 ratio is less than or equal to a log 2 ratio threshold value can be classified as a loss. For example, any segment whose median log 2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, can be classified as a loss.

In some embodiments, one algorithm can be used to call or identify significant genetic variations, wherein any segment whose median log 2 ratio was less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, can be classified as a loss. For example, any CNV segment whose median log 2 ratio is less than −0.35 as determined by DNAcopy can be classified as a loss. For example, losses can be determined according to a threshold log 2 ratio, which can be set at −0.35. In another embodiment, losses can be determined according to a threshold log 2 ratio, which can be set at −0.5.

In some embodiments, two algorithms can be used to call or identify significant genetic variations, wherein any segment whose median log 2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, as determined by one algorithm, and wherein any segment whose median log 2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20, or less, as determined by the other algorithm can be classified as a loss. For example, CNV calling can comprise using the Aberration Detection Module 2 (ADM2) algorithm and the DNAcopy algorithm, wherein losses can be determined according to a two threshold log 2 ratios, wherein the Aberration Detection Module 2 (ADM2) algorithm log 2 ratio can be −0.25 and the DNAcopy algorithm log 2 ratio can be −0.41.

In some embodiments, the use of two algorithms to call or identify significant genetic variations can be a stringent method. In some embodiments, the use of two algorithms to call or identify significant genetic variations can be a more stringent method compared to the use of one algorithm to call or identify significant genetic variations.

In some embodiments, any CNV segment whose median log 2 ratio is greater than a log 2 ratio threshold value can be classified as a gain. For example, any segment whose median log 2 ratio is greater than 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more can be classified as a gain.

In some embodiments, one algorithm can be used to call or identify significant genetic variations, wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3 or more can be classified as a gain. For example, any CNV segment whose median log 2 ratio is greater than 0.35 as determined by DNAcopy can be classified as a gain. For example, gains can be determined according to a threshold log 2 ratio, which can be set at 0.35. In another embodiment, gains can be determined according to a threshold log 2 ratio, which can be set at 0.5.

In some embodiments, two algorithms can be used to call or identify significant genetic variations, wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3 or more, as determined by one algorithm, and wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, or 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more, as determined by the other algorithm the can be classified as a gain. For example, CNV calling can comprise using the Aberration Detection Module 2 (ADM2) algorithm and the DNAcopy algorithm, wherein gains can be determined according to a two threshold log 2 ratios, wherein the Aberration Detection Module 2 (ADM2) algorithm log 2 ratio can be 0.25 and the DNAcopy algorithm log 2 ratio can be 0.32.

Any CNV segment whose absolute (median log-ratio/mad) value is less than 2 can be excluded (not identified as a significant genetic variation). For example, any CNV segment whose absolute (median log-ratio/mad) value is less than 2, 1.9, 1.8, 1.7, 1.6, 1.5, 1.4, 1.3, 1.2, 1.1, 1, 0.9, 0.8, 0.7, 0.6, or 0.5 or less can be excluded In some embodiments, multivariate analyses or joint risk analyses, including the use of multiplicative model for overall risk assessment, can subsequently be used to determine the overall risk conferred based on the genotype status at the multiple loci. Use of a multiplicative model, for example, assuming that the risk of individual risk variants multiply to establish the overall effect, allows for a straightforward calculation of the overall risk for multiple markers. The multiplicative model is a parsimonious model that usually fits the data of complex traits reasonably well. Deviations from multiplicity have been rarely described in the context of common variants for common diseases, and if reported are usually only suggestive since very large sample sizes can be required to be able to demonstrate statistical interactions between loci. Assessment of risk based on such analysis can subsequently be used in the methods, uses and kits of the disclosure, as described herein.

In some embodiments, the significance of increased or decreased susceptibility can be measured by a percentage. In some embodiments, a significant increased susceptibility can be measured as a relative susceptibility of at least 1.2, including but not limited to: at least 1.3, at least 1.4, at least 1.5, at least 1.6, at least 1.7, at least 1.8, at least 1.9, at least 2.0, at least 2.5, at least 3.0, at least 4.0, at least 5.0, at least 6.0, at least 7.0, at least 8.0, at least 9.0, at least 10.0, and at least 15.0. In some embodiments, a relative susceptibility of at least 2.0, at least 3.0, at least 4.0, at least, 5.0, at least 6.0, or at least 10.0 is significant. Other values for significant susceptibility are also contemplated, for example, at least 2.5, 3.5, 4.5, 5.5, or any suitable other numerical values, wherein the values are also within scope of the present disclosure. In some embodiments, a significant increase in susceptibility is at least about 20%, including but not limited to about 25%, 30%, 35%, 40%, 45%, 50%, 55%, 60%, 65%, 70%, 75%, 80%, 85%, 90%, 95%, 100%, 150%, 200%, 300%, 400%, 500%, 600%, 700%, 800%, 900%, 1000%, and 1500%. In one particular embodiment, a significant increase in susceptibility is at least 100%. In other embodiments, a significant increase in susceptibility is at least 200%, at least 300%, at least 400%, at least 500%, at least 700%, at least 800%, at least 900% and at least 1000%. Other cutoffs or ranges as deemed suitable by the person skilled in the art to characterize the disclosure are also contemplated, and those are also within scope of the present disclosure. In certain embodiments, a significant increase in susceptibility is characterized by a p-value, such as a p-value of less than 0.5, less than 0.4, less than 0.3, less than 0.2, less than 0.1, less than 0.05, less than 0.01, less than 0.001, less than 0.0001, less than 0.00001, less than 0.000001, less than 0.0000001, less than 0.00000001, or less than 0.000000001.

In some embodiments, an individual who is at a decreased susceptibility for or the lack of presence of a condition (e.g., PML) can be an individual in whom at least one genetic variation, conferring decreased susceptibility for or the lack of presence of the condition is identified. In some embodiments, the genetic variations conferring decreased susceptibility are also protective. In one aspect, the genetic variations can confer a significant decreased susceptibility of or lack of presence of PML.

In some embodiments, significant decreased susceptibility can be measured as a relative susceptibility of less than 0.9, including but not limited to less than 0.9, less than 0.8, less than 0.7, less than 0.6, less than 0.5, less than 0.4, less than 0.3, less than 0.2 and less than 0.1. In some embodiments, the decrease in susceptibility is at least 20%, including but not limited to at least 25%, at least 30%, at least 35%, at least 40%, at least 45%, at least 50%, at least 55%, at least 60%, at least 65%, at least 70%, at least 75%, at least 80%, at least 85%, at least 90%, at least 95% and at least 98%. Other cutoffs or ranges as deemed suitable by the person, skilled in the art to characterize the disclosure are however also contemplated, and those are also within scope of the present disclosure. In certain embodiments, a significant decrease in susceptibility is characterized by a p-value, such as a p-value of less than 0.05, less than 0.01, less than 0.001, less than 0.0001, less than 0.00001, less than 0.000001, less than 0.0000001, less than 0.00000001, or less than 0.000000001. Other tests for significance can be used, for example, a Fisher-exact test. Other statistical tests of significance known to the skilled person are also contemplated and are also within scope of the disclosure.

In some preferred embodiments, the significance of increased or decreased susceptibility can be determined according to the ratio of measurements from a test subject to a reference subject. In some embodiments, losses or gains of one or more CNVs can be determined according to a threshold $\log_2$ ratio determined by these measurements. In some embodiments, a $\log_2$ ratio value greater than 0.35, or 0.5, is indicative of a gain of one or more CNVs. In some embodiments, a $\log_2$ ratio value less than −0.35, or −0.5, is indicative of a loss of one or more CNVs. In some embodiments, the ratio of measurements from a test subject to a reference subject may be inverted such that the log 2 ratios of copy number gains are negative and the log 2 ratios of copy number losses are positive.

In some embodiments, the combined or overall susceptibility associated with a plurality of variants associated with PML can also be assessed; for example, the genetic variations described herein to be associated with susceptibility to PML can be combined with other common genetic risk factors. Combined risk for such genetic variants can be estimated in an analogous fashion to the methods described herein.

Calculating risk conferred by a particular genotype for the individual can be based on comparing the genotype of the individual to previously determined risk expressed, for example, as a relative risk (RR) or an odds ratio (OR), for the genotype, for example, for a heterozygous carrier of an at-risk variant for PML. An odds ratio can be a statistical measure used as a metric of causality. For example, in genetic disease research it can be used to convey the significance of a variant in a disease cohort relative to an unaffected/normal cohort. The calculated risk for the individual can be the relative risk for a subject, or for a specific genotype of a subject, compared to the average population. The average population risk can be expressed as a weighted average of the risks of different genotypes, using results from a reference population, and the appropriate calculations to calculate the risk of a genotype group relative to the population can then be performed. Alternatively, the risk for an individual can be based on a comparison of particular genotypes, for example, heterozygous and/or homozygous carriers of an at-risk allele of a marker compared with non-carriers of the at-risk allele (or pair of alleles in the instance of compound heterozygous variants, wherein one variant impacts the maternally inherited allele and the other impacts the paternally inherited allele). Using the population average can, in certain embodiments, be more convenient, since it provides a measure that can be easy to interpret for the user, for example, a measure that gives the risk for the individual, based on his/her genotype, compared with the average in the population.

In some embodiments, the OR value can be calculated as follows: OR=(A/(N1−A))/(U/(N2−U)), where A=number of affected cases with variant, N1=total number of affected cases, U=number of unaffected cases with variant and N2=total number of unaffected cases. In circumstances where U=0, it is conventional to set U=1, so as to avoid infinities. In some preferred embodiments, the OR can be calculated essentially as above, except that where U or A=0, 0.5 is added to all of A, N1, U, N2. In another embodiment, a Fisher's Exact Test (FET) can be calculated using standard methods. In another embodiment, the p-values can be corrected for false discovery rate (FDR) using the Benjamini-Hochberg method (Benjamini Y. and Hochberg Y., J. Royal Statistical Society 57:289 (1995); Osborne J. A. and Barker C. A. (2007)).

In certain embodiments of the disclosure, a genetic variation is correlated to PML by referencing genetic variation data to a look-up table that comprises correlations between the genetic variation and PML. The genetic variation in certain embodiments comprises at least one indication of the genetic variation. In some embodiments, the table comprises a correlation for one genetic variation. In other embodiments, the table comprises a correlation for a plurality of genetic variations in both scenarios, by referencing to a look-up table that gives an indication of a correlation between a genetic variation and PML, a risk for PML, or a susceptibility to PML, can be identified in the individual from whom the nucleic acid sample is derived.

The present disclosure also pertains to methods of clinical screening, for example, diagnosis, prognosis, or theranosis of a subject performed by a medical professional using the methods disclosed herein. In other embodiments, the disclosure pertains to methods of screening performed by a layman. The layman can be a customer of a genotyping, microarray, exome sequencing, or whole genome sequencing service provider. The layman can also be a genotype, microarray, exome sequencing, or whole genome sequencing service provider, who performs genetic analysis on a DNA sample from an individual, in order to provide service related to genetic risk factors for particular traits or diseases, based on the genotype status of the subject obtained from use of the methods described herein. The resulting genotype or genetic information can be made available to the individual and can be compared to information about PML or risk of developing PML associated with one or various genetic variations, including but not limited to, information from public or private genetic variation databases or literature and scientific publications. The screening applications of PML-associated genetic variations, as described herein, can, for example, be performed by an individual, a health professional, or a third party, for example a service provider who interprets genotype information from the subject. In some embodiments the genetic analysis is performed in a CLIA-certified laboratory (i.e. the federal regulatory standards the U.S. that are specified in the Clinical Laboratory Improvement Amendments, administered by the Centers for Medicare and Medicaid Services) or equivalent laboratories in Europe and elsewhere in the world.

The information derived from analyzing sequence data can be communicated to any particular body, including the individual from which the nucleic acid sample or sequence data is derived, a guardian or representative of the individual, clinician, research professional, medical professional, service provider, and medical insurer or insurance company. Medical professionals can be, for example, doctors, nurses, medical laboratory technologists, and pharmacists. Research professionals can be, for example, principle investigators, research technicians, postdoctoral trainees, and graduate students.

In some embodiments, a professional can be assisted by determining whether specific genetic variants are present in a nucleic acid sample from a subject, and communicating information about genetic variants to a professional. After information about specific genetic variants is reported, a medical professional can take one or more actions that can affect subject care. For example, a medical professional can record information in the subject's medical record (e.g., electronic health record or electronic medical record, including, but not limited to, country-scale health services such as the National Health Service in the United Kingdom) regarding the subject's risk of developing PML. In some embodiments, a medical professional can record information regarding risk assessment, or otherwise transform the subject's medical record, to reflect the subject's current medical condition. In some embodiments, a medical professional can review and evaluate a subject's entire medical record and assess multiple treatment strategies for clinical intervention of a subject's condition. In another embodiment, information can be recorded in the context of the system developed by the World Health Organization (WHO), the International Statistical Classification of Diseases and Related Health Problems (ICD), which is currently using the 10th revision (ICD-10 codes). For example, the ICD-10 code for PML is A81.2, whereas the ICD-10 code for multiple sclerosis is G35.

A medical professional can initiate or modify treatment after receiving information regarding a subject's screening for PML, for example. In some embodiments, a medical professional can recommend a change in therapy or exclude a therapy. In some embodiments, a medical professional can enroll a subject in a clinical trial for, by way of example, detecting correlations between a haplotype as described herein and any measurable or quantifiable parameter relating to the outcome of the treatment as described above.

In some embodiments, a medical professional can communicate information regarding a subject's screening of developing PML to a subject or a subject's family. In some embodiments, a medical professional can provide a subject and/or a subject's family with information regarding PML and risk assessment information, including treatment options, and referrals to specialists. In some embodiments, a medical professional can provide a copy of a subject's medical records to a specialist. In some embodiments, a research professional can apply information regarding a subject's risk of developing PML to advance scientific research. In some embodiments, a research professional can obtain a subject's haplotype as described herein to evaluate a subject's enrollment, or continued participation, in a research study or clinical trial. In some embodiments, a research professional can communicate information regarding a subject's screening of PML to a medical professional. In some embodiments, a research professional can refer a subject to a medical professional.

Any appropriate method can be used to communicate information to another person. For example, information can be given directly or indirectly to a professional and a laboratory technician can input a subject's genetic variation as described herein into a computer-based record. In some embodiments, information is communicated by making a physical alteration to medical or research records. For example, a medical professional can make a permanent notation or flag a medical record for communicating the risk assessment to other medical professionals reviewing the record. In addition, any type of communication can be used to communicate the risk assessment information. For example, mail, e-mail, telephone, and face-to-face interactions can be used. The information also can be communicated to a professional by making that information electronically available to the professional. For example, the information can be communicated to a professional by placing the information on a computer database such that the professional can access the information. In addition, the information can be communicated to a hospital, clinic, or research facility serving as an agent for the professional.

Results of these tests, and optionally interpretive information, can be returned to the subject, the health care provider or to a third party. The results can be communicated to the tested subject, for example, with a prognosis and optionally interpretive materials that can help the subject understand the test results and prognosis; used by a health care provider, for example, to determine whether to administer a specific drug, or whether a subject should be assigned to a specific category, for example, a category associated with a specific disease endophenotype, or with drug response or non-response; used by a third party such as a healthcare payer, for example, an insurance company or HMO, or other agency, to determine whether or not to reimburse a health care provider for services to the subject, or whether to approve the provision of services to the subject. For example, the healthcare payer can decide to reimburse a health care provider for treatments for PML if the subject has PML or has an increased risk of developing PML.

Also provided herein are databases that include a list of genetic variations as described herein, and wherein the list can be largely or entirely limited to genetic variations identified as useful for screening PML as described herein. The list can be stored, for example, on a flat file or computer-readable medium. The databases can further include information regarding one or more subjects, for example, whether a subject is affected or unaffected, clinical information such as endophenotype, age of onset of symptoms, any treatments administered and outcomes, for example, data relevant to pharmacogenomics, diagnostics, prognostics or theranostics, and other details, for example, data about the disorder in the subject, or environmental (e.g., including, but not limited to, infection or a history of infection with HIV or JCV) or other genetic factors. The databases can be used to detect correlations between a particular haplotype and the information regarding the subject.

The methods described herein can also include the generation of reports for use, for example, by a subject, care giver, or researcher, that include information regarding a subject's genetic variations, and optionally further information such as treatments administered, treatment history, medical history, predicted response, and actual response. The reports can be recorded in a tangible medium, e.g., a computer-readable disk, a solid state memory device, or an optical storage device.

Methods of Screening Using Variations in RNA and/or Polypeptides

In some embodiments of the disclosure, screening of PML can be made by examining or comparing changes in expression, localization, binding partners, and composition of a polypeptide encoded by a nucleic acid variant associated with PML, for example, in those instances where the genetic variations of the present disclosure results in a change in the composition or expression of the polypeptide and/or RNA, for example, mRNAs, microRNAs (miRNAs), and other noncoding RNAs (ncRNAs). Thus, screening of PML can be made by examining expression and/or composition of one of these polypeptides and/or RNA, or another polypeptide and/or RNA encoded by a nucleic acid associated with PML, in those instances where the genetic variation of the present disclosure results in a change in the expression, localization, binding partners, and/or composition of the polypeptide and/or RNA. In some embodiments, screening can comprise diagnosing a subject. In some embodiments, screening can comprise determining a prognosis of a subject, for example determining the susceptibility of developing PML. In some embodiments, screening can comprise theranosing a subject.

The genetic variations described herein that show association to PML can play a role through their effect on one or more of these genes, either by directly impacting one or more genes or influencing the expression of one or more nearby genes. For example, while not intending to be limited by theory, it is generally expected that a deletion of a chromosomal segment comprising a particular gene, or a fragment of a gene, can either result in an altered composition or expression, or both, of the encoded polypeptide and/or mRNA. Likewise, duplications, or high number copy number variations, are in general expected to result in increased expression of encoded polypeptide and/or RNA if the gene they are expressed from is fully encompassed within the duplicated (or triplicated, or even higher copy number gains) genomic segment, or conversely can result in decreased expression or a disrupted RNA or polypeptide if one or both breakpoints of the copy number gain disrupt a given gene. Other possible mechanisms affecting genes within a genetic variation region include, for example, effects on transcription, effects on RNA splicing, alterations in relative amounts of alternative splice forms of mRNA, effects on RNA stability, effects on transport from the nucleus to cytoplasm, and effects on the efficiency and accuracy of translation. Thus, DNA variations can be detected directly, using the subjects unamplified or amplified genomic DNA, or indirectly, using RNA or DNA obtained from the subject's tissue(s) that are present in an aberrant form or expression level as a result of the genetic variations of the disclosure showing association to PML. In another embodiment, DNA variations can be detected indirectly using a polypeptide or protein obtained from the subject's tissue(s) that is present in an aberrant form or expression level as a result of genetic variations of the disclosure showing association to the PML. In another embodiment, an aberrant form or expression level of a polypeptide or protein that results from one or more genetic variations of the disclosure showing association to PML can be detected indirectly via another polypeptide or protein present in the same biological/cellular pathway that is modulated or interacts with said polypeptide or protein that results from one or more genetic variations of the disclosure. In some embodiments, the genetic variations of the disclosure showing association to PML can affect the expression of a gene within the genetic variation region. In some embodiments, a genetic variation affecting an exonic region of a gene can affect, disrupt, or modulate the expression of the gene. In some embodiments, a genetic variation affecting an intronic or intergenic region of a gene can affect, disrupt, or modulate the expression of the gene.

Certain genetic variation regions can have flanking duplicated segments, and genes within such segments can have altered expression and/or composition as a result of such genomic alterations. Regulatory elements affecting gene expression can be located far away, even as far as tens or hundreds of kilobases away, from the gene that is regulated by said regulatory elements. Thus, in some embodiments, regulatory elements for genes that are located outside the gene (e.g., upstream or downstream of the gene) can be located within the genetic variation, and thus be affected by the genetic variation. It is thus contemplated that the detection of the genetic variations described herein, can be used for assessing expression for one or more of associated genes not directly impacted by the genetic variations. In some embodiments, a genetic variation affecting an intergenic region of a gene can affect, disrupt, or modulate the expression of a gene located elsewhere in the genome, such as described above. For example, a genetic variation affecting an intergenic region of a gene can affect, disrupt, or modulate the expression of a transcription factor, located elsewhere in the genome, which regulates the gene. Regulatory elements can also be located within a gene, such as within intronic regions, and similarly impact the expression level of the gene and ultimately the protein expression level without changing the structure of the protein. The effects of genetic variants on regulatory elements can manifest in a tissue-specific manner; for example, one or more transcription factors that bind to the regulatory element that is impacted by one or more genetic variations may be expressed at higher concentration in neurons as compared to skin cells (i.e., the impact of the one or more genetic variations may be primarily evident in neuronal cells).

In some embodiments, genetic variations of the disclosure showing association to PML can affect protein expression at the translational level. It can be appreciated by those skilled in the art that this can occur by increased or decreased expression of one or more microRNAs (miRNAs) that regulates expression of a protein known to be important, or implicated, in the cause, onset, or progression of PML. Increased or decreased expression of the one or more miRNAs can result from gain or loss of the whole miRNA gene, disruption or impairment of a portion of the gene (e.g., by an indel or CNV), or even a single base change (SNP or SNV) that produces an altered, non-functional or aberrant functioning miRNA sequence. It can also be appreciated by those skilled in the art that the expression of protein, for example, one known to cause PML by increased or decreased expression, can result due to a genetic variation that results in alteration of an existing miRNA binding site within the polypeptide's mRNA transcript, or even creates a new miRNA binding site that leads to aberrant polypeptide expression.

A variety of methods can be used for detecting polypeptide composition and/or expression levels, including but not limited to enzyme linked immunosorbent assays (ELISA), Western blots, spectroscopy, mass spectrometry, peptide arrays, colorimetry, electrophoresis, isoelectric focusing, immunoprecipitations, immunoassays, and immunofluorescence and other methods well-known in the art. A test nucleic acid sample from a subject can be assessed for the presence of an alteration in the expression and/or an alteration in composition of the polypeptide encoded by a nucleic acid associated with PML. An "alteration" in the polypeptide expression or composition, as used herein, refers to an alteration in expression or composition in a test nucleic acid sample, as compared to the expression or composition of the polypeptide in a control nucleic acid sample. Such alteration can, for example, be an alteration in the quantitative polypeptide expression or can be an alteration in the qualitative polypeptide expression, for example, expression of a mutant polypeptide or of a different splicing variant, or a combination thereof. In some embodiments, screening of PML can be made by detecting a particular splicing variant encoded by a nucleic acid associated with PML, or a particular pattern of splicing variants.

Antibodies can be polyclonal or monoclonal and can be labeled or unlabeled. An intact antibody or a fragment thereof can be used. The term "labeled", with regard to the probe or antibody, is intended to encompass direct labeling of the probe or antibody by coupling a detectable substance to the probe or antibody, as well as indirect labeling of the probe or antibody by reactivity with another reagent that is directly labeled as previously described herein. Other non-limiting examples of indirect labeling include detection of a primary antibody using a labeled secondary antibody, for example, a fluorescently-labeled secondary antibody and end-labeling of a DNA probe with biotin such that it can be detected with fluorescently-labeled streptavidin.

Methods of Detecting Genetic Variations

In some embodiments, standard techniques for genotyping for the presence genetic variations, for example, amplification, can be used. Amplification of nucleic acids can be accomplished using methods known in the art. Generally, sequence information from the region of interest can be used to design oligonucleotide primers that can be identical or similar in sequence to opposite strands of a template to be amplified. In some embodiments, amplification methods can include but are not limited to, fluorescence-based techniques utilizing PCR, for example, ligase chain reaction (LCR), Nested PCR, transcription amplification, self-sustained sequence replication, nucleic acid based sequence amplification (NASBA), and multiplex ligation-dependent probe amplification (MLPA). Guidelines for selecting primers for PCR amplification are well known in the art. In some embodiments, a computer program can be used to design primers, for example, Oligo (National Biosciences, Inc, Plymouth Minn.), MacVector (Kodak/IBI), and GCG suite of sequence analysis programs.

In some embodiments, commercial methodologies available for genotyping, for example, SNP genotyping, can be used, but are not limited to, TaqMan genotyping assays (Applied Biosystems), SNPlex platforms (Applied Biosystems), gel electrophoresis, capillary electrophoresis, size exclusion chromatography, mass spectrometry, for example, MassARRAY system (Sequenom), minisequencing methods, real-time Polymerase Chain Reaction (PCR), Bio-Plex system (BioRad), CEQ and SNPstream systems (Beckman), array hybridization technology, for example, Affymetrix GeneChip (Perlegen), BeadArray Technologies, for example, Illumina GoldenGate and Infinium assays, array tag technology, Multiplex Ligation-dependent Probe Amplification (MLPA), and endonuclease-based fluorescence hybridization technology (Invader assay, either using unamplified or amplified genomic DNA, or unamplified total RNA, or unamplified or amplified cDNA; Third Wave/Hologic). PCR can be a procedure in which target nucleic acid is amplified in a manner similar to that described in U.S. Pat. No. 4,683,195 and subsequent modifications of the procedure described therein. PCR can include a three phase temperature cycle of denaturation of DNA into single strands, annealing of primers to the denatured strands, and extension of the primers by a thermostable DNA polymerase enzyme. This cycle can be repeated so that there are enough copies to be detected and analyzed. In some embodiments, real-time quantitative PCR can be used to determine genetic variations, wherein quantitative PCR can permit both detection and quantification of a DNA sequence in a nucleic acid sample, for example, as an absolute number of copies or as a relative amount when normalized to DNA input or other normalizing genes. In some embodiments, methods of quantification can include the use of fluorescent dyes that can intercalate with double-stranded DNA, and modified DNA oligonucleotide probes that can fluoresce when hybridized with a complementary DNA.

In some embodiments of the disclosure, a nucleic acid sample obtained from the subject can be collected and PCR can used to amplify a fragment of nucleic acid that comprises one or more genetic variations that can be indicative of a susceptibility to PML. In some embodiments, detection of genetic variations can be accomplished by expression analysis, for example, by using quantitative PCR. In some embodiments, this technique can assess the presence or absence of a genetic alteration in the expression or composition of one or more polypeptides or splicing variants encoded by a nucleic acid associated with PML.

In some embodiments, the nucleic acid sample from a subject containing a SNP can be amplified by PCR prior to detection with a probe. In such an embodiment, the amplified DNA serves as the template for a detection probe and, in some embodiments, an enhancer probe. Certain embodiments of the detection probe, the enhancer probe, and/or the primers used for amplification of the template by PCR can comprise the use of modified bases, for example, modified A, T, C, G, and U, wherein the use of modified bases can be useful for adjusting the melting temperature of the nucleotide probe and/or primer to the template DNA, In some embodiments, modified bases are used in the design of the detection nucleotide probe. Any modified base known to the skilled person can be selected in these methods, and the selection of suitable bases is well within the scope of the skilled person based on the teachings herein and known bases available from commercial sources as known to the skilled person.

In some embodiments, identification of genetic variations can be accomplished using hybridization methods. The presence of a specific marker allele or a particular genomic segment comprising a genetic variation, or representative of a genetic variation, can be indicated by sequence-specific hybridization of a nucleic acid probe specific for the particular allele or the genetic variation in a nucleic acid sample that has or has not been amplified but methods described herein. The presence of more than one specific marker allele or several genetic variations can be indicated by using two or more sequence-specific nucleic acid probes, wherein each is specific for a particular allele and/or genetic variation.

Hybridization can be performed by methods well known to the person skilled in the art, for example, hybridization techniques such as fluorescent in situ hybridization (FISH), Southern analysis, Northern analysis, or in situ hybridization. In some embodiments, hybridization refers to specific hybridization, wherein hybridization can be performed with no mismatches. Specific hybridization, if present, can be using standard methods. In some embodiments, if specific hybridization occurs between a nucleic acid probe and the nucleic acid in the nucleic acid sample, the nucleic acid sample can contain a sequence that can be complementary to a nucleotide present in the nucleic acid probe. In some embodiments, if a nucleic acid probe can contain a particular allele of a polymorphic marker, or particular alleles for a plurality of markers, specific hybridization is indicative of the nucleic acid being completely complementary to the nucleic acid probe, including the particular alleles at polymorphic markers within the probe. In some embodiments a probe can contain more than one marker alleles of a particular haplotype, for example, a probe can contain alleles complementary to 2, 3, 4, 5 or all of the markers that make up a particular haplotype. In some embodiments detection of one or more particular markers of the haplotype in the nucleic acid sample is indicative that the source of the nucleic acid sample has the particular haplotype.

In some embodiments, PCR conditions and primers can be developed that amplify a product only when the variant allele is present or only when the wild type allele is present, for example, allele-specific PCR. In some embodiments of allele-specific PCR, a method utilizing a detection oligonucleotide probe comprising a fluorescent moiety or group at its 3' terminus and a quencher at its 5' terminus, and an enhancer oligonucleotide, can be employed (see e.g., Kutyavin et al., Nucleic Acid Res. 34:e128 (2006)).

An allele-specific primer/probe can be an oligonucleotide that is specific for particular a polymorphism can be prepared using standard methods. In some embodiments, allele-specific oligonucleotide probes can specifically hybridize to a nucleic acid region that contains a genetic variation. In some embodiments, hybridization conditions can be selected such that a nucleic acid probe can specifically bind to the sequence of interest, for example, the variant nucleic acid sequence.

In some embodiments, allele-specific restriction digest analysis can be used to detect the existence of a polymorphic variant of a polymorphism, if alternate polymorphic variants of the polymorphism can result in the creation or elimination of a restriction site. Allele-specific restriction digests can be performed, for example, with the particular restriction enzyme that can differentiate the alleles. In some embodiments, PCR can be used to amplify a region comprising the polymorphic site, and restriction fragment length polymorphism analysis can be conducted. In some embodiments, for sequence variants that do not alter a common restriction site, mutagenic primers can be designed that can introduce one or more restriction sites when the variant allele is present or when the wild type allele is present.

In some embodiments, fluorescence polarization template-directed dye-terminator incorporation (FP-TDI) can be used to determine which of multiple polymorphic variants of a polymorphism can be present in a subject. Unlike the use of allele-specific probes or primers, this method can employ primers that can terminate adjacent to a polymorphic site, so that extension of the primer by a single nucleotide can result in incorporation of a nucleotide complementary to the polymorphic variant at the polymorphic site.

In some embodiments, DNA containing an amplified portion can be dot-blotted, using standard methods and the blot contacted with the oligonucleotide probe. The presence of specific hybridization of the probe to the DNA can then be detected. The methods can include determining the genotype of a subject with respect to both copies of the polymorphic site present in the genome, wherein if multiple polymorphic variants exist at a site, this can be appropriately indicated by specifying which variants are present in a subject. Any of the detection means described herein can be used to determine the genotype of a subject with respect to one or both copies of the polymorphism present in the subject's genome.

In some embodiments, a peptide nucleic acid (PNA) probe can be used in addition to, or instead of, a nucleic acid probe in the methods described herein. A PNA can be a DNA mimic having a peptide-like, inorganic backbone, for example, N-(2-aminoethyl) glycine units with an organic base (A, G, C, T or U) attached to the glycine nitrogen via a methylene carbonyl linker.

Nucleic acid sequence analysis can also be used to detect genetic variations, for example, genetic variations can be detected by sequencing exons, introns, 5' untranslated sequences, or 3' untranslated sequences. One or more methods of nucleic acid analysis that are available to those skilled in the art can be used to detect genetic variations, including but not limited to, direct manual sequencing, automated fluorescent sequencing, single-stranded conformation polymorphism assays (SSCP); clamped denaturing gel electrophoresis (CDGE); denaturing gradient gel electrophoresis (DGGE), two-dimensional gel electrophoresis (2DGE or TDGE); conformational sensitive gel electrophoresis (CSGE); denaturing high performance liquid chromatography (DHPLC), infrared matrix-assisted laser desorption/ionization (IR-MALDI) mass spectrometry, mobility shift analysis, quantitative real-time PCR, restriction enzyme analysis, heteroduplex analysis; chemical mismatch cleavage (CMC), RNase protection assays, use of polypeptides that recognize nucleotide mismatches, allele-specific PCR, real-time pyrophosphate DNA sequencing, PCR amplification in combination with denaturing high performance liquid chromatography (dHPLC), and combinations of such methods.

Sequencing can be accomplished through classic Sanger sequencing methods, which are known in the art. In some embodiments sequencing can be performed using high-throughput sequencing methods some of which allow detection of a sequenced nucleotide immediately after or upon its incorporation into a growing strand, for example, detection of sequence in substantially real time or real time. In some cases, high throughput sequencing generates at least 1,000, at least 5,000, at least 10,000, at least 20,000, at least 30,000, at least 40,000, at least 50,000, at least 100,000 or at least 500,000 sequence reads per hour; with each read being at least 50, at least 60, at least 70, at least 80, at least 90, at least 100, at least 120 or at least 150 bases per read (or 500-1,000 bases per read for 454).

High-throughput sequencing methods can include but are not limited to, Massively Parallel Signature Sequencing (MPSS, Lynx Therapeutics), Polony sequencing, 454 pyrosequencing, Illumina (Solexa) sequencing, Illumina (Solexa) sequencing using 10× Genomics library preparation, SOLiD sequencing, on semiconductor sequencing, DNA nanoball sequencing, Helioscope™ single molecule sequencing, Single Molecule SMRT™ sequencing, Single Molecule real time (RNAP) sequencing, Nanopore DNA sequencing, and/or sequencing by hybridization, for example, a non-enzymatic method that uses a DNA microarray, or microfluidic Sanger sequencing.

In some embodiments, high-throughput sequencing can involve the use of technology available by Helicos BioSciences Corporation (Cambridge, Mass.) such as the Single Molecule Sequencing by Synthesis (SMSS) method. SMSS is unique because it allows for sequencing the entire human genome in up to 24 hours. This fast sequencing method also allows for detection of a SNP/nucleotide in a sequence in substantially real time or real time. Finally, SMSS is powerful because, like the MIP technology, it does not use a pre-amplification step prior to hybridization. SMSS does not use any amplification. SMSS is described in US Publication Application Nos. 20060024711; 20060024678; 20060012793; 20060012784; and 20050100932. In some embodiments, high-throughput sequencing involves the use of technology available by 454 Life Sciences, Inc. (a Roche company, Branford, Conn.) such as the PicoTiterPlate device which includes a fiber optic plate that transmits chemiluminescent signal generated by the sequencing reaction to be recorded by a CCD camera in the instrument. This use of fiber optics allows for the detection of a minimum of 20 million base pairs in 4.5 hours.

In some embodiments, PCR-amplified single-strand nucleic acid can be hybridized to a primer and incubated with a polymerase, ATP sulfurylase, luciferase, apyrase, and the substrates luciferin and adenosine 5' phosphosulfate. Next, deoxynucleotide triphosphates corresponding to the bases A, C, G, and T (U) can be added sequentially. A base incorporation can be accompanied by release of pyrophosphate, which can be converted to ATP by sulfurylase, which can drive synthesis of oxyluciferin and the release of visible light. Since pyrophosphate release can be equimolar with the number of incorporated bases, the light given off can be proportional to the number of nucleotides adding in any one step. The process can repeat until the entire sequence can be determined. In some embodiments, pyrosequencing can be utilized to analyze amplicons to determine whether breakpoints are present. In some embodiments, pyrosequencing can map surrounding sequences as an internal quality control.

Pyrosequencing analysis methods are known in the art. Sequence analysis can include a four-color sequencing by ligation scheme (degenerate ligation), which involves hybridizing an anchor primer to one of four positions. Then an enzymatic ligation reaction of the anchor primer to a population of degenerate nonamers that are labeled with fluorescent dyes can be performed. At any given cycle, the population of nonamers that is used can be structured such that the identity of one of its positions can be correlated with the identity of the fluorophore attached to that nonamer. To the extent that the ligase discriminates for complementarily at that queried position, the fluorescent signal can allow the inference of the identity of the base. After performing the ligation and four-color imaging, the anchor primer: nonamer complexes can be stripped and a new cycle begins. Methods to image sequence information after performing ligation are known in the art.

In some embodiments, analysis by restriction enzyme digestion can be used to detect a particular genetic variation if the genetic variation results in creation or elimination of one or more restriction sites relative to a reference sequence. In some embodiments, restriction fragment length polymorphism (RFLP) analysis can be conducted, wherein the digestion pattern of the relevant DNA fragment indicates the presence or absence of the particular genetic variation in the nucleic acid sample.

In some embodiments, arrays of oligonucleotide probes that can be complementary to target nucleic acid sequence segments from a subject can be used to identify genetic variations. In some embodiments, an array of oligonucleotide probes comprises an oligonucleotide array, for example, a microarray. In some embodiments, the present disclosure features arrays that include a substrate having a plurality of addressable areas, and methods of using them. At least one area of the plurality includes a nucleic acid probe that binds specifically to a sequence comprising a genetic variation, and can be used to detect the absence or presence of the genetic variation, for example, one or more SNPs, microsatellites, or CNVs, as described herein, to determine or identify an allele or genotype. For example, the array can include one or more nucleic acid probes that can be used to detect a genetic variation associated with a gene and/or gene product. In some embodiments, the array can further comprise at least one area that includes a nucleic acid probe that can be used to specifically detect another marker associated with PML as described herein.

Microarray hybridization can be performed by hybridizing a nucleic acid of interest, for example, a nucleic acid encompassing a genetic variation, with the array and detecting hybridization using nucleic acid probes. In some embodiments, the nucleic acid of interest is amplified prior to hybridization. Hybridization and detecting can be carried out according to standard methods described in Published PCT Applications: WO 92/10092 and WO 95/11995, and U.S. Pat. No. 5,424,186. For example, an array can be scanned to determine the position on the array to which the nucleic acid hybridizes. The hybridization data obtained from the scan can be, for example, in the form of fluorescence intensities as a function of location on the array.

Arrays can be formed on substrates fabricated with materials such as paper; glass; plastic, for example, polypropylene, nylon, or polystyrene; polyacrylamide; nitrocellulose; silicon; optical fiber; or any other suitable solid or semisolid support; and can be configured in a planar, for example, glass plates or silicon chips); or three dimensional, for example, pins, fibers, beads, particles, microtiter wells, and capillaries, configuration.

Methods for generating arrays are known in the art and can include for example; photolithographic methods (U.S. Pat. Nos. 5,143,854, 5,510,270 and 5,527,681); mechanical methods, for example, directed-flow methods (U.S. Pat. No. 5,384,261); pin-based methods (U.S. Pat. No. 5,288,514); bead-based techniques (PCT US/93/04145); solid phase oligonucleotide synthesis methods; or by other methods known to a person skilled in the art (see, e.g., Bier, F. F., et al., Adv Biochem Eng Biotechnol 109:433-53 (2008); Hoheisel, J. D., Nat Rev Genet 7: 200-10 (2006); Fan, J. B., et al., Methods Enzymol 410:57-73 (2006); Raqoussis, J. & Elvidge, G., Expert Rev Mol Design 6: 145-52 (2006); Mockler, T. C., et al., Genomics 85: 1-15 (2005), and references cited therein, the entire teachings of each of which are incorporated by reference herein). Many additional descriptions of the preparation and use of oligonucleotide arrays for detection of polymorphisms can be found, for example, in U.S. Pat. Nos. 6,858,394, 6,429,027, 5,445, 934, 5,700,637, 5,744,305, 5,945,334, 6,054,270, 6,300,063, 6,733,977, 7,364,858, EP 619 321, and EP 373 203, the entire teachings of which are incorporated by reference herein. Methods for array production, hybridization, and analysis are also described in Snijders et al., Nat. Genetics 29:263-264 (2001); Klein et al., Proc. Natl. Acad. Sci. USA 96:4494-4499 (1999); Albertson et al., Breast Cancer Research and Treatment 78:289-298 (2003); and Snijders et al., "BAC microarray based comparative genomic hybridization," in: Zhao et al., (eds), Bacterial Artificial Chromosomes: Methods and Protocols, Methods in Molecular Biology, Humana Press (2002).

In some embodiments, oligonucleotide probes forming an array can be attached to a substrate by any number of techniques, including, but not limited to, in situ synthesis, for example, high-density oligonucleotide arrays, using photolithographic techniques; spotting/printing a medium to low density on glass, nylon, or nitrocellulose; by masking; and by dot-blotting on a nylon or nitrocellulose hybridization membrane. In some embodiments, oligonucleotides can be immobilized via a linker, including but not limited to, by covalent, ionic, or physical linkage. Linkers for immobilizing nucleic acids and polypeptides, including reversible or cleavable linkers, are known in the art (U.S. Pat. No. 5,451,683 and WO98/20019). In some embodiments, oligonucleotides can be non-covalently immobilized on a substrate by hybridization to anchors, by means of magnetic beads, or in a fluid phase, for example, in wells or capillaries.

An array can comprise oligonucleotide hybridization probes capable of specifically hybridizing to different genetic variations. In some embodiments, oligonucleotide arrays can comprise a plurality of different oligonucleotide probes coupled to a surface of a substrate in different known locations. In some embodiments, oligonucleotide probes can exhibit differential or selective binding to polymorphic sites, and can be readily designed by one of ordinary skill in the art, for example, an oligonucleotide that is perfectly complementary to a sequence that encompasses a polymorphic site, for example, a sequence that includes the polymorphic site, within it, or at one end, can hybridize preferentially to a nucleic acid comprising that sequence, as opposed to a nucleic acid comprising an alternate polymorphic variant.

In some embodiments, arrays can include multiple detection blocks, for example, multiple groups of probes designed for detection of particular polymorphisms. In some embodiments, these arrays can be used to analyze multiple different polymorphisms. In some embodiments, detection blocks can be grouped within a single array or in multiple, separate arrays, wherein varying conditions, for example, conditions optimized for particular polymorphisms, can be used during hybridization. General descriptions of using oligonucleotide arrays for detection of polymorphisms can be found, for example, in U.S. Pat. Nos. 5,858,659 and 5,837,832. In addition to oligonucleotide arrays, cDNA arrays can be used similarly in certain embodiments.

The methods described herein can include but are not limited to providing an array as described herein; contacting the array with a nucleic acid sample, and detecting binding of a nucleic acid from the nucleic acid sample to the array. In some embodiments, the method can comprise amplifying nucleic acid from the nucleic acid sample, for example, a region associated with PML or a region that includes another region associated with PML. In some embodiments, the methods described herein can include using an array that can identify differential expression patterns or copy numbers of one or more genes in nucleic acid samples from control and affected individuals. For example, arrays of probes to a marker described herein can be used to identify genetic variations between DNA from an affected subject, and control DNA obtained from an individual that does not have PML. Since the nucleotides on the array can contain sequence tags, their positions on the array can be accurately known relative to the genomic sequence.

In some embodiments, it can be desirable to employ methods that can detect the presence of multiple genetic variations, for example, polymorphic variants at a plurality of polymorphic sites, in parallel or substantially simultaneously. In some embodiments, these methods can comprise oligonucleotide arrays and other methods, including methods in which reactions, for example, amplification and hybridization, can be performed in individual vessels, for example, within individual wells of a multi-well plate or other vessel.

Determining the identity of a genetic variation can also include or consist of reviewing a subject's medical history, where the medical history includes information regarding the identity, copy number, presence or absence of one or more alleles or SNPs in the subject, e.g., results of a genetic test.

In some embodiments extended runs of homozygosity (ROH) may be useful to map recessive disease genes in outbred populations. Furthermore, even in complex disorders, a high number of affected individuals may have the same haplotype in the region surrounding a disease mutation. Therefore, a rare pathogenic variant and surrounding haplotype can be enriched in frequency in a group of affected individuals compared with the haplotype frequency in a cohort of unaffected controls. Homozygous haplotypes (HH) that are shared by multiple affected individuals can be important for the discovery of recessive disease genes in a condition such as PML. In some embodiments, the traditional homozygosity mapping method can be extended by analyzing the haplotype within shared ROH regions to identify homozygous segments of identical haplotype that are present uniquely or at a higher frequency in PML probands compared to parental controls. Such regions are termed risk homozygous haplotypes (rHH), which may contain low-frequency recessive variants that contribute to PML risk in a subset of PML patients.

Genetic variations can also be identified using any of a number of methods well known in the art. For example, genetic variations available in public databases, which can be searched using methods and custom algorithms or algorithms known in the art, can be used. In some embodiments, a reference sequence can be from, for example, the human draft genome sequence, publicly available in various databases, or a sequence deposited in a database such as GenBank.

A comparison of one or more genomes relative to one or more other genomes with array CGH, or a variety of other genetic variation detection methods, can reveal the set of genetic variations between two genomes, between one genome in comparison to multiple genomes, or between one set of genomes in comparison to another set of genomes. In some embodiments, an array CGH experiment can be performed by hybridizing a single test genome against a pooled nucleic acid sample of two or more genomes, which can result in minimizing the detection of higher frequency variants in the experiment. In some embodiments, a test genome can be hybridized alone (i.e., one-color detection) to a microarray, for example, using array CGH or SNP genotyping methods, and the comparison step to one or more reference genomes can be performed in silico to reveal the set of genetic variations in the test genome relative to the one or more reference genomes. In one embodiment, a single test genome is compared to a single reference genome in a 2-color experiment wherein both genomes are cohybridized to the microarray. In some embodiments, the whole genome or whole exome from one or more subjects is analyzed. In some embodiments, nucleic acid information has already been obtained for the whole genome or whole exome from one or more individuals and the nucleic acid information is obtained from in silico analysis.

Any of the polynucleotides described, including polynucleotides comprising a genetic variation, can be made synthetically using methods known in the art.

Methods of Detecting CNVs

Detection of genetic variations, specifically CNVs, can be accomplished by one or more suitable techniques described herein. Generally, techniques that can selectively determine whether a particular chromosomal segment is present or absent in an individual can be used for genotyping CNVs. Identification of novel copy number variations can be done by methods for assessing genomic copy number changes.

In some embodiments, methods include but are not limited to, methods that can quantitatively estimate the number of copies of a particular genomic segment, but can also include methods that indicate whether a particular segment is present in a nucleic acid sample or not. In some embodiments, the technique to be used can quantify the amount of segment present, for example, determining whether a DNA segment is deleted, duplicated, or triplicated in subject, for example, Fluorescent In Situ Hybridization (FISH) techniques, and other methods described herein. In some embodiments, methods include detection of copy number variation from array intensity and sequencing read depth using a stepwise Bayesian model (Zhang, et al., BMC Bioinformatics, 11:539 (2010)). In some embodiments, methods include detecting copy number variations using shotgun sequencing, CNV-seq (Xie C., et al., BMC Bioinformatics, 10:80 (2009)). In some embodiments, methods include analyzing next-generation sequencing (NGS) data for CNV detection using any one of several algorithms developed for each of the four broad methods for CNV detection using NGS, namely the depth of coverage (DOC), read-pair (RP), split-read (SR) and assembly-based (AS) methods. (Teo et al., Bioinformatics (2012)). In some embodiments, methods include combining coverage with map information for the identification of deletions and duplications in targeted sequence data (Nord et al., BMC Genomics, 12:184 (2011)).

In some embodiments, other genotyping technologies can be used for detection of CNVs, including but not limited to, karyotype analysis, Molecular Inversion Probe array technology, for example, Affymetrix SNP Array 6.0, and BeadArray Technologies, for example, Illumina GoldenGate and Infinium assays, as can other platforms such as NimbleGen HD2.1 or HD4.2, High-Definition Comparative Genomic Hybridization (CGH) arrays (Agilent Technologies), tiling array technology (Affymetrix), multiplex ligation-dependent probe amplification (MLPA), Invader assay, fluorescence in situ hybridization, and, in one embodiment, Array Comparative Genomic Hybridization (aCGH) methods. As described herein, karyotype analysis can be a method to determine the content and structure of chromosomes in a nucleic acid sample. In some embodiments, karyotyping can be used, in lieu of aCGH, to detect translocations or inversions, which can be copy number neutral, and, therefore, not detectable by aCGH. Information about amplitude of particular probes, which can be representative of particular alleles, can provide quantitative dosage information for the particular allele, and by consequence, dosage information about the CNV in question, since the marker can be selected as a marker representative of the CNV and can be located within the CNV. In some embodiments, if the CNV is a deletion, the absence of particular marker allele is representative of the deletion. In some embodiments, if the CNV is a duplication or a higher order copy number variation, the signal intensity representative of the allele correlating with the CNV can represent the copy number. A summary of methodologies commonly used is provided in Perkel (Perkel J. Nature Methods 5:447-453 (2008)).

PCR assays can be utilized to detect CNVs and can provide an alternative to array analysis. In particular, PCR assays can enable detection of precise boundaries of gene/chromosome variants, at the molecular level, and which boundaries are identical in different individuals. PCR assays can be based on the amplification of a junction fragment present only in individuals that carry a deletion. This assay can convert the detection of a loss by array CGH to one of a gain by PCR.

Examples of PCR techniques that can be used in the present disclosure include, but are not limited to quantitative PCR, real-time quantitative PCR (qPCR), quantitative fluorescent PCR (QF-PCR), multiplex fluorescent PCR (MF-PCR), real time PCR (RT-PCR), single cell PCR, PCR-RFLP/RT-PCR-RFLP, hot start PCR and Nested PCR. Other suitable amplification methods include the ligase chain reaction (LCR), ligation mediated PCR (LM-PCR), degenerate oligonucleotide probe PCR (DOP-PCR), transcription amplification, self-sustained sequence replication, selective amplification of target polynucleotide sequences, consensus sequence primed polymerase chain reaction (CP-PCR), arbitrarily primed polymerase chain reaction (AP-PCR) and nucleic acid sequence based amplification (NASBA).

Alternative methods for the simultaneous interrogation of multiple regions include quantitative multiplex PCR of short fluorescent fragments (QMPSF), multiplex amplifiable probe hybridization (MAPH) and multiplex ligation-dependent probe amplification (MLPA), in which copy-number differences for up to 40 regions can be scored in one experiment. Another approach can be to specifically target regions that harbor known segmental duplications, which are often sites of copy-number variation. By targeting the variable nucleotides between two copies of a segmental duplication (called paralogous sequence variants) using a SNP-genotyping method that provides independent fluorescence intensities for the two alleles, it is possible to detect an increase in intensity of one allele compared with the other.

In some embodiments, the amplified piece of DNA can be bound to beads using the sequencing element of the nucleic acid tag under conditions that favor a single amplified piece of DNA molecule to bind a different bead and amplification occurs on each bead. In some embodiments, such amplification can occur by PCR. Each bead can be placed in a separate well, which can be a picoliter-sized well. In some embodiments, each bead is captured within a droplet of a PCR-reaction-mixture-in-oil-emulsion and PCR amplification occurs within each droplet. The amplification on the bead results in each bead carrying at least one million, at least 5 million, or at least 10 million copies of the single amplified piece of DNA molecule.

In embodiments where PCR occurs in oil-emulsion mixtures, the emulsion droplets are broken, the DNA is denatured and the beads carrying single-stranded nucleic acids clones are deposited into a well, such as a picoliter-sized well, for further analysis according to the methods described herein. These amplification methods allow for the analysis of genomic DNA regions. Methods for using bead amplification followed by fiber optics detection are described in Margulies et al., Nature, 15; 437(7057):376-80 (2005), and as well as in US Publication Application Nos. 20020012930; 20030068629; 20030100102; 20030148344; 20040248161; 20050079510, 20050124022; and 20060078909.

Another variation on the array-based approach can be to use the hybridization signal intensities that are obtained from the oligonucleotides employed on Affymetrix SNP arrays or in Illumina Bead Arrays. Here hybridization intensities are compared with average values that are derived from controls, such that deviations from these averages indicate a change in copy number. As well as providing information about copy number, SNP arrays have the added advantage of providing genotype information. For example, they can reveal loss of heterozygosity, which could provide supporting evidence for the presence of a deletion, or might indicate segmental uniparental disomy (which can recapitulate the effects of structural variation in some genomic regions—Prader-Willi and Angelman syndromes, for example).

Many of the basic procedures followed in microarray-based genome profiling are similar, if not identical, to those followed in expression profiling and SNP analysis, including the use of specialized microarray equipment and data-analysis tools. Since microarray-based expression profiling has been well established in the last decade, much can be learned from the technical advances made in this area. Examples of the use of microarrays in nucleic acid analysis that can be used are described in U.S. Pat. Nos. 6,300,063, 5,837,832, 6,969,589, 6,040,138, 6,858,412, U.S. application Ser. Nos. 08/529,115, 10/272,384, 10/045,575, 10/264,571 and 10/264,574. It should be noted that there are also distinct differences such as target and probe complexity, stability of DNA over RNA, the presence of repetitive DNA and the need to identify single copy number alterations in genome profiling.

In some embodiments, the genetic variations detected comprise CNVs and can be detected using array CGH. In some embodiments, array CGH can be been implemented using a wide variety of techniques. The initial approaches used arrays produced from large-insert genomic clones such as bacterial artificial chromosomes (BACs). Producing sufficient BAC DNA of adequate purity to make arrays is arduous, so several techniques to amplify small amounts of starting material have been employed. These techniques include ligation-mediated PCR (Snijders et al., Nat. Genet. 29:263-64), degenerate primer PCR using one or several sets of primers, and rolling circle amplification. BAC arrays that provide complete genome tiling paths are also available. Arrays made from less complex nucleic acids such as cDNAs, selected PCR products, and oligonucleotides can also be used. Although most CGH procedures employ hybridization with total genomic DNA, it is possible to use reduced complexity representations of the genome produced by PCR techniques. Computational analysis of the genome sequence can be used to design array elements complementary to the sequences contained in the representation. Various SNP genotyping platforms, some of which use reduced complexity genomic representations, can be useful for their ability to determine both DNA copy number and allelic content across the genome. In some embodiments, small amounts of genomic DNA can be amplified with a variety of whole genome or whole exome amplification methods prior to CGH analysis of the nucleic acid sample. A "whole exome," as used herein, includes exons throughout the whole genome that are expressed in genes. Since exon selection has tissue and cell type specificity, these positions may be different in the various cell types resulting from a splice variant or alternative splicing. A "whole genome," as used herein, includes the entire genetic code of a genome.

The different basic approaches to array CGH provide different levels of performance, so some are more suitable for particular applications than others. The factors that determine performance include the magnitudes of the copy number changes, their genomic extents, the state and composition of the specimen, how much material is available for analysis, and how the results of the analysis can be used. Many applications use reliable detection of copy number changes of much less than 50%, a more stringent requirement than for other microarray technologies. Note that technical details are extremely important and different implementations of methods using the same array CGH approach can yield different levels of performance. Various CGH methods are known in the art and are equally applicable to one or more methods of the present disclosure. For example, CGH methods are disclosed in U.S. Pat. Nos. 7,030,231; 7,011,949; 7,014,997; 6,977,148; 6,951,761; and 6,916,621, the disclosure from each of which is incorporated by reference herein in its entirety.

The data provided by array CGH are quantitative measures of DNA sequence dosage. Array CGH provides high-resolution estimates of copy number aberrations, and can be performed efficiently on many nucleic acid samples. The advent of array CGH technology makes it possible to monitor DNA copy number changes on a genomic scale and many projects have been launched for studying the genome in specific diseases.

In some embodiments, whole genome array-based comparative genome hybridization (array CGH) analysis, or array CGH on a subset of genomic regions, can be used to efficiently interrogate human genomes for genomic imbalances at multiple loci within a single assay. The development of comparative genomic hybridization (CGH) (Kallioniemi et al., Science 258: 818-21 (1992)) provided the first efficient approach to scanning entire genomes for variations in DNA copy number. The importance of normal copy number variation involving large segments of DNA has been unappreciated. Array CGH is a breakthrough technique in human genetics, which is attracting interest from clinicians working in fields as diverse as cancer and IVF (In Vitro Fertilization). The use of CGH microarrays in the clinic holds great promise for identifying regions of genomic imbalance associated with disease. Advances from identifying chromosomal critical regions associated with specific phenotypes to identifying the specific dosage sensitive genes can lead to therapeutic opportunities of benefit to patients. Array CGH is a specific, sensitive and rapid technique that can enable the screening of the whole genome in a single test. It can facilitate and accelerate the screening process in human genetics and is expected to have a profound impact on the screening and counseling of patients with genetic disorders. It is now possible to identify the exact location on the chromosome where an aberration has occurred and it is possible to map these changes directly onto the genomic sequence.

An array CGH approach provides a robust method for carrying out a genome-wide scan to find novel copy number variants (CNVs). The array CGH methods can use labeled fragments from a genome of interest, which can be competitively hybridized with a second differentially labeled genome to arrays that are spotted with cloned DNA fragments, revealing copy-number differences between the two genomes. Genomic clones (for example, BACs), cDNAs, PCR products and oligonucleotides, can all be used as array targets. The use of array CGH with BACs was one of the earliest employed methods and is popular, owing to the extensive coverage of the genome it provides, the availability of reliable mapping data and ready access to clones. The last of these factors is important both for the array experiments themselves, and for confirmatory FISH experiments.

In a typical CGH measurement, total genomic DNA is isolated from control and reference subjects, differentially labeled, and hybridized to a representation of the genome that allows the binding of sequences at different genomic locations to be distinguished. More than two genomes can be compared simultaneously with suitable labels. Hybridization of highly repetitive sequences is typically suppressed by the inclusion of unlabeled Cot-1 DNA in the reaction. In some embodiments of array CGH, it is beneficial to mechanically shear the genomic DNA in a nucleic acid sample, for example, with sonication, prior to its labeling and hybridization step. In another embodiment, array CGH may be performed without use of Cot-1 DNA or a sonication step in the preparation of the genomic DNA in a nucleic acid sample. The relative hybridization intensity of the test and reference signals at a given location can be proportional to the relative copy number of those sequences in the test and reference genomes. If the reference genome is normal then increases and decreases in signal intensity ratios directly indicate DNA copy number variation within the genome of the test cells. Data are typically normalized so that the modal ratio for the genome is set to some standard value, typically 1.0 on a linear scale or 0.0 on a logarithmic scale. Additional measurements such as FISH or flow cytometry can be used to determine the actual copy number associated with a ratio level.

In some embodiments, an array CGH procedure can include the following steps. First, large-insert clones, for example, BACs can be obtained from a supplier of clone libraries. Then, small amounts of clone DNA can be amplified, for example, by degenerate oligonucleotide-primed (DOP) PCR or ligation-mediated PCR in order to obtain sufficient quantities needed for spotting. Next, PCR products can be spotted onto glass slides using, for example, microarray robots equipped with high-precision printing pins. Depending on the number of clones to be spotted and the space available on the microarray slide, clones can either be spotted once per array or in replicate. Repeated spotting of the same clone on an array can increase precision of the measurements if the spot intensities are averaged, and allows for a detailed statistical analysis of the quality of the experiments. Subject and control DNAs can be labeled, for example, with either Cy3 or Cy5-dUTP using random priming and can be subsequently hybridized onto the microarray in a solution containing an excess of Cotl-DNA to block repetitive sequences. Hybridizations can either be performed manually under a coverslip, in a gasket with gentle rocking or, automatically using commercially available hybridization stations. These automated hybridization stations can allow for an active hybridization process, thereby improving the reproducibility as well as reducing the actual hybridization time, which increases throughput. The hybridized DNAs can detected through the two different fluorochromes using standard microarray scanning equipment with either a scanning confocal laser or a charge coupled device (CCD) camera-based reader, followed by spot identification using commercially or freely available software packages.

The use of CGH with arrays that comprise long oligonucleotides (60-100 bp) can improve the detection resolution (in some embodiments, as small as ~3-5 kb sized CNVs on arrays designed for interrogation of human whole genomes) over that achieved using BACs (limited to 50-100 kb or larger sized CNVs due to the large size of BAC clones). In some embodiments, the resolution of oligonucleotide CGH arrays is achieved via in situ synthesis of 1-2 million unique features/probes per microarray, which can include microarrays available from Roche NimbleGen and Agilent Technologies. In addition to array CGH methods for copy number detection, other embodiments for partial or whole genome analysis of CNVs within a genome include, but are not limited to, use of SNP genotyping microarrays and sequencing methods.

Another method for copy number detection that uses oligonucleotides can be representational oligonucleotide microarray analysis (ROMA). It is similar to that applied in the use of BAC and CGH arrays, but to increase the signal-to-noise ratio, the 'complexity' of the input DNA is reduced by a method called representation or whole-genome sampling. Here the DNA that is to be hybridized to the array can be treated by restriction digestion and then ligated to adapters, which results in the PCR-based amplification of fragments in a specific size-range. As a result, the amplified DNA can make up a fraction of the entire genomic sequence—that is, it is a representation of the input DNA that has significantly reduced complexity, which can lead to a reduction in background noise. Other suitable methods available to the skilled person can also be used, and are within scope of the present disclosure.

A comparison of one or more genomes relative to one or more other genomes with array CGH, or a variety of other CNV detection methods, can reveal the set of CNVs between two genomes, between one genome in comparison to multiple genomes, or between one set of genomes in comparison to another set of genomes. In some embodiments, an array CGH experiment can be performed by hybridizing a single test genome against a pooled nucleic acid sample of two or more genomes, which can result in minimizing the detection of higher frequency variants in the experiment. In some embodiments, a test genome can be hybridized alone (i.e. one-color detection) to a microarray, for example, using array CGH or SNP genotyping methods, and the comparison step to one or more reference genomes can be performed in silico to reveal the set of CNVs in the test genome relative to the one or more reference genomes. In one preferred embodiment, a single test genome is compared to a single reference genome in a 2-color experiment wherein both genomes are cohybridized to the microarray.

Array CGH can be used to identify genes that are causative or associated with a particular phenotype, condition, or disease by comparing the set of CNVs found in the affected cohort to the set of CNVs found in an unaffected cohort. An unaffected cohort may consist of any individual unaffected by the phenotype, condition, or disease of interest, but in one preferred embodiment is comprised of individuals or subjects that are apparently healthy (normal). Methods employed for such analyses are described in U.S. Pat. Nos. 7,702,468 and 7,957,913. In some embodiments of CNV comparison methods, candidate genes that are causative or associated (i.e. potentially serving as a biomarker) with a phenotype, condition, or disease will be identified by CNVs that occur in the affected cohort but not in the unaffected cohort. In some embodiments of CNV comparison methods, candidate genes that are causative or associated (i.e. potentially serving as a biomarker) with a phenotype, condition, or disease will be identified by CNVs that occur at a statistically significant higher frequency in the affected cohort as compared their frequency in the unaffected cohort. Thus, CNVs preferentially detected in the affected cohort as compared to the unaffected cohort can serve as beacons of genes that are causative or associated with a particular phenotype, condition, or disease. Methods employed for such analyses are described in U.S. Pat. No. 8,862,410. In some embodiments, CNV detection and comparison methods can result in direct identification of the gene that is causative or associated with phenotype, condition, or disease if the CNVs are found to overlap with or encompass the gene(s). In some embodiments, CNV detection and comparison methods can result in identification of regulatory regions of the genome (e.g., promoters, enhancers, transcription factor binding sites) that regulate the expression of one or more genes that are causative or associated with the phenotype, condition, or disease of interest. In some embodiments, CNV detection and comparison methods can result in identification of a region in the genome in linkage disequilibrium with a genetic variant that is causative or associated with the phenotype, condition, or disease of interest. In another embodiment, CNV detection and comparison methods can result in identification of a region in the genome in linkage disequilibrium with a genetic variant that is protective against the condition or disease of interest.

Due to the large amount of genetic variation between any two genomes, or two sets (cohorts) of genomes, being compared, one preferred embodiment is to reduce the genetic variation search space by interrogating only CNVs, as opposed to the full set of genetic variants that can be identified in an individual's genome or exome. The set of CNVs that occur only, or at a statistically higher frequency, in the affected cohort as compared to the unaffected cohort can then be further investigated in targeted sequencing experiments to reveal the full set of genetic variants (of any size or type) that are causative or associated (i.e. potentially serving as a biomarker) with a phenotype, condition, or disease. It can be appreciated to those skilled in the art that the targeted sequencing experiments are performed in both the affected and unaffected cohorts in order to identify the genetic variants (e.g., SNVs and indels) that occur only, or at a statistically significant higher frequency, in the affected individual or cohort as compared to the unaffected cohort. Methods employed for such analyses are described in U.S. Pat. No. 8,862,410.

A method of screening a subject for a disease or disorder can comprise assaying a nucleic acid sample from the subject to detect sequence information for more than one genetic locus and comparing the sequence information to a panel of nucleic acid biomarkers and screening the subject for the presence or absence of the disease or disorder if one or more of low frequency biomarkers in the panel are present in the sequence information.

The panel can comprise at least one nucleic acid biomarker for each of the more than one genetic loci. For example, the panel can comprise 2, 3, 4, 5, 6, 7, 8, 9, 10, 15, 20, 25, 30, 35, 40, 45, 50, 75, 100, 150, 200 or more nucleic acid biomarkers for each of the more than one genetic locus. In some embodiments, the panel can comprise from about 2-1000 nucleic acid biomarkers. For example, the panel can comprise from about 2-900, 2-800, 2-700, 2-600, 2-500, 2-400, 2-300, 2-200, 2-100, 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000 nucleic acid biomarkers.

In some embodiments, a biomarker can occur at a frequency of 1% or more in a population of subjects without a diagnosis of the disease or disorder. For example, a biomarker can occur at a frequency of 10%, 9%, 8%, 7%, 6%, 5%, 4%, 3%, 2%, 1%, or more in a population of subjects without a diagnosis of the disease or disorder. In some embodiments, a biomarker can occur at a frequency from about 1%-20% in a population of subjects without a diagnosis of the disease or disorder. For example, a biomarker can occur at a frequency of from about 1%-5% or 1%-10%, in a population of subjects without a diagnosis of the disease or disorder.

The panel can comprise at least 2 low frequency biomarkers. For example, the panel can comprise at least 2, 3, 4, 5, 6, 7, 8, 9, 10, 11, 12, 3, 14, 15, 15, 17, 18, 19, 20, 25, 30, 35, 40, 45, 50, 55, 60, 65, 70, 75, 80, 85, 90, 95, 100, 125, 150, 175, 200, 250, 500, or 1000 or more low frequency biomarkers. In some embodiments, the panel can comprise from about 2-1000 low frequency biomarkers. For example, the panel can comprise from about 2-900, 2-800, 2-700, 2-600, 2-500, 2-400, 2-300, 2-200, 2-100, 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000 low frequency biomarkers.

In some embodiments, a low frequency biomarker can occur at a frequency of 1% or less in a population of subjects without a diagnosis of the disease or disorder. For example, a low frequency biomarker can occur at a frequency of 0.5%, 0.1%, 0.05%, 0.01%, 0.005%, 0.001%, 0.0005%, or 0.0001% or less in a population of subjects without a diagnosis of the disease or disorder. In some embodiments, a low frequency biomarker can occur at a frequency from about 0.0001%-0.1% in a population of subjects without a diagnosis of the disease or disorder. For example, a low frequency biomarker can occur at a frequency of from about 0.0001%-0.0005%, 0.0001%-0.001%, 0.0001%-0.005%, 0.0001%-0.01%, 0.0001%-0.05%, 0.0001%-0.1%, 0.0001%-0.5%, 0.0005%- 0.001%, 0.0005%-0.005%, 0.0005%-0.01%, 0.0005%-0.05%, 0.0005%-0.1%, 0.0005%-0.5%, 0.0005%-1%, 0.001%-0.005%, 0.001%-0.01%, 0.001%-0.05%, 0.001%-0.1%, 0.001%-0.5%, 0.001%-1%, 0.005%-0.01%, 0.005%-0.05%, 0.005%-0.1%, 0.005%-0.5%, 0.005%-1%, 0.01%-0.05%, 0.01%-0.1%, 0.01%-0.5%, 0.01%-1%, 0.05%-0.1%, 0.05%-0.5%, 0.05%-1%, 0.1%-0.5%, 0.1%-1%, or 0.5%- 1% in a population of subjects without a diagnosis of the disease or disorder. In another embodiment, genetic biomarker frequencies can range higher (e.g., 0.5% to 5%) and have utility for diagnostic testing or drug development targeting the genes that harbor such variants. Genetic variants of appreciable frequency and phenotypic effect in the general population are sometimes described as goldilocks variants (e.g., see Cohen J Clin Lipidol. 2013 May-June; 7(3 Suppl):S1-5 and Price et al. Am J Hum Genet. 2010 Jun. 11; 86(6):832-8).

In some embodiments, the presence or absence of the disease or disorder in the subject can be determined with at least 50% confidence. For example, the presence or absence of the disease or disorder in the subject can be determined with at least 50%, 55%, 60%, 65%, 70%, 75%, 80%, 85%, 90%, 95%, 98%, 99%, or 100% confidence. In some embodiments, the presence or absence of the disease or disorder in the subject can be determined with a 50%-100% confidence. For example, the presence or absence of the disease or disorder in the subject can be determined with a 60%-100%, 70%-100%, 80%-100%, 90%-100%, 50%-90%, 50%-80%, 50%-70%, 50%-60%, 60%-90%, 60%-80%, 60%-70%, 70%-90%, 70%-80%, or 80%-90%. In one embodiment, PML candidate CNVs and genes or regulatory loci associated with these CNVs can be determined or identified by comparing genetic data from a cohort of normal individuals to that of an individual or a cohort of individuals known to have, or be susceptible to PML.

In one embodiment, PML candidate CNV-subregions and genes associated with these regions can be determined or identified by comparing genetic data from a cohort of normal individuals, such as a pre-existing database of CNVs found in normal individuals termed the Normal Variation Engine (NVE), to that of a cohort of individual known to have, or be susceptible to PML.

In some embodiments, a nucleic acid sample from one individual or nucleic acid samples from a pool of 2 or more individuals without PML can serve as the reference nucleic acid sample(s) and the nucleic acid sample from an individual known to have PML or being tested to determine if they have PML can serve as the test nucleic acid sample. In one preferred embodiment, the reference and test nucleic acid samples are sex-matched and co-hybridized on the CGH array. For example, reference nucleic acid samples can be labeled with a fluorophore such as Cy5, using methods described herein, and test subject nucleic acid samples can be labeled with a different fluorophore, such as Cy3. After labeling, nucleic acid samples can be combined and can be co-hybridized to a microarray and analyzed using any of the methods described herein, such as aCGH. Arrays can then be scanned and the data can be analyzed with software. Genetic alterations, such as CNVs, can be called using any of the methods described herein. A list of the genetic alterations, such as CNVs, can be generated for one or more test subjects and/or for one or more reference subjects. Such lists of CNVs can be used to generate a master list of non-redundant CNVs and/or CNV-subregions for each type of cohort. In one embodiment, a cohort of test nucleic acid samples, such as individuals known to have or suspected to have PML, can be cohybridized with an identical sex-matched reference individual or sex-matched pool of reference individuals to generate a list of redundant or non-redundant CNVs. Such lists can be based on the presence or absence of one or more CNVs and/or CNV subregions present in individuals within the cohort. In this manner, a master list can contain a number of distinct CNVs and/or CNV-subregions, some of which are uniquely present in a single individual and some of which are present in multiple individuals.

In some embodiments, CNVs and/or CNV-subregions of interest can be obtained by annotation of each CNV and/or CNV-subregion with relevant information, such as overlap with known genes and/or exons or intergenic regulatory regions such as transcription factor binding sites. In some embodiments, CNVs and/or CNV-subregions of interest can be obtained by calculating the OR for a CNV and/or CNV-subregion according to the following formula: OR= (PML/((# individuals in PML cohort)−PML))/(NVE/((# individuals in NVE cohort)−NVE)), where: PML=number of PML individuals with a CNV−subregion of interest and NVE=number of NVE subjects with the CNV-subregion of interest. If NVE=0, it can be set to 1 to avoid dealing with infinities in cases where no CNVs are seen in the NVE. In some embodiments, a set of publicly available CNVs (e.g., the Database of Genomic Variants) can be used as the Normal cohort for comparison to the affected cohort CNVs. In another embodiment, the set of Normal cohort CNVs may comprise a private database generated by the same CNV detection method, such as array CGH, or by a plurality of CNV detection methods that include, but are not limited to, array CGH, SNP genotyping arrays, custom CGH arrays, custom genotyping arrays, exome sequencing, whole genome sequencing, targeted sequencing, FISH, q-PCR, or MLPA.

The number of individuals in any given cohort can be at least about 10, 50, 100, 200, 300, 400, 500, 600, 700, 800, 900, 1000, 2500, 5000, 7500, 10,000, 100,000, or more. In some embodiments, the number of individuals in any given cohort can be from 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000.

In some embodiments, a method of determining relevance or statistical significance of a genetic variant in a human subject to a disease or a condition associated with a genotype comprising screening a genome of a human subject with the disease or condition, such as by array Comparative Genomic Hybridization, sequencing, or SNP genotyping, to provide information on one or more genetic variants, such as those in Tables 1 and 2. The method can further comprise comparing, such as via a computer, information of said one or more genetic variants from the genome of said subject to a compilation of data comprising frequencies of genetic variants in at least 100 normal human subjects, such as those without the disease or condition. The method can further comprise determining a statistical significance or relevance of said one or more genetic variants from said comparison to the condition or disease or determining whether a genetic variant is present in said human subject but not present in said compilation of data from said comparison, or an algorithm can be used to call or identify significant genetic variations, such as a genetic variation whose median log 2 ratio is above or below a computed value. A computer can comprise computer executable logic that provides instructions for executing said comparison.

Different categories for CNVs of interest can be defined. In some embodiments, CNVs/CNV-subregions can be of interest if the CNVs/CNV-subregions occur within intergenic regions and are associated with an OR of at least 0.7. For example, CNVs/CNV-subregions can be of interest if the CNVs/CNV-subregions occur within intergenic regions and are associated with an OR of at least 0.7, 0.7, 0.8, 0.9, 1, 2, 3, 4, 5, 6, 7, 8, 9, 10, 12, 14, 16, 18, 20, 25, 30, 35, 40, 45, 50, 60, 70, 80, 90, 100, 110, 120, 130, 140, 150, 160, 170, 175, or more. In some embodiments, CNVs/CNV-subregions can be of interest if the CNVs/CNV-subregions occur within intergenic regions and are associated with an OR from about 0.7-200, 0.7-200, 0.7-90, 0.7-80, 0.7-70, 0.7-60, 0.7-50, 0.7-40, 0.7-30, 0.7-20, 0.7-10, 0.7-5, 10-200, 10-180, 10-160, 10-140, 10-120, 10-100, 10-80, 10-60, 10-40, 10-20, 20-200, 20-180, 20-160, 20-140, 20-120, 20-100, 20-80, 20-60, 20-40, 30-200, 30-180, 30-160, 30-140, 30-120, 30-100, 30-80, 30-60, 30-40, 40-200, 40-180, 40-160, 40-140, 40-120, 40-100, 40-90, 40-80, 40-70, 40-60, 40-50, 50-200, 50-180, 50-160, 50-140, 50-120, 50-100, 50-90, 50-80, 50-70, 50-60, 60-200, 60-180, 60-160, 60-140, 60-120, 60-100, 60-90, 60-80, 60-70, 70-200, 70-180, 70-160, 70-140, 70-120, 70-100, 70-90, 70-80, 80-200, 80-180, 80-160, 80-140, 80-120, 80-100, 80-90, 90-200, 90-180, 90-160, 90-140, 90-120, or 90-100.

In some embodiments, CNVs/CNV-subregions can be of interest if the CNV/CNV-subregion overlaps a known gene, and is associated with an OR of at least 1.8. For example, CNVs/CNV-subregions can be of interest if the CNVs/CNV-subregions occur within intergenic regions and are associated with an OR of at least 1.8, 2, 3, 4, 5, 6, 7, 8, 9, 10, 12, 14, 16, 18, 20, 25, 30, 35, 40, 45, 50, 60, 70, 80, 90, 100, 110, 120, 130, 140, 150, 160, 170, 175, or more. In some embodiments, CNVs/CNV-subregions can be of interest if the CNVs/CNV-subregions occur within exonic regions and are associated with an OR from about 1.8-200, 1.8-200, 1.8-90, 1.8-80, 1.8-70, 1.8-60, 1.8-50, 1.8-40, 1.8-30, 1.8-20, 1.8-10, 1.8-5, 10-200, 10-180, 10-160, 10-140, 10-120, 10-100, 10-80, 10-60, 10-40, 10-20, 20-200, 20-180, 20-160, 20-140, 20-120, 20-100, 20-80, 20-60, 20-40, 30-200, 30-180, 30-160, 30-140, 30-120, 30-100, 30-80, 30-60, 30-40, 40-200, 40-180, 40-160, 40-140, 40-120, 40-100, 40-90, 40-80, 40-70, 40-60, 40-50, 50-200, 50-180, 50-160, 50-140, 50-120, 50-100, 50-90, 50-80, 50-70, 50-60, 60-200, 60-180, 60-160, 60-140, 60-120, 60-100, 60-90, 60-80, 60-70, 70-200, 70-180, 70-160, 70-140, 70-120, 70-100, 70-90, 70-80, 80-200, 80-180, 80-160, 80-140, 80-120, 80-100, 80-90, 90-200, 90-180, 90-160, 90-140, 90-120, or 90-100.

In some embodiments, CNVs/CNV-subregions can be of interest if the CNVs/CNV-subregions are overlapping and/or non-overlapping, impact an exon, and they affect 1 or more PML cases but only 0 Normal subjects. In some embodiments, CNVs/CNV-subregions can be of interest if the CNVs/CNV-subregions are overlapping and/or non-overlapping, impact an exon, and they affect 2 or more PML cases but only 0 or 1 Normal subjects. In some embodiments, CNVs/CNV-subregions can be of interest if the CNVs/CNV-subregions are overlapping and/or non-overlapping, impact an exon, and they affect 1-5 PML cases but only 0 or 1 Normal subjects. For example, CNVs/CNV-subregions can be of interest if the CNVs/CNV-subregions are overlapping and/or non-overlapping, impact an exon, and they affect 1 PML case but only 0 or 1 Normal subjects. This can enable identification of rarer CNVs in cases with PML. In some embodiments, CNVs/CNV-subregions can be of interest if the CNVs/CNV-subregions are overlapping and/or non-overlapping, impact an exon, and they affect 1 PML case but only 0 or 1 Normal subjects, and are associated with an OR greater than 0.7, such as 1.8. In some embodiments, CNVs/CNV-subregions can be of interest if the CNVs/CNV-subregions are overlapping and/or non-overlapping, impact an exon, and they affect 2 PML cases but only 0 or 1 Normal subjects. In some embodiments, CNVs/CNV-subregions can be of interest if the CNVs/CNV-subregions are overlapping and/or non-overlapping, impact an exon, and they affect 3 PML cases but only 0 or 1 Normal subjects. In some embodiments, CNVs/CNV-subregions can be of interest if the CNVs/CNV-subregions are overlapping and/or non-overlapping, impact an exon, and they affect 4 PML cases but only 0 or 1 Normal subjects.

In some embodiments, CNVs/CNV-subregions can be of interest if the OR associated with the sum of PML cases and the sum of NVE subjects affecting the same gene (including distinct CNVs/CNV-subregions) is at least 0.67. For example, a CNV/CNV-subregion can be of interest if the OR associated with the sum of PML cases and the sum of NVE subjects affecting the same gene (including distinct CNVs/CNV-subregions) is at least 0.7, 0.8, 0.9, 1, 2, 3, 4, 5, 6, 7, 8, 9, 10, 12, 14, 16, 18, 20, 25, 30, 35, 40, 45, 50, 60, 70, 80, 90, 100, 110, 120, 130, 140, 150, 160, 170, 175, or more. In some embodiments, a CNVs/CNV-subregions can be of interest if the OR associated with the sum of PML cases and the sum of NVE subjects affecting the same gene (including distinct CNVs/CNV-subregions) is from about 0.7-200, 0.7-200, 0.7-90, 0.7-80, 0.7-70, 0.7-60, 0.7-50, 0.7-40, 0.7-30, 0.7-20, 0.7-10, 0.7-5, 10-200, 10-180, 10-160, 10-140, 10-120, 10-100, 10-80, 10-60, 10-40, 10-20, 20-200, 20-180, 20-160, 20-140, 20-120, 20-100, 20-80, 20-60, 20-40, 30-200, 30-180, 30-160, 30-140, 30-120, 30-100, 30-80, 30-60, 30-40, 40-200, 40-180, 40-160, 40-140, 40-120, 40-100, 40-90, 40-80, 40-70, 40-60, 40-50, 50-200, 50-180, 50-160, 50-140, 50-120, 50-100, 50-90, 50-80, 50-70, 50-60, 60-200, 60-180, 60-160, 60-140, 60-120, 60-100, 60-90, 60-80, 60-70, 70-200, 70-180, 70-160, 70-140, 70-120, 70-100, 70-90, 70-80, 80-200, 80-180, 80-160, 80-140, 80-120, 80-100, 80-90, 90-200, 90-180, 90-160, 90-140, 90-120, or 90-100.

In some embodiments, CNVs/CNV-subregions can be of interest if the OR associated with the sum of PML cases and the sum of NVE subjects affecting the same gene (including distinct CNVs/CNV-subregions) is at least 1.8. For example, a CNV/CNV-subregion can be of interest if the OR associated with the sum of PML cases and the sum of NVE subjects affecting the same gene (including distinct CNVs/CNV-subregions) is at least 1.8, 2, 3, 4, 5, 6, 7, 8, 9, 10, 12, 14, 16, 18, 20, 25, 30, 35, 40, 45, 50, 60, 70, 80, 90, 100, 110, 120, 130, 140, 150, 160, 170, 175, or more. In some embodiments, a CNVs/CNV-subregions can be of interest if the OR associated with the sum of PML cases and the sum of NVE subjects affecting the same gene (including distinct CNVs/CNV-subregions) is from about 1.8-200, 1.8-200, 1.8-90, 1.8-80, 1.8-70, 1.8-60, 1.8-50, 1.8-40, 1.8-30, 1.8-20, 1.8-10, 1.8-5, 10-200, 10-180, 10-160, 10-140, 10-120, 10-100, 10-80, 10-60, 10-40, 10-20, 20-200, 20-180, 20-160, 20-140, 20-120, 20-100, 20-80, 20-60, 20-40, 30-200, 30-180, 30-160, 30-140, 30-120, 30-100, 30-80, 30-60, 30-40, 40-200, 40-180, 40-160, 40-140, 40-120, 40-100, 40-90, 40-80, 40-70, 40-60, 40-50, 50-200, 50-180, 50-160, 50-140, 50-120, 50-100, 50-90, 50-80, 50-70, 50-60, 60-200, 60-180, 60-160, 60-140, 60-120, 60-100, 60-90, 60-80, 60-70, 70-200, 70-180, 70-160, 70-140, 70-120, 70-100, 70-90, 70-80, 80-200, 80-180, 80-160, 80-140, 80-120, 80-100, 80-90, 90-200, 90-180, 90-160, 90-140, 90-120, or 90-100.

In some embodiments, CNVs/CNV-subregions can be of interest if the CNVs/CNV-subregions do not overlap (distinct CNV/CNV-subregion), but impact the same gene (or regulatory locus) and are associated with an OR of at least 6 (Genic (distinct CNV-subregions); OR>6). For example, CNVs/CNV-subregions can be of interest if the CNVs/CNV-subregions do not overlap, but impact the same gene (or regulatory locus), and are associated with an OR of at 7, 8, 9, 10, 12, 14, 16, 18, 20, 25, 30, 35, 40, 45, 50, or more. In some embodiments, CNVs/CNV-subregions can be of interest if the CNVs/CNV-subregions do not overlap, but impact the same gene (or regulatory locus), and are associated with an OR from about 6-100, 6-50, 6-40, 6-30, 6-20, 6-10, 6-9, 6-8, 6-7, 8-100, 8-50, 8-40, 8-30, 8-20, 8-10, 10-100, 10-50, 10-40, 10-30, 10-20, 20-100, 20-50, 20-40, 20-30, 30-100, 30-50, 30-40, 40-100, 40-50, 50-100, or 5-7. The CNV-subregion/gene can be an exonic or intronic part of the gene, or both.

In some embodiments, CNVs/CNV-subregions can be of interest if the CNVs/CNV-subregions do not overlap a known gene (e.g., are non-genic or intergenic) and they are associated with an OR of at least 7 (Exon+ve, PML>4, NVE<2). For example, CNVs/CNV-subregions can be of interest if the CNVs/CNV-subregion does not overlap a known gene (e.g., is non-genic or intergenic) and/or non-overlapping, impact an exon, affect 2 or more PML cases but only 0 or 1 Normal subjects and are associated with an OR of at least 8, 9, 10, 11, 12, 14, 16, 18, 20, 25, 30, 35, 40, 45, 50, or more. In some embodiments, CNVs/CNV-subregions can be of interest if the CNVs/CNV-subregions are overlapping and/or non-overlapping, impact an exon, affect 2 or more PML cases but only 0 or 1 Normal subjects and are associated with an OR from about 7-100, 7-50, 7-40, 7-30, 7-20, 20-100, 20-50, 20-40, 20-30, 30-100, 30-50, 30-40, 40-100, 40-50, 50-100, or 7-11.

In some embodiments, CNVs/CNV-subregions can be of interest if the CNVs/CNV-subregions are overlapping and/or non-overlapping, impact an exon, and they affect 1-5 PML cases but only 0 or 1 Normal subjects. This can enable identification of rarer CNVs in cases with PML. In some embodiments, CNVs/CNV-subregions can be of interest if the CNVs/CNV-subregions are overlapping and/or non-overlapping, impact an exon, and they affect 1 PML case but only 0 or 1 Normal subjects, and are associated with an OR greater than 1, such as 1.47, or from 1-2.5. In some embodiments, CNVs/CNV-subregions can be of interest if the CNVs/CNV-subregions are overlapping and/or non-overlapping, impact an exon, and they affect 2 PML cases but only 0 or 1 Normal subjects and are associated with an OR greater than 2.5, such as 2.95, or from 2.5-4. In some embodiments, CNVs/CNV-subregions can be of interest if the CNVs/CNV-subregions are overlapping and/or non-overlapping, impact an exon, and they affect 3 PML cases but only 0 or 1 Normal subjects and are associated with an OR greater than 4, such as 4.44, or from 4-5.5. In some embodiments, CNVs/CNV-subregions can be of interest if the CNVs/CNV-subregions are overlapping and/or non-overlapping, impact an exon, and they affect 4 PML cases but only 0 or 1 Normal subjects and are associated with an OR greater than 5.5, such as 5.92, or from 5.5-6.8.

In some embodiments, CNVs/CNV-subregions can be of interest if the OR associated with the sum of PML cases and the sum of NVE subjects affecting the same gene (including distinct CNVs/CNV-subregions) is at least 6. For example, a CNV/CNV-subregion can be of interest if the OR associated with the sum of PML cases and the sum of NVE subjects affecting the same gene (including distinct CNVs/CNV-subregions) is at least 7, 8, 9, 10, 12, 14, 16, 18, 20, 25, 30, 35, 40, 45, 50, or more. In some embodiments, a CNVs/CNV-subregions can be of interest if the OR associated with the sum of PML cases and the sum of NVE subjects affecting the same gene (including distinct CNVs/CNV-subregions) is from about 6-100, 6-50, 6-40, 6-30, 6-20, 6-10, 6-9, 6-8, 6-7, 8-100, 8-50. 8-40, 8-30, 8-20, 8-10, 10-100, 10-50, 10-40, 10-30, 10-20, 20-100, 20-50, 20-40, 20-30, 30-100, 30-50, 30-40, 40-100, 40-50, 50-100, or 5-7.

In some embodiments, CNVs/CNV-subregions can be of interest if the CNVs/CNV-subregions impact an intron and they affect 5 or more PML cases but only 0 or 1 Normal subjects and they are associated with an OR of at least 7 (Intron+ve, PML>4, Normals<2). For example, CNVs/CNV-subregions can be of interest if the CNVs/CNV-sub-regions impact an intron and they affect 5 or more PML cases but only 0 or 1 Normal subjects and they are associated with an OR of at least 8, 9, 10, 11, 12, 14, 16, 18, 20, 25, 30, 35, 40, 45, 50, or more. In some embodiments, CNVs/CNV-subregions can be of interest if the CNVs/CNV-subregions impact an intron and they affect 5 or more PML cases but only 0 or 1 Normal subjects and they are associated with an OR from about 7-100, 7-50, 7-40, 7-30, 7-20, 20-100, 20-50, 20-40, 20-30, 30-100, 30-50, 30-40, 40-100, 40-50, 50-100, or 7-11. CNVs/CNV-subregions impacting introns can be pathogenic (e.g., such variants can result in alternatively spliced mRNAs or loss of a microRNA binding site, which may deleteriously impact the resulting protein's structure or expression level).

In some embodiments, CNVs/CNV-subregions can be of interest if the CNVs/CNV-subregions occur within intergenic regions and are associated with an OR of greater than 30 (High OR intergenic (OR>30)). For example, CNVs/CNV-subregions can be of interest if the CNVs/CNV-subregions occur within intergenic regions and are associated with an OR of greater than 31, 32, 33, 34, 35, 40, 45, 50, 66, 60, 65, 70, 75, 80, 85, 90, 95, 100 or more. In some embodiments, CNVs/CNV-subregions can be of interest if the CNVs/CNV-subregions impact occur within intergenic regions and are associated with an OR from about 30-100, 30-90, 30-80, 30-70, 30-60, 30-50, 30-40, 40-100, 40-90, 40-80, 40-70, 40-60, 40-50, 50-100, 50-90, 50-80, 50-70, 50-60, 60-100, 60-90, 60-80, 60-70, 70-100, 70-90, 70-80, 80-100, 80-90, or 90-100.

In some embodiments, a CNV/CNV-subregion can be of interest if the CNV/CNV-subregion overlaps a known gene, and is associated with an OR of at least 10. In some embodiments, a CNV/CNV-subregion can be of interest if the CNV/CNV-subregion overlaps a known gene, is associated with an OR of at least 6, and if the OR associated with the sum of PML cases and the sum of NVE subjects affecting the same gene (including distinct CNV-subregions) is at least 6.

Methods of Treatment

One embodiment of the present disclosure provides methods, pharmaceutical compositions, and kits for the treatment of a condition in animal subjects. The condition can be HIV/AIDS, cancer, or an autoimmune disease. In some embodiments, the condition can be PML. For example, the condition can be multiple sclerosis. In some embodiments, the methods comprise administering one or more immunosuppressive medications. In some embodiments, the pharmaceutical compositions and kits comprise one or more immunosuppressive medications. The one or more immunosuppressive medications can be adalimumab (e.g., Humira), alemtuzumab (e.g., Lemtrada), alentuzumab (e.g., Campath), azathioprine (e.g., Imuran), belimumab (e.g., Benlysta), bevacizumab (e.g., Avastatin), bortezomib (e.g., Velcade), eculizumab (e.g., Soliris), leflunomide, brentuximab vedotin (e.g., Adcetris), cetuximab (e.g., Erbitux), cyclophosphamid, dimethyl fumarate (e.g., Tecfidera), efalizumab (e.g., Raptiva), fingolimod (e.g., Gilenya), fludarabine (e.g., Fludara), fumaric acid, imatinib (e.g., Gleevec, Glivec), infliximab (e.g., Remicade), methotrexate (e.g., Trexall, Rheumatrex), mycophenolate mofetil (e.g., Cellcept), natalizumab (e.g., Tysabri), rituximab (e.g., Rituxin), daclizumab (e.g., Zinbryta), vedolizumab (Entyvio), ruxolitinib (e.g., Jakafi, Jakavi), ocrelizumab (e.g., Ocrevus), or any combinations thereof. The term "animal subject" as used herein includes humans as well as other mammals. The term "treating" as used herein includes achieving a therapeutic benefit and/or a prophylactic benefit. By therapeutic benefit is meant eradication or amelioration of the underlying viral infection (e.g., HIV), cancer, or autoimmune disease.

In some embodiments, a subject can be currently treated with an antiretroviral medication. In some embodiments, a subject can be previously treated with an antiretroviral medication. In some embodiments, a subject can be not yet treated with an antiretroviral medication. The antiretroviral medication can include but not limited to Nucleoside Reverse Transcriptase Inhibitors (NRTIs), Non-Nucleoside Reverse Transcriptase Inhibitors (NNRTIs), Protease Inhibitors (PIs), Fusion Inhibitors, Entry Inhibitors, Integrase Inhibitors, Pharmacokinetic Enhancers, and Combination HIV Medicines. In some cases, the Nucleoside Reverse Transcriptase Inhibitors can include but not limited to abacavir, didanosine, emtricitabine, lamivudine, stavudine, tenofovir disoproxil fumarate, and zidovudine. In some cases, the Non-Nucleoside Reverse Transcriptase Inhibitors can include but not limited to efavirenz, etravirine, nevirapine, and rilpivirine. In some cases, the Protease Inhibitors can include but not limited to atazanavir, darunavir, fosamprenavir, indinavir, nelfinavir, ritonavir, saquinavir, and tipranavir. In some cases, the Fusion Inhibitors can include but not limited to enfuvirtide. In some cases, the Entry Inhibitors can include but not limited to maraviroc. In some cases, the Integrase Inhibitors can include but not limited to dolutegravir, elvitegravir, and raltegravir. In some cases, the Pharmacokinetic Enhancers can include but not limited to cobicistat. In some cases, the Combination HIV Medicines can include but not limited to abacavir and lamivudine, abacavir, dolutegravir, and lamivudine, abacavir, lamivudine, and zidovudine, atazanavir and cobicistat, darunavir and cobicistat, efavirenz, emtricitabine, and tenofovir disoproxil fumarate, elvitegravir, cobicistat, emtricitabine, and tenofovir alafenamide fumarate, elvitegravir, cobicistat, emtricitabine, and tenofovir disoproxil fumarate, emtricitabine, rilpivirine, and tenofovir alafenamide, emtricitabine, rilpivirine, and tenofovir disoproxil fumarate, emtricitabine and tenofovir alafenamide, emtricitabine and tenofovir disoproxil fumarate, lamivudine and zidovudine, lopinavir and ritonavir, and any combination of antiretroviral medications listed above.

In some embodiments, such as when a subject is identified as having at least one of the genetic variants described herein, an agent targeting the JC Virus can be administered to the subject. In some embodiments, a medication can be administered to a subject that prevents PML from developing, or it can reduce, lessen, shorten and/or otherwise ameliorate the progression of PML, or symptoms that develop. The pharmaceutical composition can modulate or target JC Virus. In some embodiments, a subject identified as having PML can be administered an agent that reduces a viral load in the subject. In some embodiments, an immunosuppressive agent can be administered prior to, or in conjunction with, an agent that reduces a viral load in the subject. In some embodiments, a subject identified as having a risk of developing PML can be administered an agent that prevents an increase in a viral load in the subject. In some embodiments, a subject identified as having a high risk of developing PML can be administered an agent that prevents an increase in a viral load in the subject. In some embodiments, an immunosuppressive agent can be administered prior to, or in conjunction with, an agent that prevents an increase in a viral load in the subject. The agent that reduces a viral load in the subject or that prevents an increase in a viral load in the subject can be, for example, an agent that targets JC Virus. Exemplary agents include antibodies, such as broadly neutralizing JCV antibodies. For example, an agent can be a broadly neutralizing human monoclonal JC polyomavirus VP-1 specific antibody (See, e.g., Jelcic et al., Science Translational Medicine, Vol. 7, Issue 306, pp. 306ra150 (2015) and Ray et al., Science Translational Medicine, Vol. 7, Issue 306, pp 306ra151 (2015)). Additional exemplary agents include antiretroviral agents, cidofovir, hexadecyloxypropyl-cidofovir (a lipid-ester derivative), cytarabine (cytosine arabinoside), agents that block the 5HT2a receptor (e.g., olanzapine, zisprasidone, mirtazapine, cyproheptadine, and risperidone), topoisomerase inhibitors (e.g., topotecan), and mefloquine.

In some embodiments, a pharmaceutical composition of the disclosure can be administered to a subject at risk of developing PML, or to a subject reporting one or more of the physiological symptoms of PML, even though a screening of the condition cannot have been made. In some embodiments, a pharmaceutical composition of the disclosure can be administered to a subject not identified as having a risk of developing PML, or to a subject not identified as having one or more of the physiological symptoms of PML, even though a screening of the condition cannot have been made.

The present disclosure also includes kits that can be used to treat a condition in animal subjects. These kits comprise one or more immunosuppressive medications and in some embodiments instructions teaching the use of the kit according to the various methods and approaches described herein. Such kits can also include information, such as scientific literature references, package insert materials, clinical trial results, and/or summaries of these and the like, which indicate or establish the activities and/or advantages (or risks and/or disadvantages) of the agent. Such information can be based on the results of various studies, for example, studies using experimental animals involving in vivo models and studies based on human clinical trials. Kits described herein can be provided, marketed and/or promoted to health providers, including physicians, nurses, pharmacists, formulary officials, and the like.

In some aspects a host cell can be used for testing or administering therapeutics. In some embodiments, a host cell can comprise a nucleic acid comprising expression control sequences operably-linked to a coding region. The host cell can be natural or non-natural. The non-natural host used in aspects of the method can be any cell capable of expressing a nucleic acid of the disclosure including, bacterial cells, fungal cells, insect cells, mammalian cells and plant cells. In some aspects the natural host is a mammalian tissue cell and the non-natural host is a different mammalian tissue cell. Other aspects of the method include a natural host that is a first cell normally residing in a first mammalian species and the non-natural host is a second cell normally residing in a second mammalian species. In another alternative aspect, the method uses a first cell and the second cell that are from the same tissue type. In those aspects of the method where the coding region encodes a mammalian polypeptide, the mammalian polypeptide may be a hormone. In other aspects the coding region may encode a neuropeptide, an antibody, an antimetabolite, or a polypeptide or nucleotide therapeutic.

Expression control sequences can be those nucleotide sequences, both 5' and 3' to a coding region, that are required for the transcription and translation of the coding region in a host organism. Regulatory sequences include a promoter, ribosome binding site, optional inducible elements and sequence elements required for efficient 3' processing, including polyadenylation. When the structural gene has been isolated from genomic DNA, the regulatory sequences also include those intronic sequences required for splicing of the introns as part of mRNA formation in the target host.

Formulations, Routes of Administration, and Effective Doses

Yet another aspect of the present disclosure relates to formulations, routes of administration and effective doses for pharmaceutical compositions comprising an agent or combination of agents of the instant disclosure. Such pharmaceutical compositions can be used to treat a condition (e.g., multiple sclerosis) as described above.

Compounds of the disclosure can be administered as pharmaceutical formulations including those suitable for oral (including buccal and sub-lingual), rectal, nasal, topical, transdermal patch, pulmonary, vaginal, suppository, or parenteral (including intramuscular, intraarterial, intrathecal, intradermal, intraperitoneal, subcutaneous and intravenous) administration or in a form suitable for administration by aerosolization, inhalation or insufflation. General information on drug delivery systems can be found in Ansel et al., Pharmaceutical Dosage Forms and Drug Delivery Systems (Lippencott Williams & Wilkins, Baltimore Md. (1999).

In various embodiments, the pharmaceutical composition includes carriers and excipients (including but not limited to buffers, carbohydrates, mannitol, polypeptides, amino acids, antioxidants, bacteriostats, chelating agents, suspending agents, thickening agents and/or preservatives), water, oils including those of petroleum, animal, vegetable or synthetic origin, such as peanut oil, soybean oil, mineral oil, sesame oil and the like, saline solutions, aqueous dextrose and glycerol solutions, flavoring agents, coloring agents, detackifiers and other acceptable additives, adjuvants, or binders, other pharmaceutically acceptable auxiliary substances to approximate physiological conditions, such as pH buffering agents, tonicity adjusting agents, emulsifying agents, wetting agents and the like. Examples of excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. In some embodiments, the pharmaceutical preparation is substantially free of preservatives. In other embodiments, the pharmaceutical preparation can contain at least one preservative. General methodology on pharmaceutical dosage forms is found in Ansel et al., Pharmaceutical Dosage Forms and Drug Delivery Systems (Lippencott, Williams, & Wilkins, Baltimore Md. (1999)). It can be recognized that, while any suitable carrier known to those of ordinary skill in the art can be employed to administer the compositions of this disclosure, the type of carrier can vary depending on the mode of administration.

Compounds can also be encapsulated within liposomes using well-known technology. Biodegradable microspheres can also be employed as carriers for the pharmaceutical compositions of this disclosure. Suitable biodegradable microspheres are disclosed, for example, in U.S. Pat. Nos. 4,897,268, 5,075,109, 5,928,647, 5,811,128, 5,820,883, 5,853,763, 5,814,344 and 5,942,252.

The compound can be administered in liposomes or microspheres (or microparticles). Methods for preparing liposomes and microspheres for administration to a subject are well known to those of skill in the art. U.S. Pat. No. 4,789,734, the contents of which are hereby incorporated by reference, describes methods for encapsulating biological materials in liposomes. Essentially, the material is dissolved in an aqueous solution, the appropriate phospholipids and lipids added, and along with surfactants if required, and the material dialyzed or sonicated, as necessary. A review of known methods is provided by G. Gregoriadis, Chapter 14, "Liposomes," Drug Carriers in Biology and Medicine, pp. 2.sup.87-341 (Academic Press, 1979).

Microspheres formed of polymers or polypeptides are well known to those skilled in the art, and can be tailored for passage through the gastrointestinal tract directly into the blood stream. Alternatively, the compound can be incorporated and the microspheres, or composite of microspheres, implanted for slow release over a period of time ranging from days to months. See, for example, U.S. Pat. Nos. 4,906,474, 4,925,673 and 3,625,214, and Jein, TIPS 19:155-157 (1998), the contents of which are hereby incorporated by reference.

The concentration of drug can be adjusted, the pH of the solution buffered and the isotonicity adjusted to be compatible with intravenous injection, as is well known in the art.

The compounds of the disclosure can be formulated as a sterile solution or suspension, in suitable vehicles, well known in the art. The pharmaceutical compositions can be sterilized by conventional, well-known sterilization techniques, or can be sterile filtered. The resulting aqueous solutions can be packaged for use as is, or lyophilized, the lyophilized preparation being combined with a sterile solution prior to administration. Suitable formulations and additional carriers are described in Remington "The Science and Practice of Pharmacy" (20th Ed., Lippincott Williams & Wilkins, Baltimore Md.), the teachings of which are incorporated by reference in their entirety herein.

The agents or their pharmaceutically acceptable salts can be provided alone or in combination with one or more other agents or with one or more other forms. For example, a formulation can comprise one or more agents in particular proportions, depending on the relative potencies of each agent and the intended indication. For example, in compositions for targeting two different host targets, and where potencies are similar, about a 1:1 ratio of agents can be used. The two forms can be formulated together, in the same dosage unit e.g., in one cream, suppository, tablet, capsule, aerosol spray, or packet of powder to be dissolved in a beverage; or each form can be formulated in a separate unit, e.g., two creams, two suppositories, two tablets, two capsules, a tablet and a liquid for dissolving the tablet, two aerosol sprays, or a packet of powder and a liquid for dissolving the powder, etc.

The term "pharmaceutically acceptable salt" means those salts which retain the biological effectiveness and properties of the agents used in the present disclosure, and which are not biologically or otherwise undesirable.

Typical salts are those of the inorganic ions, such as, for example, sodium, potassium, calcium, magnesium ions, and the like. Such salts include salts with inorganic or organic acids, such as hydrochloric acid, hydrobromic acid, phosphoric acid, nitric acid, sulfuric acid, methanesulfonic acid, p toluenesulfonic acid, acetic acid, fumaric acid, succinic acid, lactic acid, mandelic acid, malic acid, citric acid, tartaric acid or maleic acid. In addition, if the agent(s) contain a carboxy group or other acidic group, it can be converted into a pharmaceutically acceptable addition salt with inorganic or organic bases. Examples of suitable bases include sodium hydroxide, potassium hydroxide, ammonia, cyclohexylamine, dicyclohexyl-amine, ethanolamine, diethanolamine, triethanolamine, and the like.

A pharmaceutically acceptable ester or amide refers to those which retain biological effectiveness and properties of the agents used in the present disclosure, and which are not biologically or otherwise undesirable. Typical esters include ethyl, methyl, isobutyl, ethylene glycol, and the like. Typical amides include unsubstituted amides, alkyl amides, dialkyl amides, and the like.

In some embodiments, an agent can be administered in combination with one or more other compounds, forms, and/or agents, e.g., as described above. Pharmaceutical compositions with one or more other active agents can be formulated to comprise certain molar ratios. For example, molar ratios of about 99:1 to about 1:99 of a first active agent to the other active agent can be used. In some subset of the embodiments, the range of molar ratios of a first active agent: other active agents are selected from about 80:20 to about 20:80; about 75:25 to about 25:75, about 70:30 to about 30:70, about 66:33 to about 33:66, about 60:40 to about 40:60; about 50:50; and about 90:10 to about 10:90. The molar ratio of a first active: other active agents can be about 1:9, and in some embodiments can be about 1:1. The two agents, forms and/or compounds can be formulated together, in the same dosage unit e.g., in one cream, suppository, tablet, capsule, or packet of powder to be dissolved in a beverage; or each agent, form, and/or compound can be formulated in separate units, e.g., two creams, suppositories, tablets, two capsules, a tablet and a liquid for dissolving the tablet, an aerosol spray a packet of powder and a liquid for dissolving the powder, etc.

If necessary or desirable, the agents and/or combinations of agents can be administered with still other agents. The choice of agents that can be co-administered with the agents and/or combinations of agents of the instant disclosure can depend, at least in part, on the condition being treated. Agents of particular use in the formulations of the present disclosure include, for example, any agent having a therapeutic effect for a viral infection, including, e.g., drugs used to treat inflammatory conditions. For example, in treatments for influenza, in some embodiments formulations of the instant disclosure can additionally contain one or more conventional anti-inflammatory drugs, such as an NSAID, e.g., ibuprofen, naproxen, acetaminophen, ketoprofen, or aspirin. In some alternative embodiments for the treatment of influenza formulations of the instant disclosure can additionally contain one or more conventional influenza antiviral agents, such as amantadine, rimantadine, zanamivir, and oseltamivir. In treatments for retroviral infections, such as HIV, formulations of the instant disclosure can additionally contain one or more conventional antiviral drug, such as protease inhibitors (lopinavir/ritonavir {Kaletra}, indinavir {Crixivan}, ritonavir {Norvir}, nelfinavir {Viracept}, saquinavir hard gel capsules {Invirase}, atazanavir {Reyataz}, amprenavir {Agenerase}, fosamprenavir {Telzir}, tipranavir{Aptivus}), reverse transcriptase inhibitors, including non-Nucleoside and Nucleoside/nucleotide inhibitors (AZT {zidovudine, Retrovir}, ddl {didanosine, Videx}, 3TC {lamivudine, Epivir}, d4T {stavudine, Zerit}, abacavir {Ziagen}, FTC {emtricitabine, Emtriva}, tenofovir {Viread}, efavirenz {Sustiva} and nevirapine {Viramune}), fusion inhibitors T20 {enfuvirtide, Fuzeon}, integrase inhibitors (MK-0518 and GS-9137), and maturation inhibitors (PA-457 {Bevirimat}). As another example, formulations can additionally contain one or more supplements, such as vitamin C, E or other anti-oxidants.

The agent(s) (or pharmaceutically acceptable salts, esters or amides thereof) can be administered per se or in the form of a pharmaceutical composition wherein the active agent(s) is in an admixture or mixture with one or more pharmaceutically acceptable carriers. A pharmaceutical composition, as used herein, can be any composition prepared for administration to a subject. Pharmaceutical compositions for use in accordance with the present disclosure can be formulated in conventional manner using one or more physiologically acceptable carriers, comprising excipients, diluents, and/or auxiliaries, e.g., which facilitate processing of the active agents into preparations that can be administered. Proper formulation can depend at least in part upon the route of administration chosen. The agent(s) useful in the present disclosure, or pharmaceutically acceptable salts, esters, or amides thereof, can be delivered to a subject using a number of routes or modes of administration, including oral, buccal, topical, rectal, transdermal, transmucosal, subcutaneous, intravenous, and intramuscular applications, as well as by inhalation.

For oral administration, the agents can be formulated readily by combining the active agent(s) with pharmaceutically acceptable carriers well known in the art. Such carriers enable the agents of the disclosure to be formulated as tablets, including chewable tablets, pills, dragees, capsules, lozenges, hard candy, liquids, gels, syrups, slurries, powders, suspensions, elixirs, wafers, and the like, for oral ingestion by a subject to be treated. Such formulations can comprise pharmaceutically acceptable carriers including solid diluents or fillers, sterile aqueous media and various non-toxic organic solvents. A solid carrier can be one or more substances which can also act as diluents, flavoring agents, solubilizers, lubricants, suspending agents, binders, preservatives, tablet disintegrating agents, or an encapsulating material. In powders, the carrier generally is a finely divided solid which is a mixture with the finely divided active component. In tablets, the active component generally is mixed with the carrier having the necessary binding capacity in suitable proportions and compacted in the shape and size desired. The powders and tablets preferably contain from about one (1) to about seventy (70) percent of the active compound. Suitable carriers include but are not limited to magnesium carbonate, magnesium stearate, talc, sugar, lactose, pectin, dextrin, starch, gelatin, tragacanth, methylcellulose, sodium carboxymethylcellulose, a low melting wax, cocoa butter, and the like. Generally, the agents of the disclosure can be included at concentration levels ranging from about 0.5%, about 5%, about 10%, about 20%, or about 30% to about 50%, about 60%, about 70%, about 80% or about 90% by weight of the total composition of oral dosage forms, in an amount sufficient to provide a desired unit of dosage.

Aqueous suspensions for oral use can contain agent(s) of this disclosure with pharmaceutically acceptable excipients, such as a suspending agent (e.g., methyl cellulose), a wetting agent (e.g., lecithin, lysolecithin and/or a long-chain fatty alcohol), as well as coloring agents, preservatives, flavoring agents, and the like.

In some embodiments, oils or non-aqueous solvents can be used to bring the agents into solution, due to, for example, the presence of large lipophilic moieties. Alternatively, emulsions, suspensions, or other preparations, for example, liposomal preparations, can be used. With respect to liposomal preparations, any known methods for preparing liposomes for treatment of a condition can be used. See, for example, Bangham et al., J. Mol. Biol. 23: 238-252 (1965) and Szoka et al., Proc. Natl Acad. Sci. USA 75: 4194-4198 (1978), incorporated herein by reference. Ligands can also be attached to the liposomes to direct these compositions to particular sites of action. Agents of this disclosure can also be integrated into foodstuffs, e.g., cream cheese, butter, salad dressing, or ice cream to facilitate solubilization, administration, and/or compliance in certain subject populations.

Pharmaceutical preparations for oral use can be obtained as a solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; flavoring elements, cellulose preparations such as, for example, maize starch, wheat starch, rice starch, potato starch, gelatin, gum tragacanth, methyl cellulose, hydroxypropylmethyl cellulose, sodium carboxymethylcellulose, and/or polyvinyl pyrrolidone (PVP). If desired, disintegrating agents can be added, such as the cross linked polyvinyl pyrrolidone, agar, or alginic acid or a salt thereof such as sodium alginate. The agents can also be formulated as a sustained release preparation.

Dragee cores can be provided with suitable coatings. For this purpose, concentrated sugar solutions can be used, which can optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments can be added to the tablets or dragee coatings for identification or to characterize different combinations of active agents.

Pharmaceutical preparations that can be used orally include push fit capsules made of gelatin, as well as soft, sealed capsules made of gelatin and a plasticizer, such as glycerol or sorbitol. The push fit capsules can contain the active ingredients in admixture with filler such as lactose, binders such as starches, and/or lubricants such as talc or magnesium stearate and, optionally, stabilizers. In soft capsules, the active agents can be dissolved or suspended in suitable liquids, such as fatty oils, liquid paraffin, or liquid polyethylene glycols. In addition, stabilizers can be added. All formulations for oral administration should be in dosages suitable for administration.

Other forms suitable for oral administration include liquid form preparations including emulsions, syrups, elixirs, aqueous solutions, aqueous suspensions, or solid form preparations which are intended to be converted shortly before use to liquid form preparations. Emulsions can be prepared in solutions, for example, in aqueous propylene glycol solutions or can contain emulsifying agents, for example, such as lecithin, sorbitan monooleate, or acacia. Aqueous solutions can be prepared by dissolving the active component in water and adding suitable colorants, flavors, stabilizers, and thickening agents. Aqueous suspensions can be prepared by dispersing the finely divided active component in water with viscous material, such as natural or synthetic gums, resins, methylcellulose, sodium carboxymethylcellulose, and other well known suspending agents. Suitable fillers or carriers with which the compositions can be administered include agar, alcohol, fats, lactose, starch, cellulose derivatives, polysaccharides, polyvinylpyrrolidone, silica, sterile saline and the like, or mixtures thereof used in suitable amounts. Solid form preparations include solutions, suspensions, and emulsions, and can contain, in addition to the active component, colorants, flavors, stabilizers, buffers, artificial and natural sweeteners, dispersants, thickeners, solubilizing agents, and the like.

A syrup or suspension can be made by adding the active compound to a concentrated, aqueous solution of a sugar, e.g., sucrose, to which can also be added any accessory ingredients. Such accessory ingredients can include flavoring, an agent to retard crystallization of the sugar or an agent to increase the solubility of any other ingredient, e.g., as a polyhydric alcohol, for example, glycerol or sorbitol.

When formulating compounds of the disclosure for oral administration, it can be desirable to utilize gastroretentive formulations to enhance absorption from the gastrointestinal (GI) tract. A formulation which is retained in the stomach for several hours can release compounds of the disclosure slowly and provide a sustained release that can be preferred in some embodiments of the disclosure. Disclosure of such gastro-retentive formulations are found in Klausner E. A., et al., Pharm. Res. 20, 1466-73 (2003); Hoffman, A. et al., Int. J. Pharm. 11, 141-53 (2004), Streubel, A., et al. Expert Opin. Drug Deliver. 3, 217-3, and Chavanpatil, M. D. et al., Int. J. Pharm. (2006). Expandable, floating and bioadhesive techniques can be utilized to maximize absorption of the compounds of the disclosure.

The compounds of the disclosure can be formulated for parenteral administration (e.g., by injection, for example, bolus injection or continuous infusion) and can be presented in unit dose form in ampoules, pre-filled syringes, small volume infusion or in multi-dose containers with an added preservative. The compositions can take such forms as suspensions, solutions, or emulsions in oily or aqueous vehicles, for example, solutions in aqueous polyethylene glycol.

For injectable formulations, the vehicle can be chosen from those known in art to be suitable, including aqueous solutions or oil suspensions, or emulsions, with sesame oil, corn oil, cottonseed oil, or peanut oil, as well as elixirs, mannitol, dextrose, or a sterile aqueous solution, and similar pharmaceutical vehicles. The formulation can also comprise polymer compositions which are biocompatible, biodegradable, such as poly(lactic-co-glycolic)acid. These materials can be made into micro or nanospheres, loaded with drug and further coated or derivatized to provide superior sustained release performance. Vehicles suitable for periocular or intraocular injection include, for example, suspensions of therapeutic agent in injection grade water, liposomes and vehicles suitable for lipophilic substances. Other vehicles for periocular or intraocular injection are well known in the art.

In some embodiments, the composition is formulated in accordance with routine procedures as a pharmaceutical composition adapted for intravenous administration to human beings. Typically, compositions for intravenous administration are solutions in sterile isotonic aqueous buffer. Where necessary, the composition can also include a solubilizing agent and a local anesthetic such as lidocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients can be mixed prior to administration.

When administration is by injection, the active compound can be formulated in aqueous solutions, specifically in physiologically compatible buffers such as Hanks solution, Ringer's solution, or physiological saline buffer. The solution can contain formulatory agents such as suspending, stabilizing and/or dispersing agents. Alternatively, the active compound can be in powder form for constitution with a suitable vehicle, e.g., sterile pyrogen-free water, before use. In some embodiments, the pharmaceutical composition does not comprise an adjuvant or any other substance added to enhance the immune response stimulated by the peptide. In some embodiments, the pharmaceutical composition comprises a substance that inhibits an immune response to the peptide. Methods of formulation are known in the art, for example, as disclosed in Remington's Pharmaceutical Sciences, latest edition, Mack Publishing Co., Easton P.

In addition to the formulations described previously, the agents can also be formulated as a depot preparation. Such long acting formulations can be administered by implantation or transcutaneous delivery (for example, subcutaneously or intramuscularly), intramuscular injection or use of a transdermal patch. Thus, for example, the agents can be formulated with suitable polymeric or hydrophobic materials (for example, as an emulsion in an acceptable oil) or ion exchange resins, or as sparingly soluble derivatives, for example, as a sparingly soluble salt.

In some embodiments, pharmaceutical compositions comprising one or more agents of the present disclosure exert local and regional effects when administered topically or injected at or near particular sites of infection. Direct topical application, e.g., of a viscous liquid, solution, suspension, dimethylsulfoxide (DMSO)-based solutions, liposomal formulations, gel, jelly, cream, lotion, ointment, suppository, foam, or aerosol spray, can be used for local administration, to produce for example, local and/or regional effects. Pharmaceutically appropriate vehicles for such formulation include, for example, lower aliphatic alcohols, polyglycols (e.g., glycerol or polyethylene glycol), esters of fatty acids, oils, fats, silicones, and the like. Such preparations can also include preservatives (e.g., p-hydroxybenzoic acid esters) and/or antioxidants (e.g., ascorbic acid and tocopherol). See also Dermatological Formulations: Percutaneous absorption, Barry (Ed.), Marcel Dekker Incl, 1983.

Pharmaceutical compositions of the present disclosure can contain a cosmetically or dermatologically acceptable carrier. Such carriers are compatible with skin, nails, mucous membranes, tissues and/or hair, and can include any conventionally used cosmetic or dermatological carrier meeting these requirements. Such carriers can be readily selected by one of ordinary skill in the art. In formulating skin ointments, an agent or combination of agents of the instant disclosure can be formulated in an oleaginous hydrocarbon base, an anhydrous absorption base, a water-in-oil absorption base, an oil-in-water water-removable base and/or a water-soluble base. Examples of such carriers and excipients include, but are not limited to, humectants (e.g., urea), glycols (e.g., propylene glycol), alcohols (e.g., ethanol), fatty acids (e.g., oleic acid), surfactants (e.g., isopropyl myristate and sodium lauryl sulfate), pyrrolidones, glycerol monolaurate, sulfoxides, terpenes (e.g., menthol), amines, amides, alkanes, alkanols, water, calcium carbonate, calcium phosphate, various sugars, starches, cellulose derivatives, gelatin, and polymers such as polyethylene glycols.

Ointments and creams can, for example, be formulated with an aqueous or oily base with the addition of suitable thickening and/or gelling agents. Lotions can be formulated with an aqueous or oily base and can in general also containing one or more emulsifying agents, stabilizing agents, dispersing agents, suspending agents, thickening agents, or coloring agents. The construction and use of transdermal patches for the delivery of pharmaceutical agents is well known in the art. See, e.g., U.S. Pat. Nos. 5,023,252, 4,992,445 and 5,001,139. Such patches can be constructed for continuous, pulsatile, or on demand delivery of pharmaceutical agents.

Lubricants which can be used to form pharmaceutical compositions and dosage forms of the disclosure include, but are not limited to, calcium stearate, magnesium stearate, mineral oil, light mineral oil, glycerin, sorbitol, mannitol, polyethylene glycol, other glycols, stearic acid, sodium lauryl sulfate, talc, hydrogenated vegetable oil (e.g., peanut oil, cottonseed oil, sunflower oil, sesame oil, olive oil, corn oil, and soybean oil), zinc stearate, ethyl oleate, ethyl laureate, agar, or mixtures thereof. Additional lubricants include, for example, a syloid silica gel, a coagulated aerosol of synthetic silica, or mixtures thereof. A lubricant can optionally be added, in an amount of less than about 1 weight percent of the pharmaceutical composition.

The compositions according to the present disclosure can be in any form suitable for topical application, including aqueous, aqueous-alcoholic or oily solutions, lotion or serum dispersions, aqueous, anhydrous or oily gels, emulsions obtained by dispersion of a fatty phase in an aqueous phase (O/W or oil in water) or, conversely, (W/O or water in oil), microemulsions or alternatively microcapsules, microparticles or lipid vesicle dispersions of ionic and/or nonionic type. These compositions can be prepared according to conventional methods. Other than the agents of the disclosure, the amounts of the various constituents of the compositions according to the disclosure are those conventionally used in the art. These compositions in particular constitute protection, treatment or care creams, milks, lotions, gels or foams for the face, for the hands, for the body and/or for the mucous membranes, or for cleansing the skin. The compositions can also consist of solid preparations constituting soaps or cleansing bars.

Compositions of the present disclosure can also contain adjuvants common to the cosmetic and dermatological fields, such as hydrophilic or lipophilic gelling agents, hydrophilic or lipophilic active agents, preserving agents, antioxidants, solvents, fragrances, fillers, sunscreens, odor-absorbers and dyestuffs. The amounts of these various adjuvants are those conventionally used in the fields considered and, for example, are from about 0.01% to about 20% of the total weight of the composition. Depending on their nature, these adjuvants can be introduced into the fatty phase, into the aqueous phase and/or into the lipid vesicles.

In some embodiments, ocular viral infections can be effectively treated with ophthalmic solutions, suspensions, ointments or inserts comprising an agent or combination of agents of the present disclosure. Eye drops can be prepared by dissolving the active ingredient in a sterile aqueous solution such as physiological saline, buffering solution, etc., or by combining powder compositions to be dissolved before use. Other vehicles can be chosen, as is known in the art, including but not limited to: balance salt solution, saline solution, water soluble polyethers such as polyethyene glycol, polyvinyls, such as polyvinyl alcohol and povidone, cellulose derivatives such as methylcellulose and hydroxypropyl methylcellulose, petroleum derivatives such as mineral oil and white petrolatum, animal fats such as lanolin, polymers of acrylic acid such as carboxypolymethylene gel, vegetable fats such as peanut oil and polysaccharides such as dextrans, and glycosaminoglycans such as sodium hyaluronate. If desired, additives ordinarily used in the eye drops can be added. Such additives include isotonizing agents (e.g., sodium chloride, etc.), buffer agent (e.g., boric acid, sodium monohydrogen phosphate, sodium dihydrogen phosphate, etc.), preservatives (e.g., benzalkonium chloride, benzethonium chloride, chlorobutanol, etc.), thickeners (e.g., saccharide such as lactose, mannitol, maltose, etc.; e.g., hyaluronic acid or its salt such as sodium hyaluronate, potassium hyaluronate, etc.; e.g., mucopolysaccharide such as chondroitin sulfate, etc.; e.g., sodium polyacrylate, carboxyvinyl polymer, crosslinked polyacrylate, polyvinyl alcohol, polyvinyl pyrrolidone, methyl cellulose, hydroxy propyl methylcellulose, hydroxyethyl cellulose, carboxymethyl cellulose, hydroxy propyl cellulose or other agents known to those skilled in the art).

The solubility of the components of the present compositions can be enhanced by a surfactant or other appropriate co-solvent in the composition. Such cosolvents include polysorbate 20, 60, and 80, Pluronic F68, F-84 and P-103, cyclodextrin, or other agents known to those skilled in the art. Such co-solvents can be employed at a level of from about 0.01% to 2% by weight.

The compositions of the disclosure can be packaged in multidose form. Preservatives can be preferred to prevent microbial contamination during use. Suitable preservatives include: benzalkonium chloride, thimerosal, chlorobutanol, methyl paraben, propyl paraben, phenylethyl alcohol, edetate disodium, sorbic acid, Onamer M, or other agents known to those skilled in the art. In the prior art ophthalmic products, such preservatives can be employed at a level of from 0.004% to 0.02%. In the compositions of the present application the preservative, preferably benzalkonium chloride, can be employed at a level of from 0.001% to less than 0.01%, e.g., from 0.001% to 0.008%, preferably about 0.005% by weight. It has been found that a concentration of benzalkonium chloride of 0.005% can be sufficient to preserve the compositions of the present disclosure from microbial attack.

In some embodiments, the agents of the present disclosure are delivered in soluble rather than suspension form, which allows for more rapid and quantitative absorption to the sites of action. In general, formulations such as jellies, creams, lotions, suppositories and ointments can provide an area with more extended exposure to the agents of the present disclosure, while formulations in solution, e.g., sprays, provide more immediate, short-term exposure.

In some embodiments relating to topical/local application, the pharmaceutical compositions can include one or more penetration enhancers. For example, the formulations can comprise suitable solid or gel phase carriers or excipients that increase penetration or help delivery of agents or combinations of agents of the disclosure across a permeability barrier, e.g., the skin. Many of these penetration-enhancing compounds are known in the art of topical formulation, and include, e.g., water, alcohols (e.g., terpenes like methanol, ethanol, 2-propanol), sulfoxides (e.g., dimethyl sulfoxide, decylmethyl sulfoxide, tetradecylmethyl sulfoxide), pyrrolidones (e.g., 2-pyrrolidone, N-methyl-2-pyrrolidone, N-(2-hydroxyethyl)pyrrolidone), laurocapram, acetone, dimethylacetamide, dimethylformamide, tetrahydrofurfuryl alcohol, L-α-amino acids, anionic, cationic, amphoteric or nonionic surfactants (e.g., isopropyl myristate and sodium lauryl sulfate), fatty acids, fatty alcohols (e.g., oleic acid), amines, amides, clofibric acid amides, hexamethylene lauramide, proteolytic enzymes, α-bisabolol, d-limonene, urea and N,N-diethyl-m-toluamide, and the like. Additional examples include humectants (e.g., urea), glycols (e.g., propylene glycol and polyethylene glycol), glycerol monolaurate, alkanes, alkanols, ORGELASE, calcium carbonate, calcium phosphate, various sugars, starches, cellulose derivatives, gelatin, and/or other polymers. In some embodiments, the pharmaceutical compositions can include one or more such penetration enhancers.

In some embodiments, the pharmaceutical compositions for local/topical application can include one or more antimicrobial preservatives such as quaternary ammonium compounds, organic mercurials, p-hydroxy benzoates, aromatic alcohols, chlorobutanol, and the like.

In some embodiments, the pharmaceutical compositions can be orally- or rectally delivered solutions, suspensions, ointments, enemas and/or suppositories comprising an agent or combination of agents of the present disclosure.

In some embodiments, the pharmaceutical compositions can be aerosol solutions, suspensions or dry powders comprising an agent or combination of agents of the present disclosure. The aerosol can be administered through the respiratory system or nasal passages. For example, one skilled in the art can recognize that a composition of the present disclosure can be suspended or dissolved in an appropriate carrier, e.g., a pharmaceutically acceptable propellant, and administered directly into the lungs using a nasal spray or inhalant. For example, an aerosol formulation comprising an agent can be dissolved, suspended or emulsified in a propellant or a mixture of solvent and propellant, e.g., for administration as a nasal spray or inhalant Aerosol formulations can contain any acceptable propellant under pressure, such as a cosmetically or dermatologically or pharmaceutically acceptable propellant, as conventionally used in the art.

An aerosol formulation for nasal administration is generally an aqueous solution designed to be administered to the nasal passages in drops or sprays. Nasal solutions can be similar to nasal secretions in that they are generally isotonic and slightly buffered to maintain a pH of about 5.5 to about 6.5, although pH values outside of this range can additionally be used. Antimicrobial agents or preservatives can also be included in the formulation.

An aerosol formulation for inhalations and inhalants can be designed so that the agent or combination of agents of the present disclosure is carried into the respiratory tree of the subject when administered by the nasal or oral respiratory route. Inhalation solutions can be administered, for example, by a nebulizer. Inhalations or insufflations, comprising finely powdered or liquid drugs, can be delivered to the respiratory system as a pharmaceutical aerosol of a solution or suspension of the agent or combination of agents in a propellant, e.g., to aid in disbursement. Propellants can be liquefied gases, including halocarbons, for example, fluorocarbons such as fluorinated chlorinated hydrocarbons, hydrochlorofluorocarbons, and hydrochlorocarbons, as well as hydrocarbons and hydrocarbon ethers.

Halocarbon propellants useful in the present disclosure include fluorocarbon propellants in which all hydrogens are replaced with fluorine, chlorofluorocarbon propellants in which all hydrogens are replaced with chlorine and at least one fluorine, hydrogen-containing fluorocarbon propellants, and hydrogen-containing chlorofluorocarbon propellants. Halocarbon propellants are described in Johnson, U.S. Pat. No. 5,376,359; Byron et al., U.S. Pat. No. 5,190,029; and Purewal et al., U.S. Pat. No. 5,776,434. Hydrocarbon propellants useful in the disclosure include, for example, propane, isobutane, n-butane, pentane, isopentane and neopentane. A blend of hydrocarbons can also be used as a propellant. Ether propellants include, for example, dimethyl ether as well as the ethers. An aerosol formulation of the disclosure can also comprise more than one propellant. For example, the aerosol formulation can comprise more than one propellant from the same class, such as two or more fluorocarbons; or more than one, more than two, more than three propellants from different classes, such as a fluorohydrocarbon and a hydrocarbon. Pharmaceutical compositions of the present disclosure can also be dispensed with a compressed gas, e.g., an inert gas such as carbon dioxide, nitrous oxide or nitrogen.

Aerosol formulations can also include other components, for example, ethanol, isopropanol, propylene glycol, as well as surfactants or other components such as oils and detergents. These components can serve to stabilize the formulation and/or lubricate valve components.

The aerosol formulation can be packaged under pressure and can be formulated as an aerosol using solutions, suspensions, emulsions, powders and semisolid preparations. For example, a solution aerosol formulation can comprise a solution of an agent of the disclosure in (substantially) pure propellant or as a mixture of propellant and solvent. The solvent can be used to dissolve the agent and/or retard the evaporation of the propellant. Solvents useful in the disclosure include, for example, water, ethanol and glycols. Any combination of suitable solvents can be use, optionally combined with preservatives, antioxidants, and/or other aerosol components.

An aerosol formulation can also be a dispersion or suspension. A suspension aerosol formulation can comprise a suspension of an agent or combination of agents of the instant disclosure. Dispersing agents useful in the disclosure include, for example, sorbitan trioleate, oleyl alcohol, oleic acid, lecithin and corn oil. A suspension aerosol formulation can also include lubricants, preservatives, antioxidant, and/or other aerosol components.

An aerosol formulation can similarly be formulated as an emulsion. An emulsion aerosol formulation can include, for example, an alcohol such as ethanol, a surfactant, water and a propellant, as well as an agent or combination of agents of the disclosure. The surfactant used can be nonionic, anionic or cationic. One example of an emulsion aerosol formulation comprises, for example, ethanol, surfactant, water and propellant. Another example of an emulsion aerosol formulation comprises, for example, vegetable oil, glyceryl monostearate and propane.

The compounds of the disclosure can be formulated for administration as suppositories. A low melting wax, such as a mixture of triglycerides, fatty acid glycerides, Witepsol S55 (trademark of Dynamite Nobel Chemical, Germany), or cocoa butter is first melted and the active component is dispersed homogeneously, for example, by stirring. The molten homogeneous mixture is then poured into convenient sized molds, allowed to cool, and to solidify.

The compounds of the disclosure can be formulated for vaginal administration. Pessaries, tampons, creams, gels, pastes, foams or sprays containing in addition to the active ingredient such carriers as are known in the art to be appropriate.

It is envisioned additionally, that the compounds of the disclosure can be attached releasably to biocompatible polymers for use in sustained release formulations on, in or attached to inserts for topical, intraocular, periocular, or systemic administration. The controlled release from a biocompatible polymer can be utilized with a water soluble polymer to form an instillable formulation, as well. The controlled release from a biocompatible polymer, such as for example, PLGA microspheres or nanospheres, can be utilized in a formulation suitable for intra ocular implantation or injection for sustained release administration, as well any suitable biodegradable and biocompatible polymer can be used.

In one aspect of the disclosure, the subject's carrier status of any of the genetic variation risk variants described herein, or genetic variants identified via other analysis methods within the genes or regulatory loci that are identified by the CNVs or SNVs described herein, can be used to help determine whether a particular treatment modality, such as any one of the above, or a combination thereof, should be administered. Whether a treatment option such as any of the above mentioned treatment options is administered can be determined based on the presence or absence of a particular genetic variation risk variant in the individual, or by monitoring expression of genes that are associated with the variants of the present disclosure. Expression levels and/or mRNA levels can thus be determined before and during treatment to monitor its effectiveness. Alternatively, or concomitantly, the status with respect to a genetic variation, and or genotype and/or haplotype status of at least one risk variant for PML presented herein can be determined before and during treatment to monitor its effectiveness. It can also be appreciated by those skilled in the art that aberrant expression levels of a gene impacted by a CNV or other mutations found as a consequence of targeted sequencing of the CNV-identified gene can be assayed or diagnostically tested for by measuring the polypeptide expression level of said aberrantly expressed gene. In another embodiment, aberrant expression levels of a gene may result from a CNV impacting a DNA sequence (e.g., transcription factor binding site) that regulates a gene whose aberrant expression level is involved in or causes PML, or other mutations found as a consequence of targeted sequencing of the CNV-identified gene regulatory sequence, can be assayed or diagnostically tested for by measuring the polypeptide expression level of the gene involved in or causative of PML. In some embodiments, a specific CNV mutation within a gene, or other specific mutations found upon targeted sequencing of a CNV-identified gene found to be involved in or causative of PML, may cause an aberrant structural change in the expressed polypeptide that results from said gene mutations and the altered polypeptide structure(s) can be assayed via various methods know to those skilled in the art.

Alternatively, biological networks or metabolic pathways related to the genes within, or associated with, the genetic variations described herein can be monitored by determining mRNA and/or polypeptide levels. This can be done for example, by monitoring expression levels of polypeptides for several genes belonging to the network and/or pathway in nucleic acid samples taken before and during treatment. Alternatively, metabolites belonging to the biological network or metabolic pathway can be determined before and during treatment. Effectiveness of the treatment is determined by comparing observed changes in expression levels/metabolite levels during treatment to corresponding data from healthy subjects.

In some embodiments, the genetic variations described herein and/or those subsequently found (e.g., via other genetic analysis methods such as sequencing) via targeted analysis of those genes initially identified by the genetic variations described herein, can be used to prevent adverse effects associated with a therapeutic agent, such as during clinical trials. For example, individuals who are carriers of at least one at-risk genetic variation can be more likely to respond negatively to a therapeutic agent, such as an immunosuppressive agent. For example, carriers of certain genetic variants may be more likely to show an adverse response to the therapeutic agent. In some embodiments, one or more of the genetic variations employed during clinical trials for a given therapeutic agent can be used in a companion diagnostic test that is administered to the patient prior to administration of the therapeutic agent to determine if the patient is likely to have a favorable or an adverse response to the therapeutic agent.

The genetic variations described herein can be used for determining whether a subject is administered a pharmaceutical agent, such as an immunosuppressive drug. Certain combinations of variants, including those described herein, but also combinations with other risk variants for PML, can be suitable for one selection of treatment options, while other variant combinations can be suitable for selection of other treatment options. Such combinations of variants can include one variant, two variants, three variants, or four or more variants, as needed to determine with clinically reliable accuracy the selection of treatment module. In another embodiment, information from testing for the genetic variations described herein, or other rare genetic variations in or near the genes described herein, may be combined with information from other types of testing (e.g., a JCV antibody test, CD62L test, or CSF IgM oligoclonal bands test) for selection of treatment options.

Kits

Kits useful in the methods of the disclosure comprise components useful in any of the methods described herein, including for example, primers for nucleic acid amplification, hybridization probes for detecting genetic variation, or other marker detection, restriction enzymes, nucleic acid probes, optionally labeled with suitable labels, allele-specific oligonucleotides, antibodies that bind to an altered polypeptide encoded by a nucleic acid of the disclosure as described herein or to a wild type polypeptide encoded by a nucleic acid of the disclosure as described herein, means for amplification of genetic variations or fragments thereof, means for analyzing the nucleic acid sequence of nucleic acids comprising genetic variations as described herein, means for analyzing the amino acid sequence of a polypeptide encoded by a genetic variation, or a nucleic acid associated with a genetic variation, etc. The kits can for example, include necessary buffers, nucleic acid primers for amplifying nucleic acids, and reagents for allele-specific detection of the fragments amplified using such primers and necessary enzymes (e.g., DNA polymerase). Additionally, kits can provide reagents for assays to be used in combination with the methods of the present disclosure, for example, reagents for use with other screening assays for PML.

In some embodiments, the disclosure pertains to a kit for assaying a nucleic acid sample from a subject to detect the presence of a genetic variation, wherein the kit comprises reagents necessary for selectively detecting at least one particular genetic variation in the genome of the individual. In some embodiments, the disclosure pertains to a kit for assaying a nucleic acid sample from a subject to detect the presence of at least one particular allele of at least one polymorphism associated with a genetic variation in the genome of the subject. In some embodiments, the reagents comprise at least one contiguous oligonucleotide that hybridizes to a fragment of the genome of the individual comprising at least genetic variation. In some embodiments, the reagents comprise at least one pair of oligonucleotides that hybridize to opposite strands of a genomic segment obtained from a subject, wherein each oligonucleotide primer pair is designed to selectively amplify a fragment of the genome of the individual that includes at least one genetic variation, or a fragment of a genetic variation. Such oligonucleotides or nucleic acids can be designed using the methods described herein. In some embodiments, the kit comprises one or more labeled nucleic acids capable of allele-specific detection of one or more specific polymorphic markers or haplotypes with a genetic variation, and reagents for detection of the label. In some embodiments, a kit for detecting SNP markers can comprise a detection oligonucleotide probe, that hybridizes to a segment of template DNA containing a SNP polymorphism to be detected, an enhancer oligonucleotide probe, detection probe, primer and/or an endonuclease, for example, as described by Kutyavin et al., (Nucleic Acid Res. 34:e128 (2006)). In other embodiments, the kit can contain reagents for detecting SNVs and/or CNVs.

In some embodiments, the DNA template is amplified by any means of the present disclosure, prior to assessment for the presence of specific genetic variations as described herein. Standard methods well known to the skilled person for performing these methods can be utilized, and are within scope of the disclosure. In one such embodiment, reagents for performing these methods can be included in the reagent kit.

In a further aspect of the present disclosure, a pharmaceutical pack (kit) is provided, the pack comprising a therapeutic agent and a set of instructions for administration of the therapeutic agent to humans screened for one or more variants of the present disclosure, as disclosed herein. The therapeutic agent can be a small molecule drug, an antibody, a peptide, an antisense or RNAi molecule, or other therapeutic molecules as described herein. In some embodiments, an individual identified as a non-carrier of at least one variant of the present disclosure is instructed to take the therapeutic agent. In one such embodiment, an individual identified as a non-carrier of at least one variant of the present disclosure is instructed to take a prescribed dose of the therapeutic agent. In some embodiments, an individual identified as a carrier of at least one variant of the present disclosure is instructed not to take the therapeutic agent. In some embodiments, an individual identified as a carrier of at least one variant of the present disclosure is instructed not to take a prescribed dose of the therapeutic agent. In some embodiments, an individual identified as a carrier of at least one variant of the present disclosure is instructed to take an agent that targets the JC Virus. For example, an individual identified as a carrier of at least one variant of the present disclosure can be instructed to take an agent that targets the JC Virus prior to or in conjunction with, taking an immunosuppressive agent.

Also provided herein are articles of manufacture, comprising a probe that hybridizes with a region of human chromosome as described herein and can be used to detect a polymorphism described herein. For example, any of the probes for detecting polymorphisms or genetic variations described herein can be combined with packaging material to generate articles of manufacture or kits. The kit can include one or more other elements including: instructions for use; and other reagents such as a label or an agent useful for attaching a label to the probe. Instructions for use can include instructions for screening applications of the probe for making a diagnosis, prognosis, or theranosis to PML in a method described herein. Other instructions can include instructions for attaching a label to the probe, instructions for performing in situ analysis with the probe, and/or instructions for obtaining a nucleic acid sample to be analyzed from a subject. In some cases, the kit can include a labeled probe that hybridizes to a region of human chromosome as described herein.

The kit can also include one or more additional reference or control probes that hybridize to the same chromosome or another chromosome or portion thereof that can have an abnormality associated with a particular endophenotype. A kit that includes additional probes can further include labels, e.g., one or more of the same or different labels for the probes. In other embodiments, the additional probe or probes provided with the kit can be a labeled probe or probes. When the kit further includes one or more additional probe or probes, the kit can further provide instructions for the use of the additional probe or probes. Kits for use in self-testing can also be provided. Such test kits can include devices and instructions that a subject can use to obtain a nucleic acid sample (e.g., buccal cells, blood) without the aid of a health care provider. For example, buccal cells can be obtained using a buccal swab or brush, or using mouthwash.

Kits as provided herein can also include a mailer (e.g., a postage paid envelope or mailing pack) that can be used to return the nucleic acid sample for analysis, e.g., to a laboratory. The kit can include one or more containers for the nucleic acid sample, or the nucleic acid sample can be in a standard blood collection vial. The kit can also include one or more of an informed consent form, a test requisition form, and instructions on how to use the kit in a method described herein. Methods for using such kits are also included herein. One or more of the forms (e.g., the test requisition form) and the container holding the nucleic acid sample can be coded, for example, with a bar code for identifying the subject who provided the nucleic acid sample.

In some embodiments, an in vitro screening test can comprise one or more devices, tools, and equipment configured to collect a nucleic acid sample from an individual. In some embodiments of an in vitro screening test, tools to collect a nucleic acid sample can include one or more of a swab, a scalpel, a syringe, a scraper, a container, and other devices and reagents designed to facilitate the collection, storage, and transport of a nucleic acid sample. In some embodiments, an in vitro screening test can include reagents or solutions for collecting, stabilizing, storing, and processing a nucleic acid sample.

Such reagents and solutions for nucleotide collecting, stabilizing, storing, and processing are well known by those of skill in the art and can be indicated by specific methods used by an in vitro screening test as described herein. In some embodiments, an in vitro screening test as disclosed herein, can comprise a microarray apparatus and reagents, a flow cell apparatus and reagents, a multiplex nucleotide sequencer and reagents, and additional hardware and software necessary to assay a nucleic acid sample for certain genetic markers and to detect and visualize certain genetic markers.

The present disclosure further relates to kits for using antibodies in the methods described herein. This includes, but is not limited to, kits for detecting the presence of a variant polypeptide in a test nucleic acid sample. One preferred embodiment comprises antibodies such as a labeled or labelable antibody and a compound or agent for detecting variant polypeptides in a nucleic acid sample, means for determining the amount or the presence and/or absence of variant polypeptide in the nucleic acid sample, and means for comparing the amount of variant polypeptide in the nucleic acid sample with a standard, as well as instructions for use of the kit. In certain embodiments, the kit further comprises a set of instructions for using the reagents comprising the kit.

Computer-Implemented Aspects

As understood by those of ordinary skill in the art, the methods and information described herein (genetic variation association with PML) can be implemented, in all or in part, as computer executable instructions on known computer readable media. For example, the methods described herein can be implemented in hardware. Alternatively, the method can be implemented in software stored in, for example, one or more memories or other computer readable medium and implemented on one or more processors. As is known, the processors can be associated with one or more controllers, calculation units and/or other units of a computer system, or implanted in firmware as desired. If implemented in software, the routines can be stored in any computer readable memory such as in RAM, ROM, flash memory, a magnetic disk, a laser disk, or other storage medium, as is also known. Likewise, this software can be delivered to a computing device via any known delivery method including, for example, over a communication channel such as a telephone line, the Internet, a wireless connection, etc., or via a transportable medium, such as a computer readable disk, flash drive, etc.

More generally, and as understood by those of ordinary skill in the art, the various steps described above can be implemented as various blocks, operations, tools, modules and techniques which, in turn, can be implemented in hardware, firmware, software, or any combination of hardware, firmware, and/or software. When implemented in hardware, some or all of the blocks, operations, techniques, etc. can be implemented in, for example, a custom integrated circuit (IC), an application specific integrated circuit (ASIC), a field programmable logic array (FPGA), a programmable logic array (PLA), etc.

Results from such genotyping can be stored in a data storage unit, such as a data carrier, including computer databases, data storage disks, or by other convenient data storage means. In certain embodiments, the computer database is an object database, a relational database or a post-relational database. Data can be retrieved from the data storage unit using any convenient data query method.

When implemented in software, the software can be stored in any known computer readable medium such as on a magnetic disk, an optical disk, or other storage medium, in a RAM or ROM or flash memory of a computer, processor, hard disk drive, optical disk drive, tape drive, etc. Likewise, the software can be delivered to a user or a computing system via any known delivery method including, for example, on a computer readable disk or other transportable computer storage mechanism.

The steps of the claimed methods can be operational with numerous other general purpose or special purpose computing system environments or configurations. Examples of well known computing systems, environments, and/or configurations that can be suitable for use with the methods or system of the claims include, but are not limited to, personal computers, server computers, hand-held or laptop devices, multiprocessor systems, microprocessor-based systems, set top boxes, programmable consumer electronics, network PCs, minicomputers, mainframe computers, distributed computing environments that include any of the above systems or devices, and the like.

The steps of the claimed method and system can be described in the general context of computer-executable instructions, such as program modules, being executed by a computer. Generally, program modules include routines, programs, objects, components, and/or data structures that perform particular tasks or implement particular abstract data types. The methods and apparatus can also be practiced in distributed computing environments where tasks are performed by remote processing devices that are linked through a communications network. In both integrated and distributed computing environments, program modules can be located in both local and remote computer storage media including memory storage devices. Numerous alternative embodiments could be implemented, using either current technology or technology developed after the filing date of this application, which would still fall within the scope of the claims defining the disclosure.

While the risk evaluation system and method, and other elements, have been described as preferably being implemented in software, they can be implemented in hardware, firmware, etc., and can be implemented by any other processor. Thus, the elements described herein can be implemented in a standard multi-purpose CPU or on specifically designed hardware or firmware such as an application-specific integrated circuit (ASIC) or other hard-wired device as desired. When implemented in software, the software routine can be stored in any computer readable memory such as on a magnetic disk, a laser disk, or other storage medium, in a RAM or ROM of a computer or processor, in any database, etc. Likewise, this software can be delivered to a user or a screening system via any known or desired delivery method including, for example, on a computer readable disk or other transportable computer storage mechanism or over a communication channel, for example, a telephone line, the internet, or wireless communication. Modifications and variations can be made in the techniques and structures described and illustrated herein without departing from the spirit and scope of the present disclosure.

Unless otherwise explained, all technical and scientific terms used herein have the same meaning as commonly understood by one of ordinary skill in the art to which this disclosure belongs. The following references contain embodiments of the methods and compositions that can be used herein: The Merck Manual of Diagnosis and Therapy, 18th Edition, published by Merck Research Laboratories, 2006 (ISBN 0-911910-18-2); Benjamin Lewin, Genes IX, published by Jones & Bartlett Publishing, 2007 (ISBN-13: 9780763740634); Kendrew et al., (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8).

Standard procedures of the present disclosure are described, e.g., in Maniatis et al., Molecular Cloning: A Laboratory Manual, Cold Spring Harbor Laboratory Press, Cold Spring Harbor, N.Y., USA (1982); Sambrook et al., Molecular Cloning: A Laboratory Manual (2 ed.), Cold Spring Harbor Laboratory Press, Cold Spring Harbor, N.Y., USA (1989); Davis et al., Basic Methods in Molecular Biology, Elsevier Science Publishing, Inc., New York, USA (1986); or Methods in Enzymology: Guide to Molecular Cloning Techniques Vol. 152, S. L. Berger and A. R. Kimmerl (eds.), Academic Press Inc., San Diego, USA (1987)). Current Protocols in Molecular Biology (CPMB) (Fred M. Ausubel, et al., ed., John Wiley and Sons, Inc.), Current Protocols in Protein Science (CPPS) (John E. Coligan, et al., ed., John Wiley and Sons, Inc.), Current Protocols in Immunology (CPI) (John E. Coligan, et al., ed. John Wiley and Sons, Inc.), Current Protocols in Cell Biology (CPCB) (Juan S. Bonifacino et al., ed., John Wiley and Sons, Inc.), Culture of Animal Cells: A Manual of Basic Technique by R. Ian Freshney, Publisher: Wiley-Liss; 5th edition (2005), and Animal Cell Culture Methods (Methods in Cell Biology, Vol. 57, Jennie P. Mather and David Barnes editors, Academic Press, 1st edition, 1998), which are all incorporated by reference herein in their entireties.

It should be understood that the following examples should not be construed as being limiting to the particular methodology, protocols, and compositions, etc., described herein and, as such, can vary. The following terms used herein is for the purpose of describing particular embodiments only, and is not intended to limit the scope of the embodiments disclosed herein.

Disclosed herein are molecules, materials, compositions, and components that can be used for, can be used in conjunction with, can be used in preparation for, or are products of methods and compositions disclosed herein. It is understood that when combinations, subsets, interactions, groups, etc. of these materials are disclosed and while specific reference of each various individual and collective combinations and permutation of these molecules and compounds cannot be explicitly disclosed, each is specifically contemplated and described herein. For example, if a nucleotide or nucleic acid is disclosed and discussed and a number of modifications that can be made to a number of molecules including the nucleotide or nucleic acid are discussed, each and every combination and permutation of nucleotide or nucleic acid and the modifications that are possible are specifically contemplated unless specifically indicated to the contrary. This concept applies to all aspects of this application including, but not limited to, steps in methods of making and using the disclosed molecules and compositions. Thus, if there are a variety of additional steps that can be performed it is understood that each of these additional steps can be performed with any specific embodiment or combination of embodiments of the disclosed methods, and that each such combination is specifically contemplated and should be considered disclosed.

Those skilled in the art can recognize, or be able to ascertain using no more than routine experimentation, many equivalents to the specific embodiments of the method and compositions described herein. Such equivalents are intended to be encompassed by the following claims.

It is understood that the disclosed methods and compositions are not limited to the particular methodology, protocols, and reagents described as these can vary. It is also to be understood that the terminology used herein is for the purpose of describing particular embodiments only, and is not intended to limit the scope of the present disclosure which can be limited only by the appended claims.

Unless defined otherwise, all technical and scientific terms used herein have the meanings that would be commonly understood by one of skill in the art in the context of the present specification.

It should be noted that as used herein and in the appended claims, the singular forms "a," "an," and "the" include plural reference unless the context clearly dictates otherwise. Thus, for example, reference to "a nucleotide" includes a plurality of such nucleotides; reference to "the nucleotide" is a reference to one or more nucleotides and equivalents thereof known to those skilled in the art, and so forth.

The term "and/or" shall in the present context be understood to indicate that either or both of the items connected by it are involved. While preferred embodiments of the present disclosure have been shown and described herein, it can be obvious to those skilled in the art that such embodiments are provided by way of example only. Numerous variations, changes, and substitutions can now occur to those skilled in the art without departing from the disclosure. It should be understood that various alternatives to the embodiments of the disclosure described herein can be employed in practicing the disclosure. It is intended that the following claims define the scope of the disclosure and that methods and structures within the scope of these claims and their equivalents be covered thereby.

EXAMPLES

Example 1

Experimental Approach

In the present study, a set of genes were identified, deleterious variants within which increase susceptibility to PML. The relevant genes were discovered on the basis of a combined CNV plus sequence analysis approach. Two sets of genes were compiled (see Table 6 and corresponding description):
  A. A set based on a detailed literature review of genes involved in the immune system and JC virus biology, along with genes described in the context of PML via case reports.
  B. A set based on the observation of rare CNVs within the PML cohort.

A non-redundant list of 419 genes was generated (see Table 6), which contains 245 curated from immune deficiency (immunodeficiency) reviews (Table 6, 'Public_db'), 169 identified via rare CNVs using the methods described herein (Table 6, 'PBio'), and 6 genes that were found using both methods (Table 6, 'Both'). See Table 6 and description below for further information).

Using this set of 419 genes, it was determined whether:
  Rare CNVs were present that might explain the susceptibility to PML;
  Rare sequence variants (determined via whole exome sequencing analysis—WES) were present that might explain the susceptibility to PML;
  Combinations of CNVs, SNVs and/or CNVs and SNVs might explain the susceptibility;
  Individual variants might be present at higher frequency in the PML cohort (variant burden analysis—Tables 14, 15);
  Total numbers of heterozygous, damaging variants were high for any specific genes (gene burden analysis—Table 13).

In all cases, due consideration was given to:
Pathogenic/deleterious nature of the variants observed (e.g., whether gene function was highly likely to be affected);
Rarity of the variants or variant combinations (e.g., those that would be expected to be present in 1% or less of the normal population were considered);
Ethnicity of the PML cases to account for potential frequency differences in one population subgroup vs. another. Ethnicities (e.g., ancestry) for the PML patients are reported in Table 7. For Sample_ID identifiers beginning with 'MVGS', ethnicities were not reported but all patients were from the USA and their ethnicities were assumed to be of European (EUR) ancestry. However, PML case MVGS811-13a is potentially of African (AFR) ancestry on the basis of common SNVs that are also found in PML cases known to be of AFR ancestry. In one embodiment, ethnic-specific frequency data from the ExAC database was used to assess relative frequencies of variants found in PML patients vs. an unselected population (ExAC subjects). ExAC ethnicities were designated as follows: African/African American (AFR), Latino (LAT, also known as AMR), East Asian (EAS), Finnish (FIN), Non-Finnish European (EUR, also known as NFE), South Asian (SAS), and Other (OTH). For some PML cases reported in Table 7, the ethnicities were alternately reported as Subsaharan, North African (MGB), Caribbean (CAR), or Hispanic (HISP). For interpretation of variants found in these patients, the assignments of ancestry using ExAC db designations were as follows: AFR=MGB or Subsaharan; LAT=CAR or HISP. Ancestry was unknown for two PML cases (PML02 and PML28) and, for frequency interpretation purposes (using ExAC db), they were assumed to be of European (EUR) ancestry.

While the primary genetic mechanism that was considered was autosomal recessive (AR) inheritance, a number of solutions were based on autosomal dominant (AD) inheritance but only in cases for which prior evidence was found that heterozygous variants in the relevant gene had previously been associated with an immune deficiency syndrome. It can be appreciated by those skilled in the art that some genes may contain both AR and AD model pathogenic variants (e.g., see Table 6 entries marked as 'AD_AR' in the 'Disease_Model' column).

For AR inheritance (~40% of genes in Table 6 fall into this category, AR or AD_AR), the following were considered:
  Homozygous or compound heterozygous gene-disruptive CNVs;
  Homozygous or compound heterozygous sequence variants; i.e. single nucleotide variants (SNVs). Compound heterozygosity was only inferred when either phasing was available or one of the pairs of SNVs was itself homozygous;
  Compound heterozygosity for a CNV and SNV. Such calls were only possible in cases for which the SNV was in trans to a deletion (e.g., DUSP16 SNV in Table 10 and the CNV in Table 1).

Example 2

Copy Number Variant (CNV) Analysis

The data presented herein was generated on the basis of a comparison of copy number variants (CNVs) identified in 2 cohorts:
  1) 1,005 Normal individuals (Normal Variation Engine—NVE);
  2) 71 Progressive Multifocal Leukoencephalopathy (PML) cases along with 6 Human Immunodeficiency Virus (HIV) cases without a diagnosis of PML (in order to aid in distinguishing germline variants vs. acquired variants that result from HIV infection). Total cohort size=77.

Genomic DNA sample hybridization—NVE and PML, HIV Cohorts

Genomic DNA samples from individuals within the Normal cohort (NVE 'test' subjects, also referred to as 'NVE cases' in some tables herein) and from the PML, HIV cohort (PML, HIV 'test' subjects) were hybridized against a single, sex-matched reference individual. Reference DNA samples were labeled with Cy5 and test subject DNA samples were labeled with Cy3. After labeling, samples were combined and co-hybridized to Agilent 1M feature oligonucleotide microarrays, design ID 021529 (Agilent Product Number G4447A) using standard conditions (array Comparative Genomic Hybridization—aCGH). Post-hybridization, arrays were scanned at 2 µm resolution, using Agilent's DNA microarray scanner, generating tiff images for later analysis.

All tiff images were analyzed using Agilent Feature Extraction (FE) software, with the following settings:
  Human Genome Freeze:hg18:NCBI36:Mar2006
  FE version: 10.7.3.1
  Grid/design file: 021529_D_F_20091001
  Protocol: CGH_107_Sep09

This procedure generates a variety of output files, one of which is a text-tab delimited file, containing ~1,000,000 rows of data, each corresponding to a specific feature on the array. This *.txt file was used to perform CNV calling using DNAcopy, an open source software package implemented in R via BioConductor (http://www.bioconductor.org/packages/release/bioc/html/DNAcopy.html). Heterozygous losses (het_loss), homozygous losses (hom_loss) or gains were determined according to a threshold log 2ratio, which was set at:
  hom_loss min=−1000;
  hom_loss max=−2;
  het_loss min=−2;
  het_loss max=−0.5;
  gain min=0.5;
  gain max=1000;

With very few exceptions, all CNVs with a log 2ratio value between −0.5 and +0.5 were not considered. All log 2ratio values were determined according to Cy3/Cy5 (Test/Reference). A minimum probe threshold for CNV-calling was set at 2 (2 consecutive probes were sufficient to call a CNV). A CNV list was generated for each individual in the 3 cohorts (NVE, PML, and HIV).

Using custom scripts, CNVs identified in the NVE and PML cohorts (many of which appeared in multiple individuals) were (separately) 'merged' into master lists of non-redundant CNV-subregions, according to the presence or absence of the CNV-subregion in individuals within the cohort. Using this approach, the NVE-master lists have:

| | |
|---|---|
| 7778 | het_loss |
| 653 | hom_loss |
| 4862 | gain | distinct CNV-subregions, respectively. The PML+HIV cohort of 77 individuals master lists contained:

| | |
|---|---|
| 2523 | het_loss |
| 314 | hom_loss |
| 1639 | gain | distinct CNV-subregions, respectively.

Those skilled in the art can appreciate that CNVs can be acquired in an individual's genome that are not inherited. Such 'acquired CNVs' often occur in a tissue specific manner, such as in solid tumors compared to a patient's normal tissue. In blood-derived genomic DNA samples, which are what was used for both the NVE and PML subjects in the studies described herein, acquired CNVs can be the result of blood cancers such as leukemia and lymphoma, but also due to HIV infection. Many of the PML cases in this study had HIV as their primary disease (see Table 7). In order to aid in the interpretation of acquired vs. germline CNVs, an HIV sub-cohort of 6 cases was included in the primary, genome-wide CNV comparison but rare CNVs in the 6 HIV (non-PML) cases were not considered as relevant to PML susceptibility. The purpose of generating data on the 6 HIV cases was to determine whether some changes seen in PML patients who developed the disorder on a background of HIV (PML/HIV) were likely related to the underlying HIV and not the PML susceptibility itself. In other words, the HIV cases served as a general control for the large number of PML/HIV cases.

For example, consider 3 individuals within the NVE cohort with the following hypothetical CNVs: Chr1:1-100,000; Chr1:10,001-100,000; and Chr1:1-89,999. In the master list, these would be merged into 3 distinct CNV subregions, as follows:

| | | |
|---|---|---|
| CNV-subregion 1 | Chr1: 1-10,000 | Subjects A, C |
| CNV-subregion 2 | Chr1: 10,001-89,999 | Subjects A, B, C |
| CNV-subregion 3 | Chr90,000: 1-100,000 | Subjects A, B |

Comparison of the corresponding NVE and PML master lists of CNV-subregions was performed (het_loss versus het_loss, hom_loss versus hom_loss and gain versus gain), resulting in a combined file with totals for NVE and PML for each distinct CNV-subregion in the study.

The data are subsequently curated as follows (The example calculation below was based on an original PML cohort of 80 cases, of which 6 are non-PML HIV controls and 3 PML cases that were duplicate samples. In some instances, the OR and FET values reported in Table 2 were used as 'relative' guidelines when considering the relevance of a CNV. In nearly all instances, a CNV was considered as a potential cause or contributing factor to PML if it was absent from the NVE database of CNVs).

Annotation using custom designed scripts in order to attach relevant information to each CNV region regarding overlap with known genes and exons, overlap with genes involved in the immune system and overlap with regulatory regions, including transcription factor binding sites.
  A calculation of the odds ratio (OR) and Fishers Exact test (FET) for each CNV-subregion, according to the following formula:

$OR=(PML/(77-PML))/(NVE/(1005-NVE))$ where:
    PML=number of PML individuals with CNV-subregion of interest
    NVE=number of NVE individuals with CNV-subregion of interest As an illustrative example, consider the CNV subregion gain involving chr2:55764753-55771586, which is found in 3 individuals in the PML cohort and 1 individual in the NVE cohort (see Table 2). The OR is: (3/74)/(1/1004)=40.7

Note that, by one convention, if either of NVE or PML=0, a value of 0.5 is added to all 4 entries in the main formula above, in order to avoid dealing with infinities (see Deeks and Higgins, Statistical algorithms in Review Manager 5, Statistical Methods Group of The Cochrane Collaboration, (2010)). This has the effect of artificially lowering OR values in cases where no individuals within the NVE have the CNV. This method is applicable to all the calculations in Table 2. This method is also used when calculating the Fisher's 2-tailed Exact Test (FET) in the event that any one of the variables is zero. For convenience in analysis, the sub-cohort of 6 HIV (non-PML) cases were retained in Table 2. Therefore, the OR values reported in Table 2 are slightly different from the OR calculations for the actual number of PML cases (n=71). Using the example above for a CNV-subregion gain involving chr2:55764753-55771586, the actual OR using 71 PML cases vs. 1005 NVE subjects was: (3/68)41/(1004)=44.29. In some instances, a non-PML HIV control (see Table 11, identified as 3280, 3281, 3283, 3284, 3285, and 3286) is found to have a CNV of potential relevance in PML subjects. This can also impact the OR calculation. For example, for CNV-subregion loss chr19: 55247874-55250186 the OR in Table 2 is listed as 17.38 but one case is a non-PML HIV control (Table 11, PML70_control=3280). For this example, the actual OR using 71 PML cases vs. 1005 NVE subjects, and excluding the non-PML HIV case, was: (4/67)/(4/(1001)=14.94.

The CNV-subregions/genes that are listed herein (e.g., in one or more of Tables 1-4), fulfill one of the following criteria:

Strong biology linking the gene that a CNV-subregion impacts or is near, with known immune deficiency pathways/mechanisms or biology in PML (e.g., JC virus related biology). That is, in some cases, statistical evidence is lacking but does not exclude the CNV-subregion as a candidate;

Statistical analysis combined with medium to strong biology (e.g., links in the peer-reviewed literature to PML, JC virus, host defense, immune deficiency, or neuropathology) without obvious biological connection (best FET in this category was 3.25E-10);

It can be appreciated by those skilled in the art that the number of PML candidate CNV-subregions, irrespective of category, may increase or decrease as additional PML cohorts are analyzed.

Example 3

Whole Exome Sequencing (WES) and Case Level Analysis

WES data was obtained on a total of 70 PML cases (non-PML HIV cases were not sequenced—they were used simply to help in the interpretation of complex CNVs observed in PML patients who also had HIV).

Variant annotation reports were further interrogated against the full set of genes detailed above. Synonymous variants and variants predicted to be modifiers (outside coding regions) were not considered. For all other variants, further filtering was performed so that only those predicted by at least one in silico prediction algorithm (e.g., Polyphen2, SIFT, MutationTaster) to be pathogenic were considered for further evaluation. Finally, only variants or variant combinations that would be expected to be present in 1% or less of the normal population were evaluated for case level analysis (Tables 7-10). Data from the Exome Aggregation Consortium (ExAC) was used to obtain ethnic-specific frequency data for variants under consideration (see, Lek et al., Nature, 17; 536(7616):285-91) (2016)).

Example 4

Description of Sequence Data

The sequence file 33655-710.101_ST25.txt contains genomic sequence information for (in the following order):

A. All distinct CNVs listed in Table 1;

B. The full genomic extent of the transcripts listed in Table 4;

C. Sequence variants detailed in Table 5.

D. The full genomic extent of the transcripts listed in Table 12

Note that:

1. SEQ_ID 1-172 are the CNV sequences from Table 1;

2. SEQ_ID 173-455 are the transcript sequences from Table 4;

3. SEQ_ID 1000-1329 are the sequence variants from Table 5;

4. SEQ_ID 1500-2177 are the transcript sequences from Table 12.

Examples of sequences submitted:

Sequence entry starts:

TABLE 1

SEQ_ID 1 = 49,653 bp CNV (het_loss) at chr1: 1086119-1135772 involving genes MIR200A, MIR200B, MIR429, TNFRSF18, TTLL10:

```
<210> 1
<211> 49654
<212> DNA
<213> Homo sapiens
<400> 1
cttctggggt ctaaggccag aagtgacctt tcttctcacg gaggcacccc cacatcacag         60
gccccaagct cccaccagga gtcccaggc agcaggtttt ccaccacagc cgggaagagc        120
cccgccttca ccacccacca ccagccaatc ccgagaccac cgaagccccc agaccgggcc       180
. . . (sequence truncated for brevity)
gattcccgca cggccgggga cggccccagg gccttgggag cgtctgtgga cacctgtggt     49560
gtgggccgag gagctgggag ctcatctgaa cacgccagca ctcgcgcatc cacgctgctg     49620
gcggatgcct gggtttctcc actgtggggc cacg                                 49654
```

Sequence entry ends.
Sequence entry starts:

TABLE 4

SEQ_ID 173 = MIR200B, transcript NR_029639, which is 95 bp in length:

```
<210> 173
<211> 95
<212> DNA
```

TABLE 4-continued

SEQ_ID 173 = MIR200B, transcript NR_029639, which is 95 bp in length:

<213> Homo sapiens
<400> 173
ccagctcggg cagccgtggc catcttactg ggcagcattg gatggagtca ggtctctaat 60
actgcctggt aatgatgacg gcggagccct gcacg 95

Sequence entry ends.
Sequence entry starts:

TABLE 5

SEQ_ID 1148 = chr 9: 304628 reference allele = G;
alternate allele = A

<210> 1148
<211> 40
<212> DNA
<213> Homo sapiens
<220>
<221> variant
<222> (20) . . . (20)
<223> G→A
<400> 1148
tttaaaaaga ctggatctcg aaaagatttt cacaagacgc 40

Sequence entry ends.
Sequence entry starts:

TABLE 12

SEQ_ID 1500 = ACADM, transcript NM_000016, which is 39,313 bp in length:

<210> 1500
<211> 39313
<212> DNA
<213> Homo sapiens
<400> 1500
cgcaagtccc cccaccgttc agcgcaaccg ggccctccca gccccgccgc cgtcccctc 60
ccccgccctg gctctcttttc cgcgctgcgg tcagcctcgg cgtcccacag agagggccag 120
. . . (sequence truncated for brevity)
gtaatagtgt atatttcttg tatttactat gatgaaaaaa ggtcgtttta attttgaatt 39240
gaataaagtt acctgttcat tttttattag atattttaaa gacttcagaa aatataaata 39300
tgaaataatt taa 39313

Sequence entry ends.

Example 5

Those skilled in the art can appreciate that genes can be impacted by acquired or germline genetic variants (e.g., CNVs), wherein each gene has the potential to contain genetic variants that are acquired (e.g., via a disease process such as HIV infection, or cancers such as leukemia and lymphoma) or present in the germ line (e.g., inherited from a parent or are de novo, i.e. not inherited from a parent). In FIG. 1, the PRKCB gene was impacted by germ line variants in 2 PML cases and acquired variants in 6 PML cases. The invention described herein is focused on detection of germline variants that are present in PML patient genomes. Therefore, no solutions/explanations for a given patient's PML was based on an acquired CNV, although another PML patient could potentially be 'solved' by one or two germline rare variants impacting the gene.

For this PRKCB example, no CNV-based solutions were found (an AR model was assumed), but 1 SNV solution is reported in Table 8 (het SNV, an AD model is assumed for this PML case). Further supporting evidence was assessed for the PRKCB gene by performing String analysis (high confidence=0.7, 1st shell=up to 10 interactors; string-db.org; see Szklarczyk et al., (2015), and references therein). String analysis showed that PRKCB interacts with PML-419 genes CARD11, IKBKB, and RBCK1 (see Table 6).

In FIG. 2, both TNFRSF13C and CENPM are disrupted and/or gained by a set of acquired CNV gains. Acquired CNVs can be very complex, such as the high copy number gains often identified in tumor-derived DNA samples (as compared to the patient's normal genome). In the PML gene discovery described herein, blood-derived genomic DNA obtained from several PML-diagnosed HIV patients, or PML cases with a primary disease of leukemia and lymphoma (reported as 'Other' in Table 7), showed complex genomic changes (e.g., gains exhibiting a dup-trip-dup pattern). In some PML cases, the acquired gains passed the log 2 ratio cutoff (>0.5) that was selected for this study, but in other PML cases the log 2 ratios for the gains were <0.5 and this data was filtered out from the main analyses that were performed to ascertain rare germline CNVs.

In one embodiment of the invention, a set of 6 non-PML HIV cases (3 African ancestry, 3 European ancestry) were used to aid in the interpretation of whether a CNV was an acquired or germline event. The non-PML 'PML cases' are labeled with '_control' in Table 11 and correspond to 'PML-_Case_ID' numbers 3280, 3281, 3283, 3284, 3285, and 3286. While some CNVs are reported in Tables 1 and 2 for this set of non-PML control HIV subjects, none of these genetic findings were used to nominate a gene discovered on the basis of rare CNVs (as compared to the NVE db) as a potential PML gene (PBio genes reported in Table 6). In other words, these rare CNVs were only used to aid in determining if a particular genomic region containing multiple overlapping CNVs was potentially due to an acquired genetic event. Those skilled in the art can appreciate that the set of experiments described herein do not necessarily fully rule in or out that a given genomic region contained only acquired CNVs vs. only germline CNVs (i.e. it's possible that the same region can contain an acquired CNV in one individual and a germline CNV in another).

For the CNV data shown in FIG. 2, both the TNFRSF13C and CENPM genes were included in PML-419 gene list (Table 6) on the basis of their immune or neurological related biology reported in the literature. No CNV or SNV PML solutions were found for these two genes, but String analysis (high confidence=0.7, 1st shell=up to 10 interactors) shows that TNFRSF13C interacts with PML-419 genes TRAF3 (Table 7 solution) and TNFRSF13B (Table 8 solution), as well as BTK (a known PML gene, see Table 6).

Figure 3:
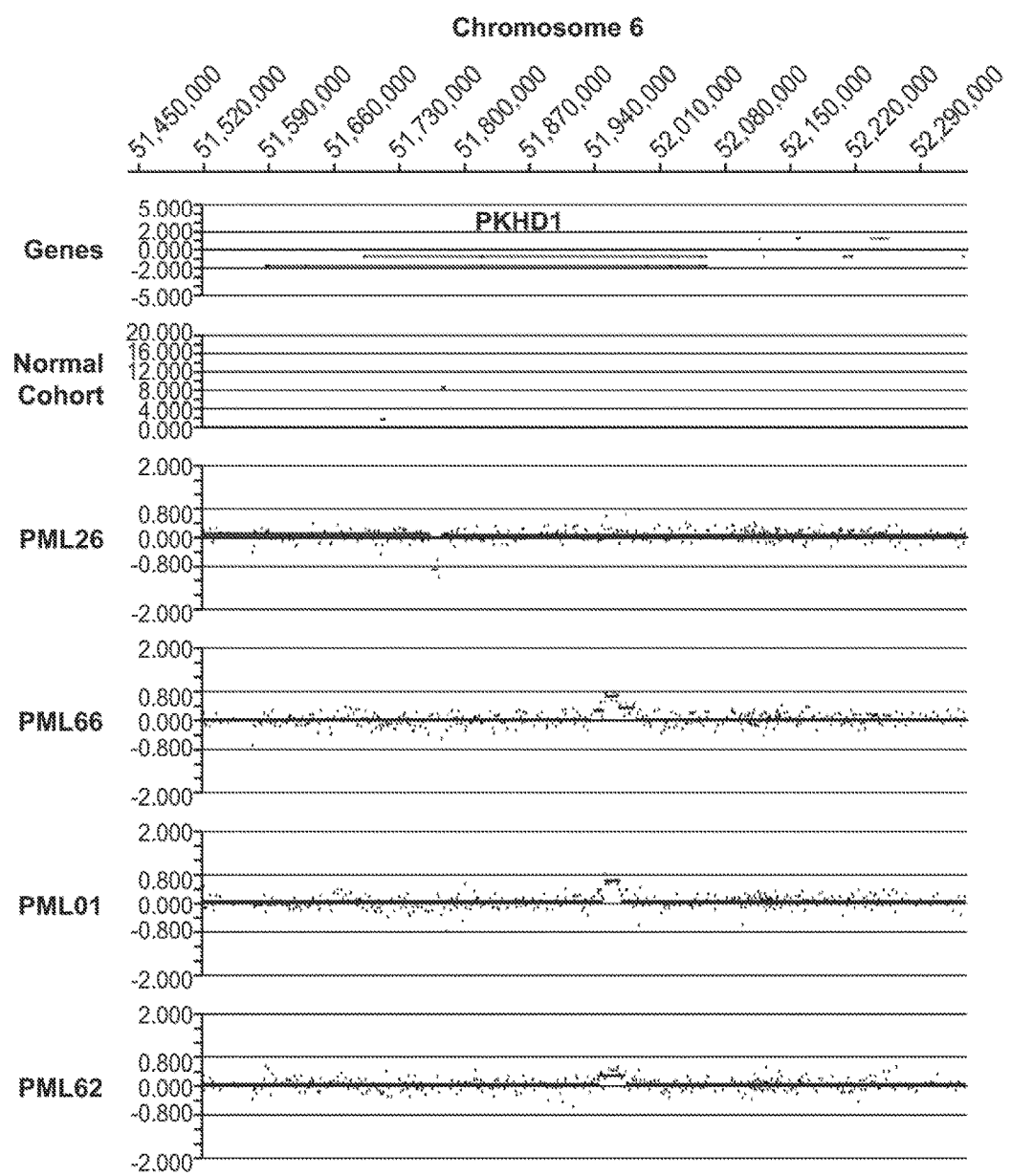
FIG. 3 represents an example of a gene (PKHD1) impacted by germline and acquired CNVs.

FIG. 3 shows another example of a gene that is impacted by both germline and acquired CNVs. While no PML cases were solved on the basis of the acquired or germline CNVs shown to impact the PKHD1 gene, nomination of this gene to Table 6 on the basis of its biology resulted in finding 3 potential alternate solutions (AR model) for 3 other PML cases (see Table 8). However, String analysis (high confidence=0.7, 1st shell=up to 10 interactors) did not reveal any PML-419 gene interactions with PKHD1.

Example 6

Those skilled in the art can appreciate that an AR disease model would involve ascertaining whether both alleles (for a gene or genetic locus) are impacted by a genetic variant in individuals affected by the disorder. The types of genetic variants can be SNVs, CNVs, indels, etc. In the study describe herein, if an AR disease model was invoked for a gene (see Table 6), we assessed the PML patient's CGH data for CNVs (heterozygous or homozygous) and their exome data for SNVs (heterozygous or homozygous). Thus, each patient may be solved for one of the PML-419 genes (Table 6) with one of the following scenarios: homozygous deletion, homozygous duplication (log 2 ratio will appear comparable to that typically found for triplications), homozygous SNV, compound heterozygous SNVs, compound heterozygous CNVs, or compound heterozygous SNV and CNV. Those skilled in the art know that, for an AR disease mechanism, a pathogenic SNV or CNV may have appreciable frequency in the general population (e.g., up to 1% frequency) with little to no impact on the individual's health, but when present with a second pathogenic variant on the other allele, can cause disease.

Figure 4:
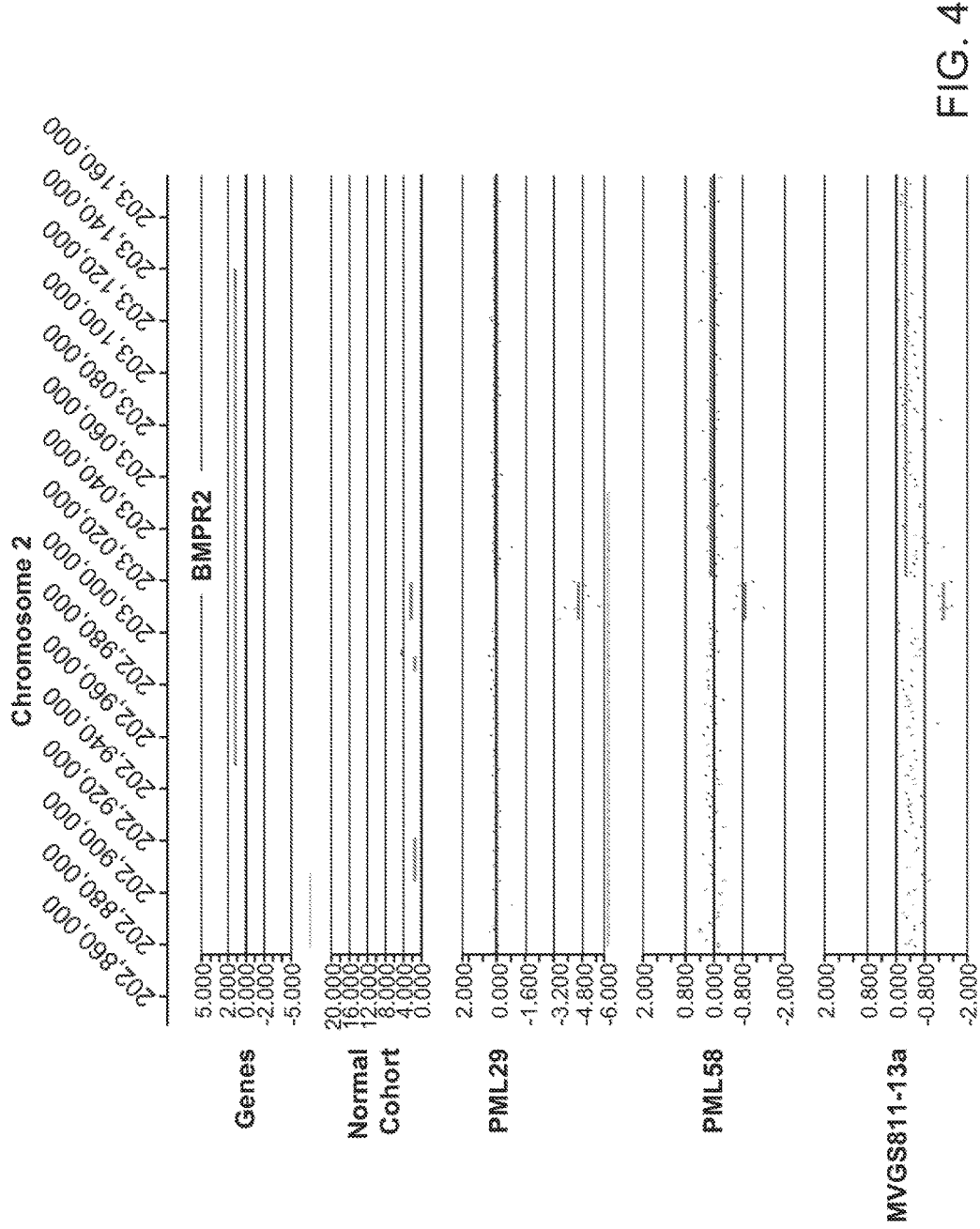
FIG. 4 represents an example of a gene (BMPR2) impacted by a recurrent CNV (homozygous and heterozygous losses).

FIG. 4 shows an example of a recurrent intronic loss impacting the BMPR2 gene. Patient PML29 was found to have a homozygous deletion, whereas as patients PML58 and MVGS811-13a have a heterozygous deletion. Assuming an AR disease model, no SNV solutions were found for this gene; however, PML29 is potentially solved due to the homozygous deletion that was detected. While immune-related biology is reported for studies on BMPR2 (see Table 6), String analysis (high confidence=0.7, 1st shell=up to 10 interactors) did not reveal any PML-419 gene interactions with BMPR2.

Figure 5:
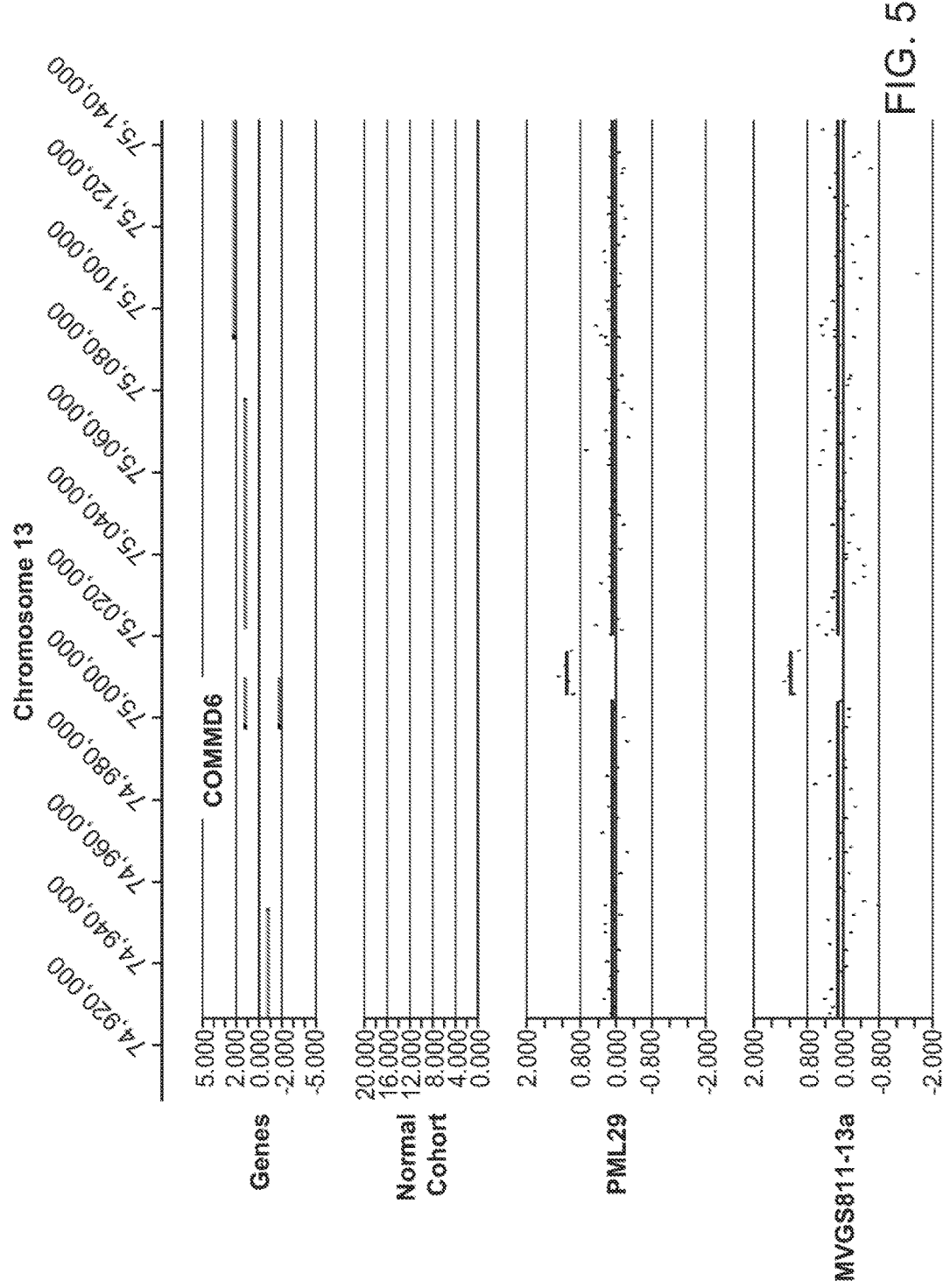
FIG. 5 represents an example of a gene (COMMD6) impacted by a recurrent CNV (e.g., homozygous duplication).

FIG. 5 shows an example of a recurrent exonic gain that disrupts the COMMD6 gene. Two PML patients were found to have homozygous duplications of this CNV. Interestingly, while String analysis (high confidence=0.7, 1st shell=up to 10 interactors) did not reveal any PML-419 gene interactions with COMMD6, recent studies (see Table 6, PMIDs 25355947 and 27441653) show a potential link between COMMD6 and known PML gene WAS via the WASH gene.

Figure 6:
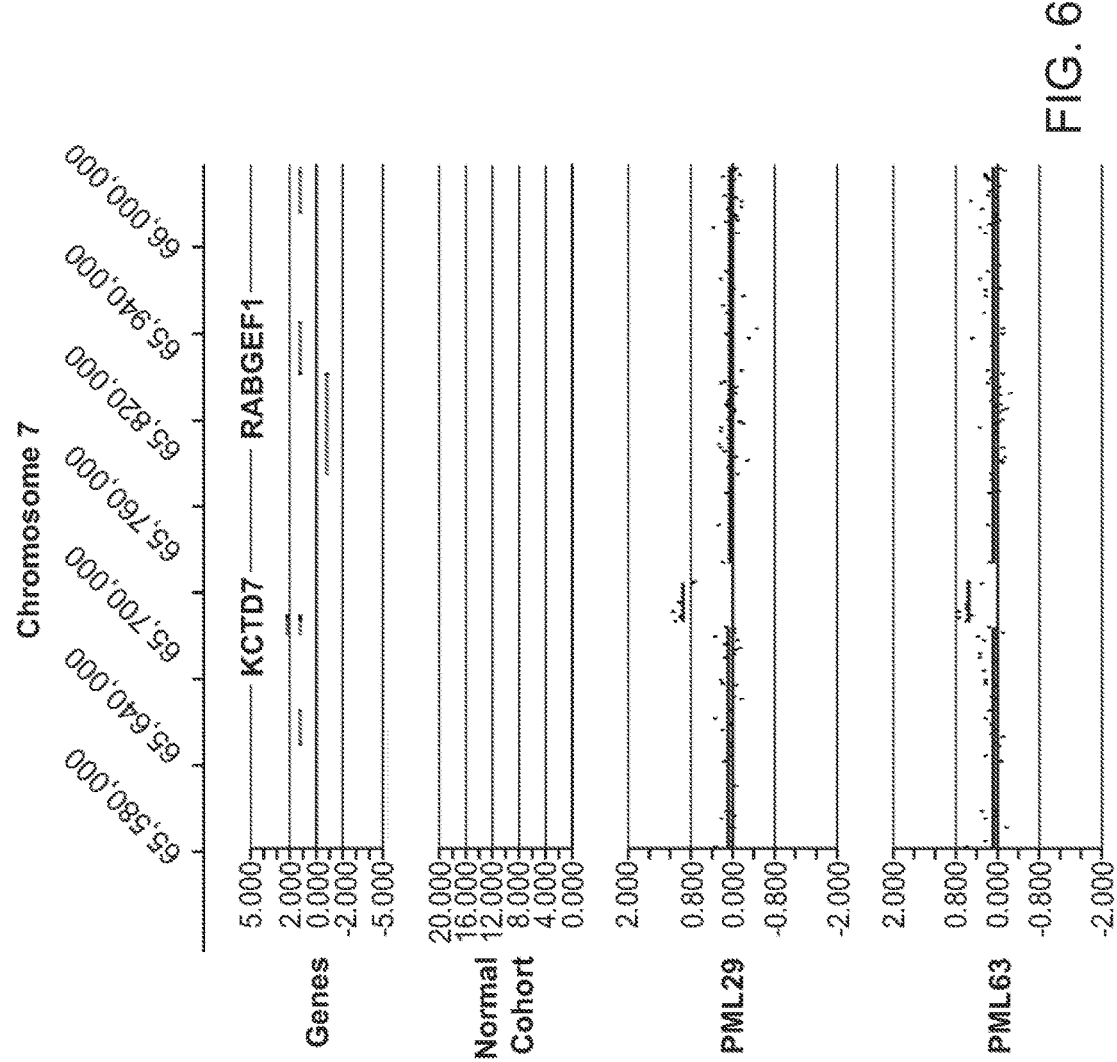
FIG. 6 represents an example of genes (KCTD7, RAB-GEF1) directly and potentially impacted by a recurrent CNV (e.g., homozygous duplication).

FIG. 6 shows an example of a recurrent exonic gain that disrupts the KCTD7 gene and its right breakpoint is upstream of RABGEF1 (i.e. one or both genes may be causing/contributing to PML). A recently annotated non-coding RNA (see hg19 assembly, LOC100996437) may also be impacted by this CNV. Both genes have immune and neurological links (see Table 6) and since patient PML29 has a homozygous duplication, it was added as a PML solution in Table 7. String analysis (high confidence=0.7, 1st shell=up to 10 interactors) did not reveal any PML-419 gene interactions for either gene, but they are linked together in a joint String analysis.

Figure 7:
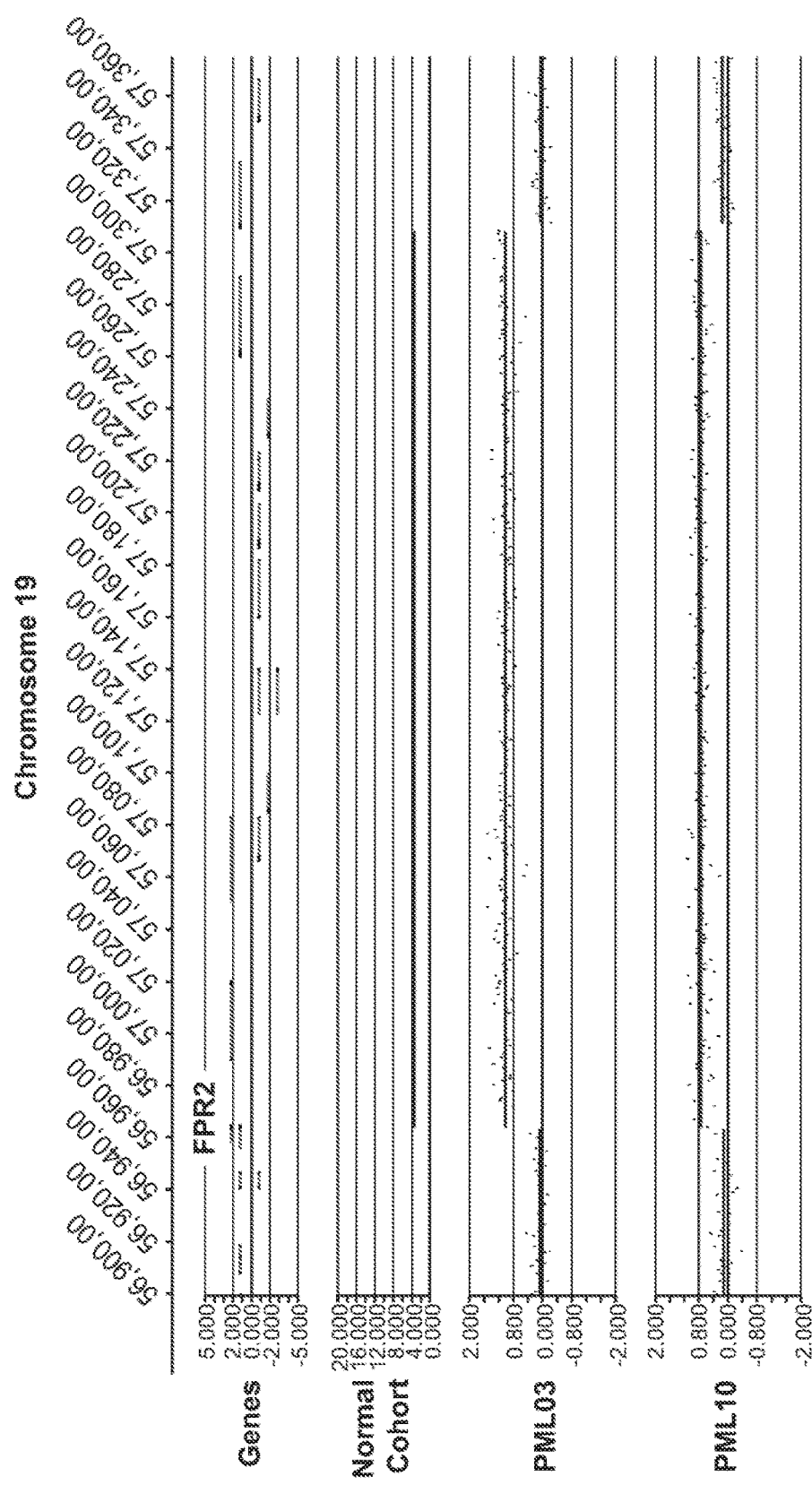
FIG. 7 represents an example of a gene (FPR2) impacted by a recurrent CNV (e.g., homozygous duplication).

FIG. 7 shows an example of a recurrent gain that disrupts FPR2 (left breakpoint) and ZNF616 (right breakpoint, gene not labeled), and other genes are fully encompassed by this CNV. There is strong supporting biology for FPR2 (see Table 6) and it is listed as a PML solution in Table 7. String analysis (high confidence=0.7, 1st shell=up to 10 interactors) did not reveal any PML-419 gene interactions for FPR2, but a joint analysis of Table 7 genes did reveal an interaction (see FIG. 13).

Figure 8:
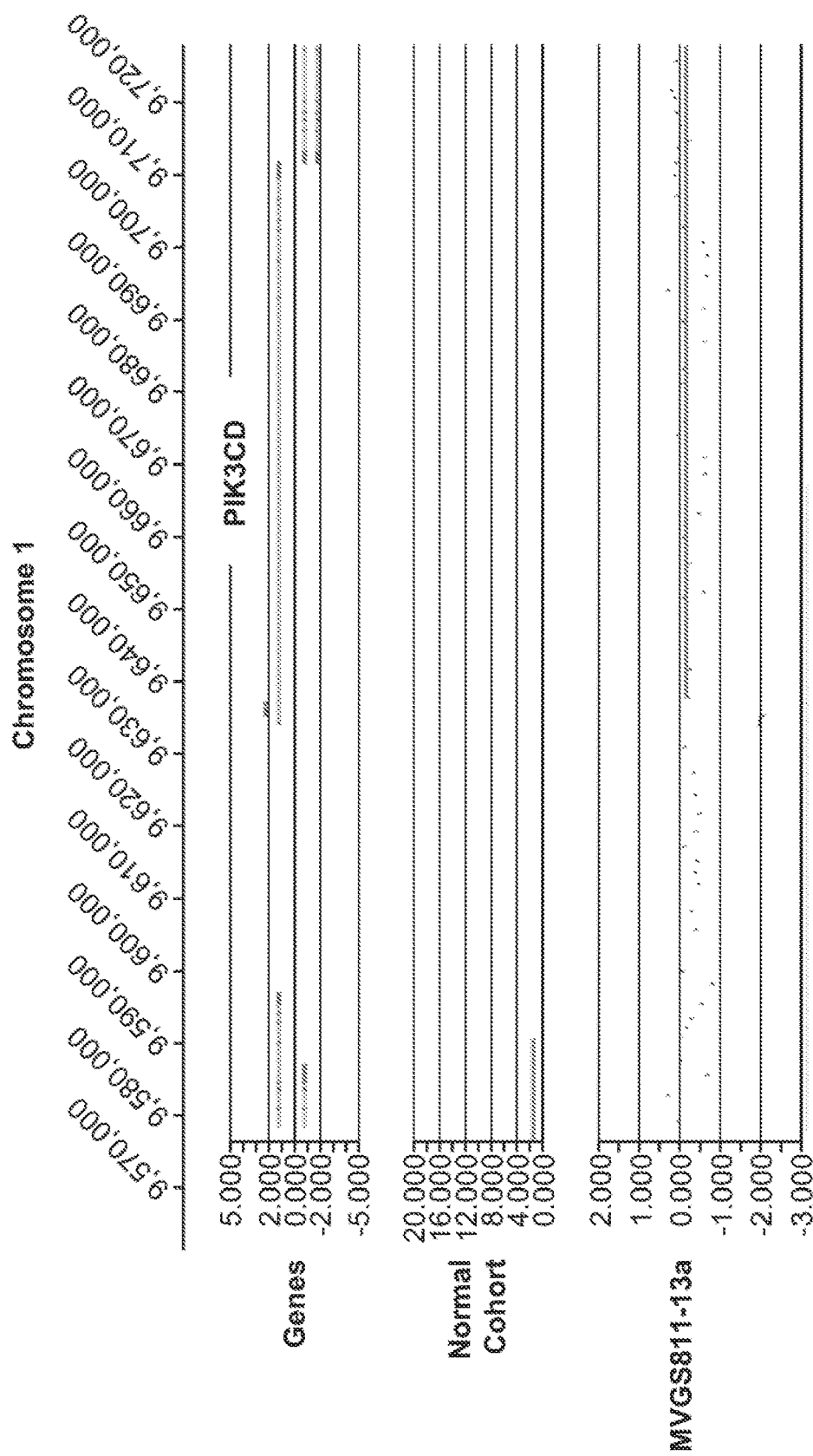
FIG. 8 represents an example of a gene (PIK3CD) impacted by a CNV (e.g., homozygous loss).

FIG. 8 shows an example of an exonic loss impacting the PIK3CD and PIK3CD-AS1 genes. Patient MVGS811-13a has a homozygous deletion and is reported as a solution in Table 7 based on the strong immune-related biology for PIK3CD (see Table 6). String analysis (high confidence=0.7, 1st shell=up to 10 interactors) reveals PML-419 gene interactions for PTEN and PIK3R1.

Example 7

A subset of the rare CNVs found in our PML study were located in intergenic regions. While those skilled in the art can appreciate that intergenic variants (CNVs, SNVs, etc.) can have long range effects on the expression of genes (e.g., gene regulatory elements can be located several kilobases away from the genes under their influence), in our study we assumed that intergenic CNVs were potentially impacting one or both adjacent genes if they were located <~100 Kb away, either upstream or downstream. The ENCODE project has revealed a wealth of information, such as transcription factor binding sites, and rare CNVs that were identified in the study herein were checked for their potential impact on these sites (hg19 assembly ENCODE annotation was checked) and were often found to impact transcription factor binding sites and/or were located in conserved DNA regions.

Figure 9:
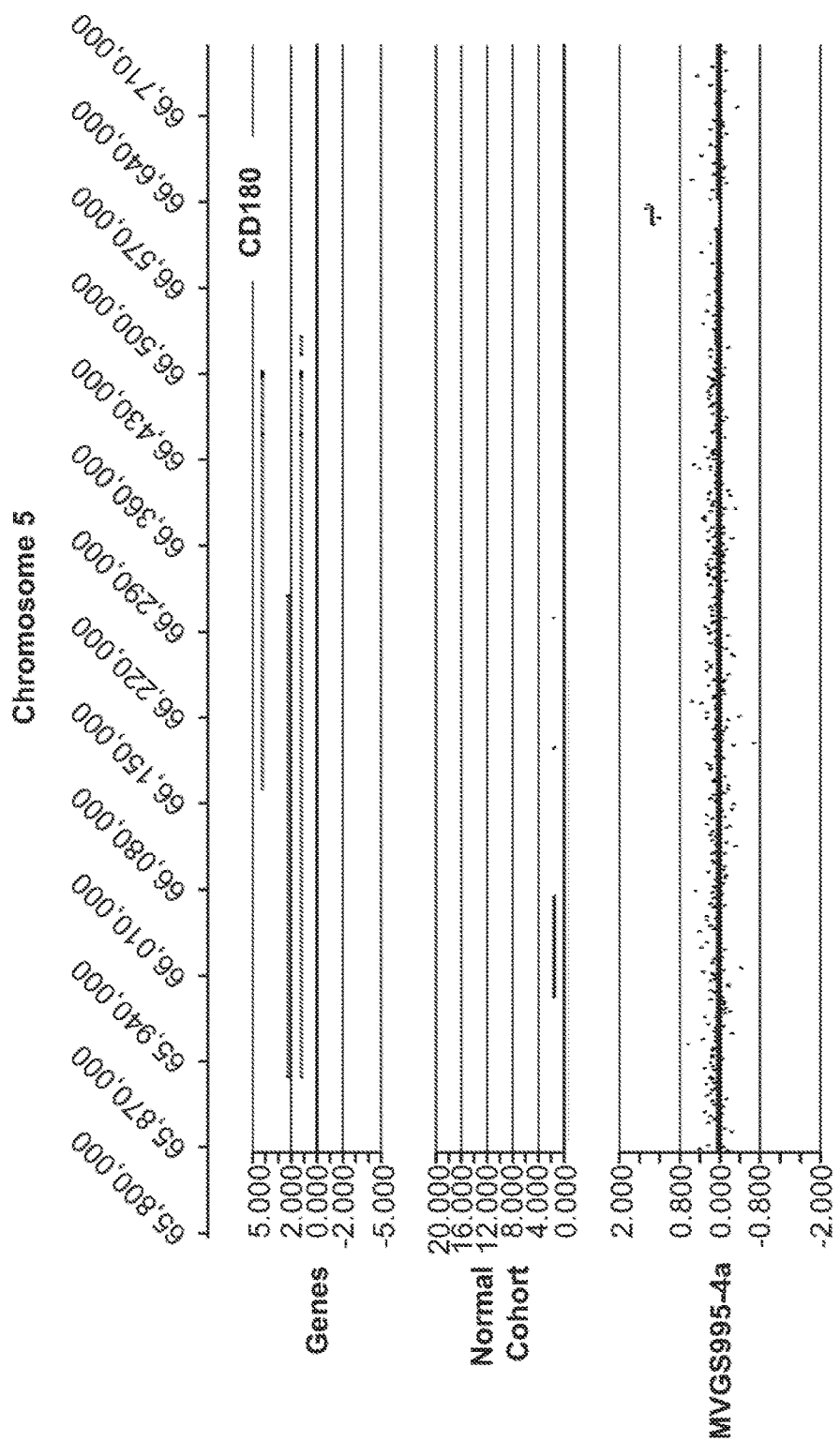
FIG. 9 represents an example of a gene (CD180) potentially impacted by an intergenic CNV gain (e.g., homozygous duplication).

FIG. 9 shows an intergenic, recurrent gain that is upstream of CD180. Patient MVGS995-4a has a homozygous duplication and, while not considered as a PML solution in Table 7, is potentially an alternate solution that may be causing or contributing to the patient's PML based on altered expression of CD180. The gene has immune-related biology (see Table 6) and String analysis (high confidence=0.7, 1st shell=up to 10 interactors) reveals a PML-419 gene interaction with PLCG2 (see Table 7, 2 PML cases have a solution for this gene).

Figure 10:
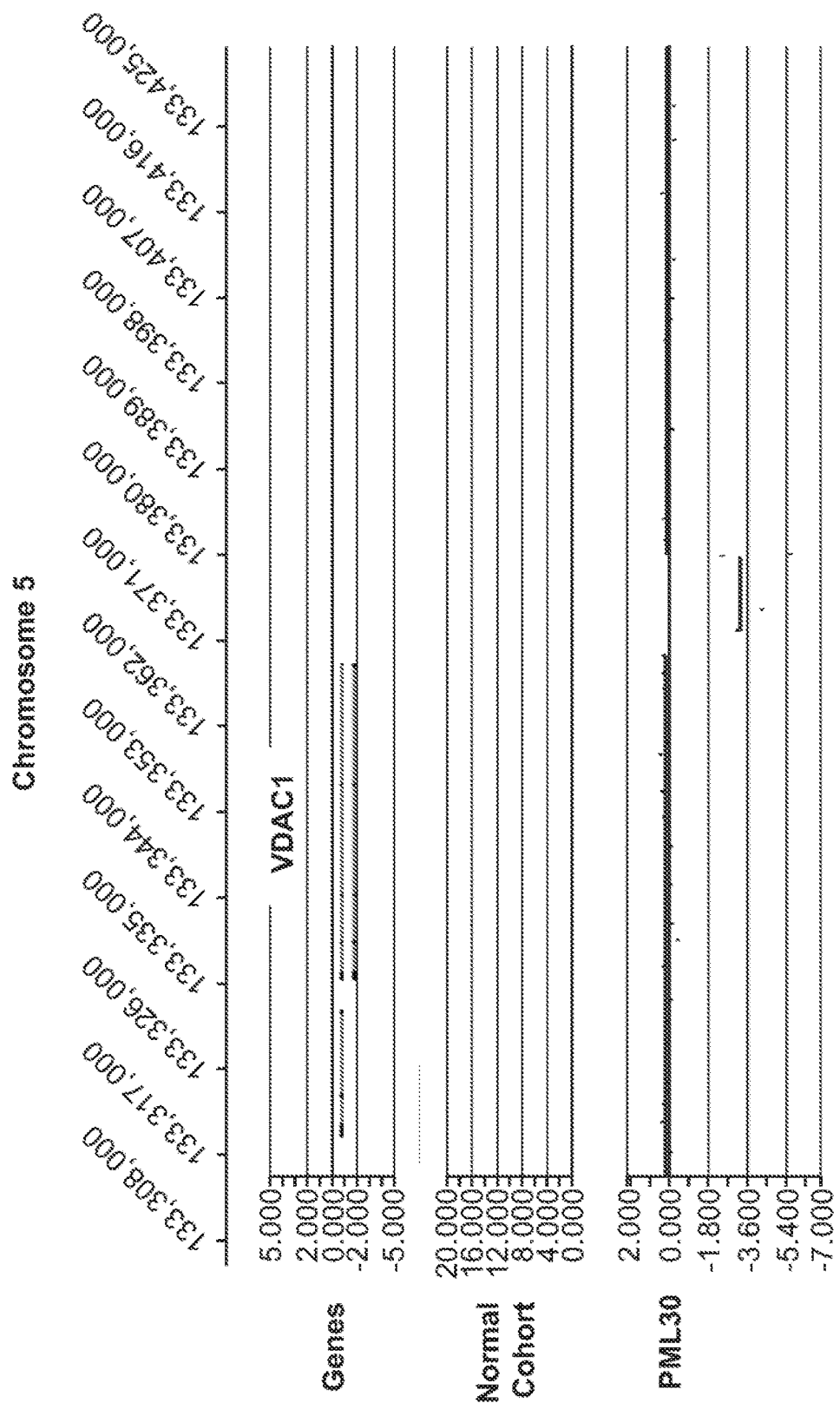
FIG. 10 represents an example of a gene (VDAC1) potentially impacted by an intergenic CNV (homozygous loss).

FIG. 10 shows an intergenic, recurrent loss that is upstream of VDAC1. Patient PML30 has a homozygous deletion and, while not considered as a PML solution in Table 7, is potentially an alternate solution that may be causing or contributing to the patient's PML based on altered expression of VDAC1. String analysis (high confidence=0.7, 1st shell=up to 10 interactors) did not reveal any PML-419 gene interactions for VDAC1.

Figure 11:
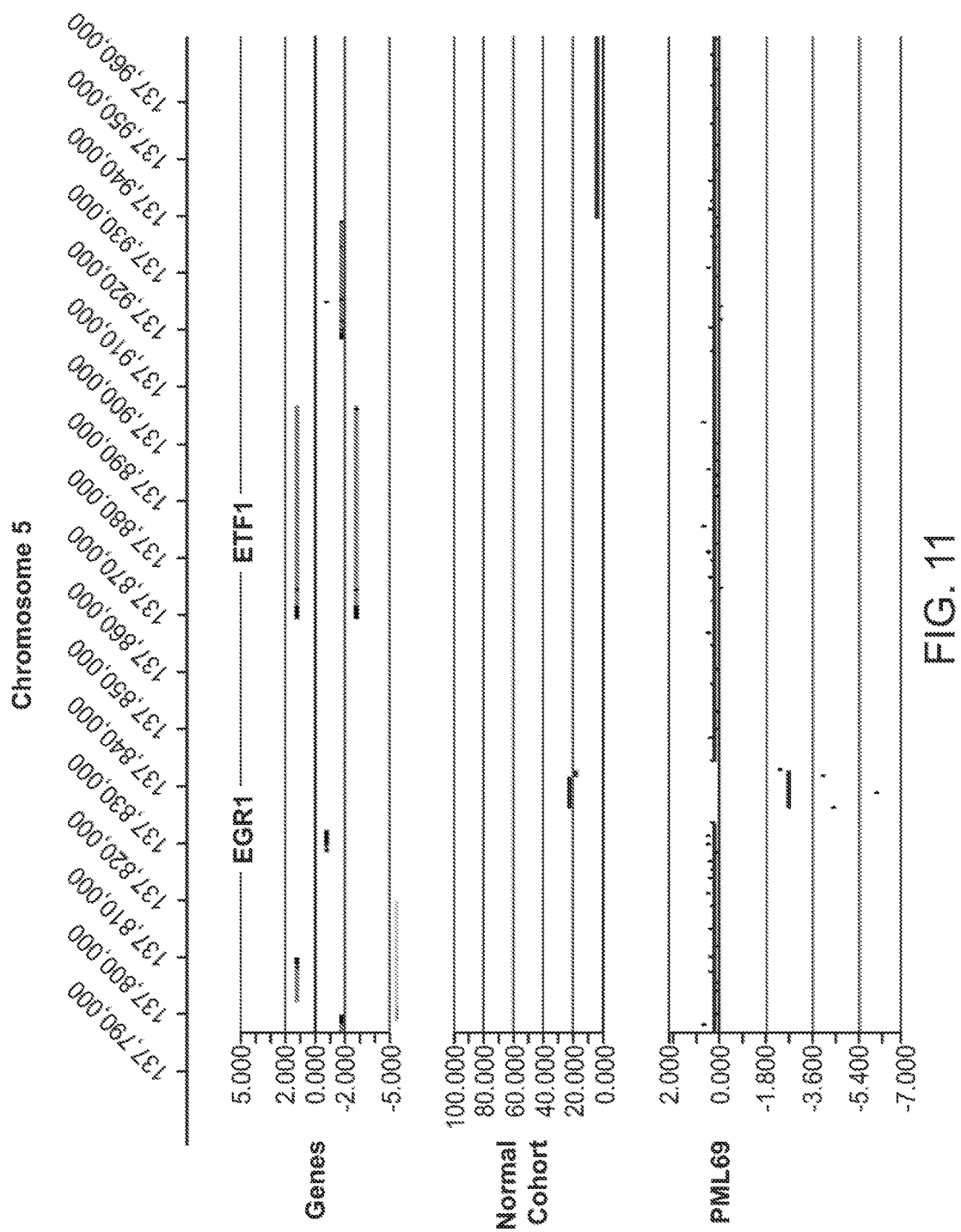
FIG. 11 represents an example of genes (EGR1 and ETF1) potentially impacted by an intergenic CNV (homozygous loss).

FIG. 11 shows an intergenic, recurrent loss that is downstream of EGR1 and ETF1. Patient PML69 has a homozygous deletion and, based on links for EGR1 to PML-419 genes (Table 6) and its proximity to EGR1 (~4 Kb away), it was added as a potential PML solution in Table 7. String analysis (high confidence=0.7, 1st shell=up to 10 interactors) reveals PML-419 gene interactions with JUN, PTEN, and TP53), but nothing of note was found for String analysis of ETF1.

Figure 12:
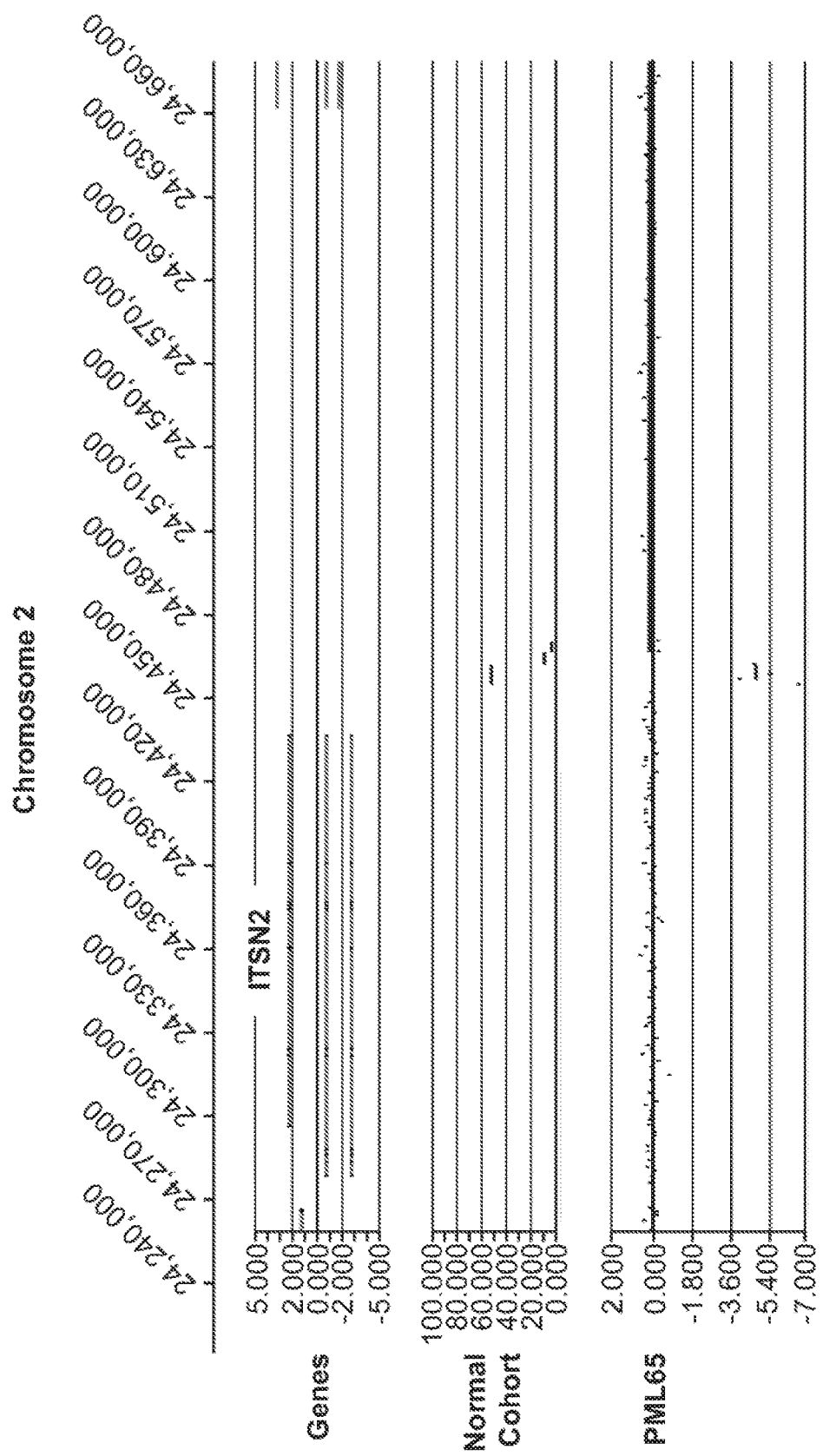
FIG. 12 represents an example of a gene (ITSN2) potentially impacted by an intergenic CNV (homozygous loss).

FIG. 12 shows an intergenic, recurrent loss that is upstream of ITSN2. Patient PML65 has a homozygous deletion and, based on links for ITSN2 to a known PML gene (WAS) in the PML-419 gene list (Table 6), it was added as a potential PML solution in Table 7. Interestingly, another PML case was found to have a rare homozygous SNV in ITSN2, so this gene has 2 PML solutions reported in Table 7. String analysis (high confidence=0.7, 1st shell=up to 10 interactors) did not reveal any PML-419 gene interactions.

Example 8

Pathway analyses, such as protein-protein interactions, are providing valuable insights into the underlying biology for complex diseases. While PML is a very rare disease that requires several concurrent factors (e.g., infection by the JC virus), multiple genes may be independently causing or increasing the risk of developing this neurodegenerative disorder based on the presence of a genetic variant in a given gene (e.g., a heterozygous variant wherein one deleterious variant is present on the maternally or paternally inherited allele, a homozygous variant wherein the same deleterious variant is present on both alleles, or compound heterozygous variants wherein a pair of deleterious variants are present but one is found on the maternally inherited allele and the other is found on the paternally inherited allele). As hypothesized, presence of an immune deficiency genetic disorder was another prerequisite. Indeed, in the PML study described herein, 43 genes were proposed as solutions for 61 of 71 PML cases (see Table 7) that were assessed using array CGH and whole exome sequencing. Numerous algorithms and associated databases have been developed to investigate molecular pathways, such as String (see, Szklarczyk et al., (2015), and references therein).

Figure 13:
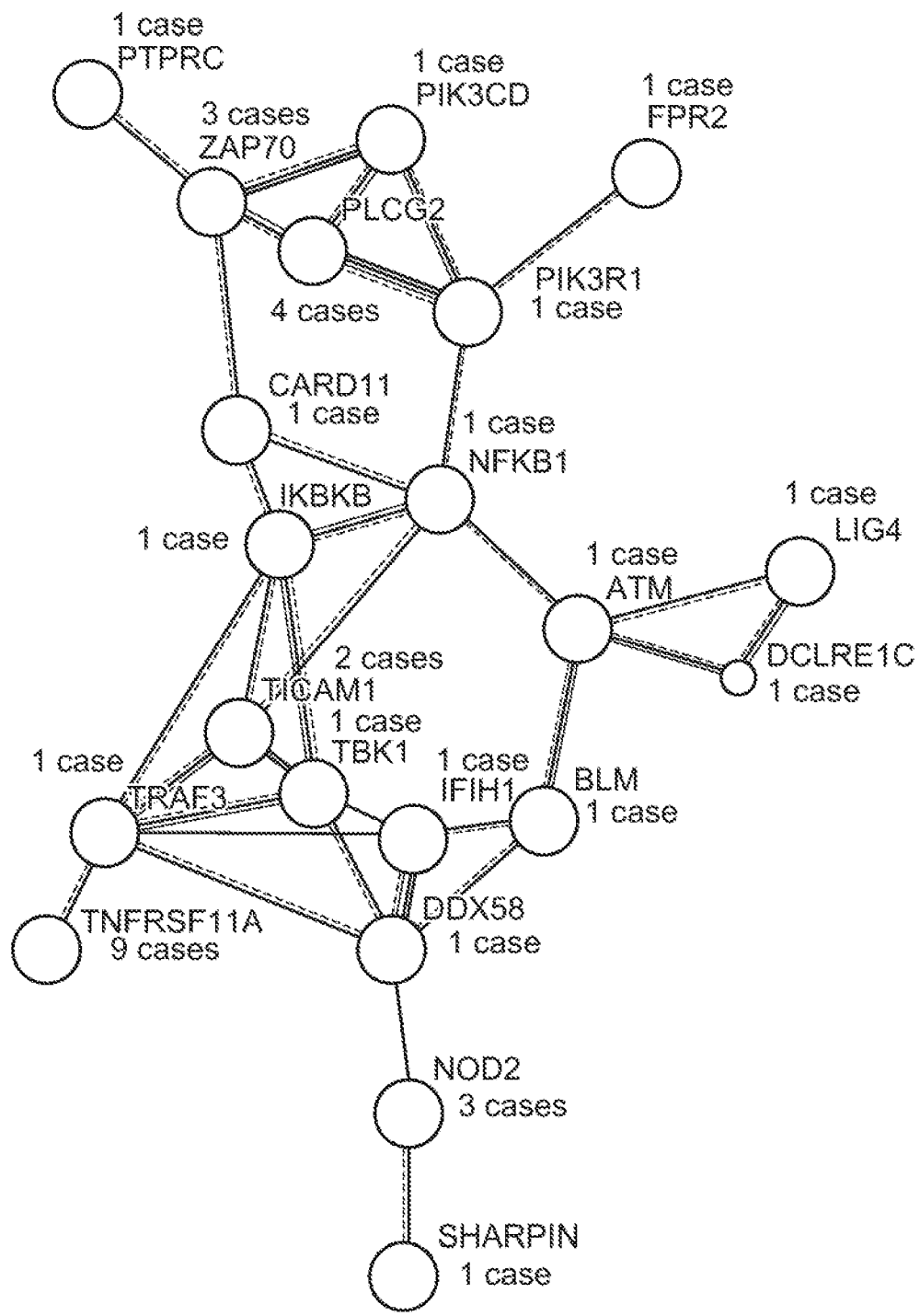
FIG. 13 represents an example of known and/or predicted protein interactions using the String database for 21 of 43 genes (non-redundant list) reported in Table 7. The number of PML cases found to harbor variants impacting a given gene is indicated next to each gene.

FIG. 13 shows an example of String analysis performed on the 43 genes considered as PML solutions on the basis of an AD or AR disease model. A series of interactions were found for 21 of 43 genes, and in several instances this included interactions for genes implicated in 2 or more PML cases that are reported in Table 7 (9 cases for TNFRSF11A, 4 cases for PLCG2, 3 cases for ZAP70 and NOD2, and 2 PML cases for TICAM1).

Example 9

To determine the likelihood that a randomly selected individual would harbor one of the variants described herein, the following analysis was performed: For each variant or combination of variants, the ethnic-specific frequency quoted in Table 7 was used to determine the probability that a randomly selected individual of the same ethnicity would be expected not to harbor the variant or combination of variants. The product of all such probabilities was calculated (e.g., the probability that a randomly selected individual would not harbor any of the variants) and subtracted from 1, yielding the probability that a random individual would harbor at least one of the variants. It was found that, for HIV cases, the probability of a random individual harboring at least one of the variants was ~5%, which is consistent with the pre-HAART risk of PML in the context of HIV. For non-HIV cases (mostly MS/NTZ), the risk was ~1%, which, again, is consistent with the risk of PML in MS/NTZ, especially after long-term therapy.

These analyses support the notion that the frequencies of the variants identified as relevant to PML risk are consistent with the actual observed risks for unselected individuals. The analyses are predicated on the reasonable assumption that there is no PML-relevant connection with the risk of developing HIV (an acquired infection) and/or MS (e.g., this implies that treatment of healthy individuals with Natalizumab, for example, would result in similar risks of PML). Any deviations (e.g., variants found in a slightly higher number of normal individuals than expected according to the numbers actually observed to be affected by PML) may be due to: penetrance (e.g., not everyone with the variants will be at maximal risk of PML); the assumption that individuals with MS, HIV and other underlying conditions represented a normal (e.g., with respect to PML risk) cross-section of the general population, prior to developing the underlying disorders HIV, MS etc; and under ascertainment of PML, even in patients with HIV, MS/NTZ.

Example 10

Tables Referenced in this Study

TABLE 1

CNVs of interest in this study

| Chr | Original CNV Start | Original CNV Stop | Original CNV Size | CNV Type | PML Case ID | RefSeq Gene Symbol | SEQ ID |
|---|---|---|---|---|---|---|---|
| 1 | 1086119 | 1135772 | 49653 | het_loss | 3009 | MIR200A, MIR200B, MIR429, TNFRSF18, TTLL10 | 1 |
| 1 | 9634094 | 9635206 | 1112 | hom_loss | 3009 | PIK3CD | 2 |
| 1 | 12018512 | 12032581 | 14069 | gain | 3205 | | 3 |
| 1 | 19593401 | 19602807 | 9406 | het_loss | 3203 | CAPZB | 4 |
| 1 | 21695957 | 21700243 | 4286 | het_loss | 3161 | | 5 |
| 1 | 24364786 | 24391166 | 26380 | gain | 3199 | IFNLR1 | 6 |
| 1 | 28666669 | 28737671 | 71002 | gain | 3161 | PHACTR4, RCC1, SNHG3 | 7 |
| 1 | 49372054 | 49380088 | 8034 | het_loss | 3145 | AGBL4 | 8 |
| 1 | 153816159 | 153827698 | 11539 | het_loss | 3168 | | 9 |
| 1 | 205607255 | 205610341 | 3086 | gain | 3007 | | 10 |
| 1 | 215760485 | 215762451 | 1966 | het_loss | 3117 | GPATCH2 | 11 |
| 1 | 215866737 | 215869900 | 3163 | het_loss | 3151 | GPATCH2 | 12 |
| 2 | 10352668 | 10356083 | 3415 | het_loss | 3007 | | 13 |
| 2 | 24457024 | 24462631 | 5607 | hom_loss | 3204 | | 14 |
| 2 | 38468717 | 38471950 | 3233 | het_loss | 3175 | | 15 |
| 2 | 38516138 | 38524237 | 8099 | het_loss | 3151 | | 16 |
| 2 | 38726517 | 38731845 | 5328 | het_loss | 3159 | | 17 |
| 2 | 40620890 | 40624089 | 3199 | het_loss | 3202 | | 18 |

TABLE 1-continued

CNVs of interest in this study

| Chr | Original CNV Start | Original CNV Stop | Original CNV Size | CNV Type | PML Case ID | RefSeq Gene Symbol | SEQ ID |
|---|---|---|---|---|---|---|---|
| 2 | 46631006 | 46643501 | 12495 | gain | 3145 | RHOQ | 19 |
| 2 | 55764753 | 55790559 | 25806 | gain | 3143 | PNPT1 | 20 |
| 2 | 55764753 | 55790559 | 25806 | gain | 3193 | PNPT1 | 20 |
| 2 | 55764753 | 55790559 | 25806 | gain | 3282 | PNPT1 | 20 |
| 2 | 55764753 | 55790559 | 25806 | gain | 3143 | PNPT1 | 20 |
| 2 | 55764753 | 55790559 | 25806 | gain | 3193 | PNPT1 | 20 |
| 2 | 55764753 | 55790559 | 25806 | gain | 3282 | PNPT1 | 20 |
| 2 | 55764753 | 55790559 | 25806 | gain | 3143 | PNPT1 | 20 |
| 2 | 55764753 | 55790559 | 25806 | gain | 3193 | PNPT1 | 20 |
| 2 | 55764753 | 55790559 | 25806 | gain | 3282 | PNPT1 | 20 |
| 2 | 71190677 | 71200120 | 9443 | het_loss | 3175 | MCEE | 21 |
| 2 | 71190677 | 71200120 | 9443 | het_loss | 3175 | MCEE | 21 |
| 2 | 71191311 | 71200120 | 8809 | het_loss | 3204 | MCEE | 22 |
| 2 | 71198108 | 71200120 | 2012 | het_loss | 3143 | MCEE | 23 |
| 2 | 71190677 | 71200120 | 9443 | het_loss | 3175 | MCEE | 21 |
| 2 | 71198108 | 71200120 | 2012 | het_loss | 3193 | MCEE | 23 |
| 2 | 71198108 | 71200120 | 2012 | het_loss | 3200 | MCEE | 23 |
| 2 | 71191311 | 71200120 | 8809 | het_loss | 3204 | MCEE | 22 |
| 2 | 74773432 | 74913493 | 140061 | gain | 3118 | HK2 | 24 |
| 2 | 105418748 | 105435274 | 16526 | het_loss | 3193 | FHL2 | 25 |
| 2 | 110182348 | 110210249 | 27901 | gain | 3174 | MALL, MIR4267, MIR4436B1, MIR4436B2 | 26 |
| 2 | 127823042 | 127828410 | 5368 | het_loss | 3273 | | 27 |
| 2 | 134911636 | 134914254 | 2618 | het_loss | 3273 | MGAT5 | 28 |
| 2 | 203005216 | 203019933 | 14717 | het_loss | 3009 | BMPR2 | 29 |
| 2 | 203005216 | 203019933 | 14717 | het_loss | 3192 | BMPR2 | 29 |
| 2 | 203005216 | 203019933 | 14717 | hom_loss | 3152 | BMPR2 | 29 |
| 2 | 230212897 | 230216339 | 3442 | het_loss | 3154 | DNER | 30 |
| 3 | 122979920 | 122994402 | 14482 | gain | 3202 | IQCB1 | 31 |
| 4 | 26565071 | 26566345 | 1274 | het_loss | 3010 | STIM2 | 32 |
| 4 | 26565071 | 26566345 | 1274 | het_loss | 3125 | STIM2 | 32 |
| 4 | 26565071 | 26566345 | 1274 | het_loss | 3168 | STIM2 | 32 |
| 4 | 26565071 | 26566345 | 1274 | het_loss | 3282 | STIM2 | 32 |
| 4 | 26565071 | 26566345 | 1274 | het_loss | 3284 | STIM2 | 32 |
| 4 | 26565071 | 26566345 | 1274 | hom_loss | 3273 | STIM2 | 32 |
| 4 | 54838623 | 54873909 | 35286 | gain | 3153 | PDGFRA | 33 |
| 4 | 90791460 | 90843887 | 52427 | gain | 3168 | | 34 |
| 4 | 90800863 | 90808258 | 7395 | het_loss | 3009 | | 35 |
| 4 | 90800863 | 90808258 | 7395 | het_loss | 3284 | | 35 |
| 5 | 45331278 | 46150784 | 819506 | gain | 3157 | HCN1 | 36 |
| 5 | 49771219 | 49774457 | 3238 | gain | 3273 | EMB | 37 |
| 5 | 66619415 | 66636116 | 16701 | gain | 3010 | | 38 |
| 5 | 78480194 | 78497296 | 17102 | gain | 3205 | | 39 |
| 5 | 78497296 | 78531091 | 33795 | gain | 3132 | | 40 |
| 5 | 78497296 | 78521408 | 24112 | gain | 3185 | | 41 |
| 5 | 78497296 | 78531091 | 33795 | gain | 3132 | | 40 |
| 5 | 78497296 | 78521408 | 24112 | gain | 3185 | | 41 |
| 5 | 78500552 | 78526637 | 26085 | gain | 3205 | | 42 |
| 5 | 78497296 | 78531091 | 33795 | gain | 3132 | | 40 |
| 5 | 78500552 | 78526637 | 26085 | gain | 3205 | | 42 |
| 5 | 78497296 | 78531091 | 33795 | gain | 3132 | | 40 |
| 5 | 83490494 | 83495169 | 4675 | het_loss | 3204 | EDIL3 | 43 |
| 5 | 133372071 | 133379727 | 7656 | hom_loss | 3153 | | 44 |
| 5 | 137836466 | 137843309 | 6843 | hom_loss | 3279 | | 45 |
| 5 | 150159466 | 150202601 | 43135 | het_loss | 3117 | | 46 |
| 5 | 150159466 | 150204134 | 44668 | het_loss | 3180 | | 47 |
| 5 | 150159466 | 150202601 | 43135 | het_loss | 3199 | | 46 |
| 5 | 150159466 | 150204134 | 44668 | het_loss | 3278 | | 47 |
| 5 | 150159466 | 150202601 | 43135 | het_loss | 3117 | | 46 |
| 5 | 150159466 | 150204134 | 44668 | het_loss | 3180 | | 47 |
| 5 | 150159466 | 150202601 | 43135 | het_loss | 3199 | | 46 |
| 5 | 150159466 | 150204134 | 44668 | het_loss | 3278 | | 47 |
| 5 | 150159466 | 150202601 | 43135 | het_loss | 3117 | | 46 |
| 5 | 150159466 | 150204134 | 44668 | het_loss | 3180 | | 47 |
| 5 | 150159466 | 150202601 | 43135 | het_loss | 3199 | | 46 |
| 5 | 150159466 | 150204134 | 44668 | het_loss | 3278 | | 47 |
| 5 | 150185190 | 150201145 | 15955 | hom_loss | 3009 | | 48 |
| 5 | 150185190 | 150201145 | 15955 | hom_loss | 3143 | | 48 |
| 5 | 150185190 | 150202601 | 17411 | hom_loss | 3152 | | 49 |
| 5 | 150185190 | 150202601 | 17411 | hom_loss | 3154 | | 49 |
| 5 | 150185190 | 150202601 | 17411 | hom_loss | 3193 | | 49 |
| 5 | 150159466 | 150201145 | 41679 | hom_loss | 3196 | | 50 |
| 5 | 150185190 | 150201145 | 15955 | hom_loss | 3281 | | 48 |
| 5 | 150185190 | 150201145 | 15955 | hom_loss | 3009 | | 48 |

TABLE 1-continued

CNVs of interest in this study

| Chr | Original CNV Start | Original CNV Stop | Original CNV Size | CNV Type | PML Case ID | RefSeq Gene Symbol | SEQ ID |
|---|---|---|---|---|---|---|---|
| 5 | 150185190 | 150201145 | 15955 | hom_loss | 3143 | | 48 |
| 5 | 150185190 | 150202601 | 17411 | hom_loss | 3152 | | 49 |
| 5 | 150185190 | 150202601 | 17411 | hom_loss | 3154 | | 49 |
| 5 | 150185190 | 150202601 | 17411 | hom_loss | 3193 | | 49 |
| 5 | 150159466 | 150201145 | 41679 | hom_loss | 3196 | | 50 |
| 5 | 150185190 | 150201145 | 15955 | hom_loss | 3281 | | 48 |
| 5 | 150185190 | 150202601 | 17411 | hom_loss | 3152 | | 49 |
| 5 | 150185190 | 150202601 | 17411 | hom_loss | 3154 | | 49 |
| 5 | 150185190 | 150202601 | 17411 | hom_loss | 3193 | | 49 |
| 5 | 150185190 | 150204134 | 18944 | het_loss | 3132 | | 51 |
| 5 | 150159466 | 150204134 | 44668 | het_loss | 3180 | | 47 |
| 5 | 150202601 | 150204134 | 1533 | het_loss | 3196 | | 52 |
| 5 | 150191322 | 150204134 | 12812 | het_loss | 3273 | | 53 |
| 5 | 150185190 | 150204134 | 18944 | het_loss | 3277 | | 51 |
| 5 | 150159466 | 150204134 | 44668 | het_loss | 3278 | | 47 |
| 5 | 150185190 | 150204134 | 18944 | het_loss | 3280 | | 51 |
| 5 | 150185190 | 150204134 | 18944 | het_loss | 3282 | | 51 |
| 5 | 179590681 | 179626660 | 35979 | het_loss | 3172 | MAPK9 | 54 |
| 6 | 2882577 | 2947403 | 64826 | het_loss | 3196 | DKFZP686I15217, NQO2, SERPINB6 | 55 |
| 6 | 2964646 | 2966011 | 1365 | het_loss | 3193 | HTATSF1P2, NQO2 | 56 |
| 6 | 51766024 | 51773250 | 7226 | het_loss | 3167 | PKHD1 | 57 |
| 6 | 51952217 | 51969378 | 17161 | gain | 3127 | PKHD1 | 58 |
| 6 | 51952217 | 51969378 | 17161 | gain | 3127 | PKHD1 | 58 |
| 6 | 51953476 | 51965723 | 12247 | gain | 3205 | PKHD1 | 59 |
| 6 | 51952217 | 51969378 | 17161 | gain | 3127 | PKHD1 | 58 |
| 6 | 74396294 | 74404837 | 8543 | het_loss | 3009 | SLC17A5 | 60 |
| 6 | 74396294 | 74398409 | 2115 | het_loss | 3160 | SLC17A5 | 61 |
| 6 | 74396294 | 74404837 | 8543 | het_loss | 3009 | SLC17A5 | 60 |
| 6 | 86416979 | 86431527 | 14548 | het_loss | 3197 | | 62 |
| 6 | 91131823 | 91135670 | 3847 | het_loss | 3171 | | 63 |
| 6 | 107882367 | 107890605 | 8238 | het_loss | 3201 | PDSS2 | 64 |
| 6 | 166418511 | 166422386 | 3875 | het_loss | 3125 | | 65 |
| 6 | 166418511 | 166422386 | 3875 | het_loss | 3163 | | 65 |
| 6 | 166418511 | 166422386 | 3875 | het_loss | 3192 | | 65 |
| 6 | 166418511 | 166422386 | 3875 | het_loss | 3193 | | 65 |
| 6 | 166418511 | 166422386 | 3875 | het_loss | 3194 | | 65 |
| 6 | 166418511 | 166422386 | 3875 | het_loss | 3200 | | 65 |
| 6 | 166418511 | 166422386 | 3875 | het_loss | 3205 | | 65 |
| 6 | 166418511 | 166422386 | 3875 | het_loss | 3280 | | 65 |
| 6 | 166418511 | 166422386 | 3875 | het_loss | 3281 | | 65 |
| 6 | 166418511 | 166422386 | 3875 | het_loss | 3284 | | 65 |
| 6 | 166418511 | 166422386 | 3875 | hom_loss | 3009 | | 65 |
| 6 | 166418511 | 166422386 | 3875 | hom_loss | 3152 | | 65 |
| 6 | 166418511 | 166422386 | 3875 | hom_loss | 3175 | | 65 |
| 7 | 65741238 | 65768682 | 27444 | gain | 3152 | KCTD7 | 66 |
| 7 | 65741238 | 65768682 | 27444 | gain | 3202 | KCTD7 | 66 |
| 7 | 157174966 | 157177843 | 2877 | het_loss | 3009 | PTPRN2 | 67 |
| 7 | 157425841 | 157496238 | 70397 | gain | 3189 | PTPRN2 | 68 |
| 7 | 158000082 | 158024569 | 24487 | het_loss | 3279 | PTPRN2 | 69 |
| 7 | 158000082 | 158024569 | 24487 | het_loss | 3279 | PTPRN2 | 69 |
| 7 | 158000082 | 158024569 | 24487 | het_loss | 3279 | MIR595, PTPRN2 | 69 |
| 8 | 23103186 | 23125443 | 22257 | het_loss | 3140 | TNFRSF10A | 70 |
| 8 | 39914488 | 39919594 | 5106 | het_loss | 3126 | IDO2 | 71 |
| 8 | 79905654 | 79910286 | 4632 | het_loss | 3159 | | 72 |
| 8 | 99790200 | 99799839 | 9639 | het_loss | 3006 | STK3 | 73 |
| 8 | 102049360 | 102064431 | 15071 | het_loss | 3173 | | 74 |
| 8 | 102049360 | 102064431 | 15071 | het_loss | 3175 | | 74 |
| 8 | 102049360 | 102064431 | 15071 | het_loss | 3282 | | 74 |
| 9 | 571398 | 584647 | 13249 | het_loss | 3006 | KANK1 | 75 |
| 9 | 571398 | 584647 | 13249 | het_loss | 3006 | KANK1 | 75 |
| 9 | 580722 | 598488 | 17766 | het_loss | 3200 | KANK1 | 76 |
| 9 | 580722 | 598488 | 17766 | het_loss | 3282 | KANK1 | 76 |
| 9 | 580722 | 598488 | 17766 | het_loss | 3200 | KANK1 | 76 |
| 9 | 580722 | 598488 | 17766 | het_loss | 3282 | KANK1 | 76 |
| 9 | 634039 | 637589 | 3550 | het_loss | 3273 | KANK1 | 77 |
| 9 | 634039 | 637589 | 3550 | het_loss | 3282 | KANK1 | 77 |
| 9 | 74050088 | 74059447 | 9359 | het_loss | 3165 | GDA | 78 |
| 9 | 93140394 | 93447826 | 307432 | gain | 3198 | AUH, MIR3163, MIR3910-1, MIR3910-2, NFIL3 | 79 |
| 9 | 118564159 | 118575633 | 11474 | gain | 3193 | ASTN2 | 80 |
| 9 | 118612694 | 118664593 | 51899 | het_loss | 3144 | ASTN2 | 81 |
| 9 | 119220847 | 119233078 | 12231 | gain | 3005 | | 82 |
| 10 | 899657 | 1071401 | 171744 | gain | 3161 | GTPBP4, IDI2, IDI2-AS1, LARP4B | 83 |
| 10 | 76217585 | 76411591 | 194006 | gain | 3179 | KAT6B | 84 |

TABLE 1-continued

CNVs of interest in this study

| Chr | Original CNV Start | Original CNV Stop | Original CNV Size | CNV Type | PML Case ID | RefSeq Gene Symbol | SEQ ID |
|---|---|---|---|---|---|---|---|
| 10 | 116000069 | 116004388 | 4319 | gain | 3010 | VWA2 | 85 |
| 11 | 14677012 | 14689025 | 12013 | het_loss | 3199 | PDE3B | 86 |
| 11 | 34608313 | 34615878 | 7565 | het_loss | 3117 | EHF | 87 |
| 11 | 62382087 | 62398462 | 16375 | het_loss | 3205 | SLC3A2 | 88 |
| 11 | 76631014 | 76643625 | 12611 | het_loss | 3193 | GDPD4 | 89 |
| 12 | 11616557 | 12422129 | 805572 | het_loss | 3126 | ETV6 | 90 |
| 12 | 12435301 | 12778142 | 342841 | het_loss | 3126 | APOLD1, CDKN1B, CREBL2, DUSP16, GPR19, LOH12CR1 | 91 |
| 12 | 12968705 | 12971310 | 2605 | gain | 3127 |  | 92 |
| 12 | 91786998 | 94313682 | 2526684 | het_loss | 3126 | EEA1, LOC643339 | 93 |
| 12 | 91786998 | 94313682 | 2526684 | het_loss | 3126 | LOC643339, MRPL42, NUDT4, NUDT4P1, SOCS2, SOCS2-AS1, UBE2N | 93 |
| 12 | 91786998 | 94313682 | 2526684 | het_loss | 3126 | CCDC41, CRADD, PLXNC1 | 93 |
| 12 | 111061085 | 111064486 | 3401 | het_loss | 3004 | TRAFD1 | 94 |
| 13 | 40939924 | 41026908 | 86984 | gain | 3140 | RGCC | 95 |
| 13 | 75006025 | 75016304 | 10279 | gain | 3009 | COMMD6 | 96 |
| 13 | 75006025 | 75016304 | 10279 | gain | 3152 | COMMD6 | 96 |
| 13 | 91811087 | 91814369 | 3282 | het_loss | 3143 | GPC5 | 97 |
| 13 | 91811087 | 91811118 | 31 | hom_loss | 3173 | GPC5 | 98 |
| 13 | 110754499 | 110778301 | 23802 | gain | 3006 | ARHGEF7, TEX29 | 99 |
| 14 | 20021118 | 20055469 | 34351 | gain | 3205 | RNASE10 | 100 |
| 14 | 20426824 | 20481852 | 55028 | hom_loss | 3200 | ECRP, RNASE3 | 101 |
| 14 | 20430810 | 20490129 | 59319 | het_loss | 3192 | ECRP | 102 |
| 14 | 20430810 | 20490129 | 59319 | het_loss | 3192 |  | 102 |
| 14 | 20430810 | 20490129 | 59319 | het_loss | 3192 |  | 102 |
| 14 | 21096689 | 21105611 | 8922 | het_loss | 3125 |  | 103 |
| 14 | 21096689 | 21105611 | 8922 | het_loss | 3175 |  | 103 |
| 14 | 21096689 | 21105611 | 8922 | het_loss | 3194 |  | 103 |
| 14 | 21096689 | 21105611 | 8922 | het_loss | 3204 |  | 103 |
| 14 | 21096689 | 21105611 | 8922 | het_loss | 3273 |  | 103 |
| 14 | 21120750 | 21125513 | 4763 | gain | 3143 |  | 104 |
| 14 | 21120750 | 21125513 | 4763 | gain | 3173 |  | 104 |
| 14 | 60901636 | 60909492 | 7856 | het_loss | 3193 | PRKCH | 105 |
| 14 | 60912874 | 60921269 | 8395 | het_loss | 3174 | PRKCH | 106 |
| 14 | 63937192 | 63944459 | 7267 | gain | 3205 | MTHFD1 | 107 |
| 14 | 95754535 | 95759056 | 4521 | het_loss | 3009 | BDKRB2 | 108 |
| 14 | 95754535 | 95759056 | 4521 | het_loss | 3173 | BDKRB2 | 108 |
| 14 | 95754535 | 95759056 | 4521 | het_loss | 3202 | BDKRB2 | 108 |
| 15 | 66065925 | 66082418 | 16493 | het_loss | 3010 |  | 109 |
| 15 | 70432627 | 70443017 | 10390 | gain | 3169 | HEXA | 110 |
| 15 | 75096101 | 75128723 | 32622 | gain | 3200 | PSTPIP1 | 111 |
| 15 | 75101524 | 75115806 | 14282 | gain | 3132 | PSTPIP1 | 112 |
| 15 | 75096101 | 75128723 | 32622 | gain | 3200 | PSTPIP1 | 111 |
| 15 | 75105789 | 75115806 | 10017 | gain | 3127 | PSTPIP1 | 113 |
| 15 | 75101524 | 75115806 | 14282 | gain | 3132 | PSTPIP1 | 112 |
| 15 | 75105789 | 75115806 | 10017 | gain | 3199 | PSTPIP1 | 113 |
| 15 | 75096101 | 75128723 | 32622 | gain | 3200 | PSTPIP1 | 111 |
| 15 | 75105789 | 75115806 | 10017 | gain | 3279 | PSTPIP1 | 113 |
| 15 | 75105789 | 75115806 | 10017 | gain | 3127 | PSTPIP1 | 113 |
| 15 | 75101524 | 75115806 | 14282 | gain | 3132 | PSTPIP1 | 112 |
| 15 | 75105789 | 75115806 | 10017 | gain | 3199 | PSTPIP1 | 113 |
| 15 | 75096101 | 75128723 | 32622 | gain | 3200 | PSTPIP1 | 111 |
| 15 | 75105789 | 75115806 | 10017 | gain | 3279 | PSTPIP1 | 113 |
| 15 | 75096101 | 75128723 | 32622 | gain | 3200 | PSTPIP1 | 111 |
| 15 | 88999998 | 89016848 | 16850 | het_loss | 3172 |  | 114 |
| 16 | 6823677 | 6932753 | 109076 | het_loss | 3126 | RBFOX1 | 115 |
| 16 | 6823677 | 6932753 | 109076 | het_loss | 3126 | RBFOX1 | 115 |
| 16 | 6942078 | 6945539 | 3461 | gain | 3173 | RBFOX1 | 116 |
| 16 | 6942078 | 6945539 | 3461 | gain | 3175 | RBFOX1 | 116 |
| 16 | 6942078 | 6945539 | 3461 | gain | 3282 | RBFOX1 | 116 |
| 16 | 23842653 | 23848772 | 6119 | het_loss | 3198 | PRKCB | 117 |
| 16 | 23892842 | 23903495 | 10653 | gain | 3199 | PRKCB | 118 |
| 16 | 23892842 | 23903495 | 10653 | gain | 3199 | PRKCB | 118 |
| 16 | 23893969 | 23908248 | 14279 | gain | 3205 | PRKCB | 119 |
| 16 | 23893969 | 23908248 | 14279 | gain | 3205 | PRKCB | 119 |
| 16 | 69044235 | 69050151 | 5916 | gain | 3174 | FUK | 120 |
| 16 | 69044235 | 69050151 | 5916 | gain | 3185 | FUK | 120 |
| 16 | 69052450 | 69081640 | 29190 | het_loss | 3197 | COG4, FUK | 121 |
| 16 | 70653499 | 70665447 | 11948 | gain | 3143 | HPR | 122 |
| 16 | 70653499 | 70665447 | 11948 | gain | 3152 | HPR | 122 |
| 16 | 70653499 | 70665447 | 11948 | gain | 3192 | HPR | 122 |
| 16 | 70653499 | 70665447 | 11948 | gain | 3200 | HPR | 122 |
| 16 | 70653499 | 70665447 | 11948 | gain | 3282 | HPR | 122 |
| 16 | 70653499 | 70665447 | 11948 | gain | 3284 | HPR | 122 |

TABLE 1-continued

CNVs of interest in this study

| Chr | Original CNV Start | Original CNV Stop | Original CNV Size | CNV Type | PML Case ID | RefSeq Gene Symbol | SEQ ID |
|---|---|---|---|---|---|---|---|
| 17 | 69341925 | 70202523 | 860598 | gain | 3183 | BTBD17, C17orf77, CD300A, CD300C, CD300E, CD300LB, CD300LD, CD300LF, DNAI2, GPR142, GPRC5C, KIF19, MGC16275, RAB37, RPL38, TTYH2 | 123 |
| 17 | 75608151 | 75615433 | 7282 | het_loss | 3144 | TBC1D16 | 124 |
| 17 | 75608151 | 75615433 | 7282 | het_loss | 3152 | TBC1D16 | 124 |
| 17 | 75608151 | 75615433 | 7282 | het_loss | 3163 | TBC1D16 | 124 |
| 17 | 75608151 | 75611602 | 3451 | het_loss | 3192 | TBC1D16 | 125 |
| 17 | 75608151 | 75615433 | 7282 | het_loss | 3200 | TBC1D16 | 124 |
| 17 | 75608151 | 75611602 | 3451 | het_loss | 3204 | TBC1D16 | 125 |
| 17 | 75608151 | 75611602 | 3451 | het_loss | 3284 | TBC1D16 | 125 |
| 17 | 75608151 | 75611602 | 3451 | hom_loss | 3009 | TBC1D16 | 125 |
| 17 | 75611602 | 75615433 | 3831 | hom_loss | 3175 | TBC1D16 | 126 |
| 17 | 75608151 | 75615433 | 7282 | het_loss | 3144 | TBC1D16 | 124 |
| 17 | 75608151 | 75615433 | 7282 | het_loss | 3152 | TBC1D16 | 124 |
| 17 | 75608151 | 75615433 | 7282 | het_loss | 3163 | TBC1D16 | 124 |
| 17 | 75608151 | 75615433 | 7282 | het_loss | 3200 | TBC1D16 | 124 |
| 17 | 76241510 | 76267844 | 26334 | gain | 3205 | RPTOR | 127 |
| 17 | 76247305 | 76265683 | 18378 | gain | 3127 | RPTOR | 128 |
| 17 | 76241510 | 76267844 | 26334 | gain | 3205 | RPTOR | 127 |
| 17 | 76241510 | 76267844 | 26334 | gain | 3205 | RPTOR | 127 |
| 18 | 9985530 | 10125331 | 139801 | gain | 3175 |  | 129 |
| 18 | 12764095 | 12781985 | 17890 | gain | 3191 | PTPN2 | 130 |
| 18 | 27026203 | 27029351 | 3148 | het_loss | 3125 |  | 131 |
| 18 | 27026203 | 27029351 | 3148 | het_loss | 3143 |  | 131 |
| 18 | 27026203 | 27029351 | 3148 | het_loss | 3175 |  | 131 |
| 18 | 42537949 | 42663605 | 125656 | gain | 3125 | PIAS2, ST8SIA5 | 132 |
| 18 | 46917195 | 46945018 | 27823 | het_loss | 3161 |  | 133 |
| 18 | 59457622 | 59465699 | 8077 | het_loss | 3145 | SERPINB4 | 134 |
| 19 | 3270755 | 3291144 | 20389 | gain | 3205 |  | 135 |
| 19 | 46386511 | 46388364 | 1853 | hom_loss | 3175 |  | 136 |
| 19 | 52496536 | 52501292 | 4756 | gain | 3124 |  | 137 |
| 19 | 55247874 | 55252420 | 4546 | het_loss | 3163 | FLJ26850 | 138 |
| 19 | 55247874 | 55252420 | 4546 | het_loss | 3173 | FLJ26850 | 138 |
| 19 | 55247874 | 55252420 | 4546 | het_loss | 3192 | FLJ26850 | 138 |
| 19 | 55247874 | 55252420 | 4546 | het_loss | 3200 | FLJ26850 | 138 |
| 19 | 55247874 | 55252420 | 4546 | het_loss | 3280 | FLJ26850 | 138 |
| 19 | 55247874 | 55252420 | 4546 | het_loss | 3163 | FLJ26850 | 138 |
| 19 | 55247874 | 55252420 | 4546 | het_loss | 3173 | FLJ26850 | 138 |
| 19 | 55247874 | 55252420 | 4546 | het_loss | 3192 | FLJ26850 | 138 |
| 19 | 55250187 | 55252420 | 2233 | het_loss | 3194 | FLJ26850 | 139 |
| 19 | 55247874 | 55252420 | 4546 | het_loss | 3200 | FLJ26850 | 138 |
| 19 | 55247874 | 55252420 | 4546 | het_loss | 3280 | FLJ26850 | 138 |
| 19 | 55250187 | 55252420 | 2233 | hom_loss | 3175 | FLJ26850 | 139 |
| 19 | 55250187 | 55252420 | 2233 | hom_loss | 3202 | FLJ26850 | 139 |
| 19 | 56964168 | 57308449 | 344281 | gain | 3155 | FPR2, FPR3, ZNF350, ZNF432, ZNF577, ZNF613, ZNF614, ZNF615, ZNF649, ZNF841 | 140 |
| 19 | 56964168 | 57308449 | 344281 | gain | 3157 | FPR2, FPR3, ZNF350, ZNF432, ZNF577, ZNF613, ZNF614, ZNF615, ZNF649, ZNF841 | 140 |
| 19 | 59013780 | 59023850 | 10070 | het_loss | 3117 | NLRP12 | 141 |
| 19 | 59249279 | 59251831 | 2552 | hom_loss | 3160 | VSTM1 | 142 |
| 19 | 59249279 | 59251831 | 2552 | hom_loss | 3164 | VSTM1 | 142 |
| 19 | 59250742 | 59251831 | 1089 | hom_loss | 3117 | VSTM1 | 143 |
| 19 | 59249279 | 59251831 | 2552 | hom_loss | 3160 | VSTM1 | 142 |
| 19 | 59249279 | 59251831 | 2552 | hom_loss | 3164 | VSTM1 | 142 |
| 19 | 59250742 | 59251831 | 1089 | hom_loss | 3277 | VSTM1 | 143 |
| 20 | 17844577 | 17954650 | 110073 | gain | 3166 | MGME1, OVOL2, SNORD17, SNX5 | 144 |
| 20 | 42706680 | 42711434 | 4754 | het_loss | 3125 | ADA | 145 |
| 21 | 15234620 | 15312960 | 78340 | gain | 3009 | NRIP1 | 146 |
| 21 | 29643302 | 29647950 | 4648 | het_loss | 3202 | BACH1 | 147 |
| 21 | 44634707 | 44666832 | 32125 | gain | 3200 | TRPM2 | 148 |
| 21 | 44634707 | 44641658 | 6951 | gain | 3205 | TRPM2 | 149 |
| 21 | 44634707 | 44671482 | 36775 | gain | 3279 | TRPM2 | 150 |
| 21 | 44637544 | 44669596 | 32052 | gain | 3127 | TRPM2 | 151 |
| 21 | 44637544 | 44657372 | 19828 | gain | 3185 | TRPM2 | 152 |
| 21 | 44634707 | 44666832 | 32125 | gain | 3200 | TRPM2 | 148 |
| 21 | 44634707 | 44641658 | 6951 | gain | 3205 | TRPM2 | 149 |
| 21 | 44634707 | 44671482 | 36775 | gain | 3279 | TRPM2 | 150 |
| 21 | 44637544 | 44669596 | 32052 | gain | 3127 | TRPM2 | 151 |
| 21 | 44637544 | 44657372 | 19828 | gain | 3185 | TRPM2 | 152 |
| 21 | 44634707 | 44666832 | 32125 | gain | 3200 | TRPM2 | 148 |
| 21 | 44634707 | 44671482 | 36775 | gain | 3279 | TRPM2 | 150 |

TABLE 1-continued

CNVs of interest in this study

| Chr | Original CNV Start | Original CNV Stop | Original CNV Size | CNV Type | PML Case ID | RefSeq Gene Symbol | SEQ ID |
|---|---|---|---|---|---|---|---|
| 21 | 44643974 | 44657372 | 13398 | het_loss | 3161 | TRPM2 | 153 |
| 21 | 44637544 | 44669596 | 32052 | gain | 3127 | TRPM2 | 151 |
| 21 | 44637544 | 44657372 | 19828 | gain | 3185 | TRPM2 | 152 |
| 21 | 44634707 | 44666832 | 32125 | gain | 3200 | TRPM2 | 148 |
| 21 | 44643974 | 44657372 | 13398 | gain | 3205 | TRPM2 | 153 |
| 21 | 44634707 | 44671482 | 36775 | gain | 3279 | TRPM2 | 150 |
| 21 | 44637544 | 44669596 | 32052 | gain | 3127 | TRPM2 | 151 |
| 21 | 44634707 | 44666832 | 32125 | gain | 3200 | TRPM2 | 148 |
| 21 | 44634707 | 44671482 | 36775 | gain | 3279 | TRPM2 | 150 |
| 21 | 44637544 | 44669596 | 32052 | gain | 3127 | TRPM2 | 151 |
| 21 | 44634707 | 44666832 | 32125 | gain | 3200 | TRPM2 | 148 |
| 21 | 44660199 | 44681194 | 20995 | gain | 3205 | TRPM2 | 154 |
| 21 | 44634707 | 44671482 | 36775 | gain | 3279 | TRPM2 | 150 |
| 21 | 44637544 | 44669596 | 32052 | gain | 3127 | TRPM2 | 151 |
| 21 | 44660199 | 44681194 | 20995 | gain | 3205 | TRPM2 | 154 |
| 21 | 44634707 | 44671482 | 36775 | gain | 3279 | TRPM2 | 150 |
| 21 | 44660199 | 44681194 | 20995 | gain | 3205 | TRPM2 | 154 |
| 21 | 44634707 | 44671482 | 36775 | gain | 3279 | TRPM2 | 150 |
| 21 | 44660199 | 44681194 | 20995 | gain | 3205 | TRPM2 | 154 |
| 21 | 45348895 | 45354820 | 5925 | het_loss | 3179 | ADARB1 | 155 |
| 22 | 37689058 | 37715385 | 26327 | gain | 3169 | APOBEC3A, APOBEC3A_B, APOBEC3B | 156 |
| 22 | 39257585 | 39261621 | 4036 | het_loss | 3005 | MKL1 | 157 |
| 22 | 40642402 | 40655210 | 12808 | gain | 3205 | TNFRSF13C | 158 |
| 22 | 40655820 | 40673250 | 17430 | gain | 3185 | | 159 |
| 22 | 40655820 | 40675788 | 19968 | gain | 3205 | | 160 |
| 22 | 40659633 | 40671866 | 12233 | gain | 3127 | | 161 |
| 22 | 40655820 | 40673250 | 17430 | gain | 3185 | | 159 |
| 22 | 40655820 | 40675788 | 19968 | gain | 3205 | | 160 |
| 22 | 40659633 | 40671866 | 12233 | gain | 3127 | CENPM | 161 |
| 22 | 40655820 | 40673250 | 17430 | gain | 3185 | CENPM | 159 |
| 22 | 40663050 | 40668079 | 5029 | gain | 3190 | CENPM | 162 |
| 22 | 40663050 | 40668079 | 5029 | gain | 3202 | CENPM | 162 |
| 22 | 40655820 | 40675788 | 19968 | gain | 3205 | CENPM | 160 |
| 22 | 40659633 | 40671866 | 12233 | gain | 3127 | CENPM | 161 |
| 22 | 40655820 | 40673250 | 17430 | gain | 3185 | CENPM | 159 |
| 22 | 40655820 | 40675788 | 19968 | gain | 3205 | CENPM | 160 |
| 22 | 40655820 | 40673250 | 17430 | gain | 3185 | CENPM | 159 |
| 22 | 40655820 | 40675788 | 19968 | gain | 3205 | CENPM | 160 |
| 22 | 40655820 | 40675788 | 19968 | gain | 3205 | | 160 |
| 23 | 232907 | 244684 | 11777 | het_loss | 3007 | PPP2R3B | 163 |
| 23 | 7585301 | 7830994 | 245693 | gain | 3172 | | 164 |
| 23 | 7585301 | 7830994 | 245693 | gain | 3172 | VCX | 164 |
| 23 | 7769323 | 7779354 | 10031 | het_loss | 3132 | | 165 |
| 23 | 6465033 | 8093113 | 1628080 | het_loss | 3171 | | 166 |
| 23 | 7769323 | 7779354 | 10031 | het_loss | 3204 | | 165 |
| 23 | 7585301 | 7830994 | 245693 | gain | 3172 | | 164 |
| 23 | 7585301 | 7830994 | 245693 | gain | 3172 | | 164 |
| 23 | 6465033 | 8093113 | 1628080 | het_loss | 3171 | MIR651, PNPLA4 | 166 |
| 23 | 7585301 | 7830994 | 245693 | gain | 3172 | PNPLA4 | 164 |
| 23 | 48358646 | 48408854 | 50208 | het_loss | 3009 | | 167 |
| 23 | 64710574 | 64725828 | 15254 | gain | 3125 | | 168 |
| 23 | 73083877 | 73086192 | 2315 | hom_loss | 3193 | JPX | 169 |
| 23 | 73083877 | 73086192 | 2315 | hom_loss | 3200 | JPX | 169 |
| 23 | 122337025 | 122340879 | 3854 | hom_loss | 3125 | GRIA3 | 170 |
| 23 | 148452844 | 148461889 | 9045 | het_loss | 3163 | | 171 |
| 23 | 148452844 | 148461889 | 9045 | het_loss | 3205 | | 171 |
| 23 | 148452844 | 148461889 | 9045 | hom_loss | 3144 | | 171 |
| 23 | 148452844 | 148461889 | 9045 | hom_loss | 3193 | | 171 |
| 23 | 149901706 | 149904265 | 2559 | gain | 3117 | HMGB3 | 172 |
| 23 | 149901706 | 149904265 | 2559 | gain | 3118 | HMGB3 | 172 |

Table 1 lists all CNVs of interest, obtained as described in the text, with the exception that, for each entry, the original CNV start and stop positions are noted, along with original CNV size, type (heterozygous loss, homozygous loss or gain), Case_ID and gene annotation (for the CNV-subregion NOT original CNV). The final column contains SEQ_ID numbers. Standard chromosomal numbering used by those skilled in the art is used in Table 1 for the autosomal chromosomes (1-22) but, for convenience with analysis methods, chromosome X is designated as chromosome 23 herein. All coordinates are based on hg18.

TABLE 2

CNV -subregions of interest in this study

| Chr | CNV Subregion Start | CNV Subregion Stop | CNV Subregion Size | CNV Type | PML Case ID | RefSeq Gene Symbol | Exon overlap | NVE cases | PML cases | FET | OR | CNV Subregion No (SRN) |
|---|---|---|---|---|---|---|---|---|---|---|---|---|
| 1 | 1086119 | 1135772 | 49653 | het_loss | 3009 | MIR200A, MIR200B, MIR429, TNFRSF18, TTLL10 | Y | 0 | 1 | 0.005115965 | 39.43 | 1 |
| 1 | 9634094 | 9635206 | 1112 | hom_loss | 3009 | PIK3CD | Y | 0 | 1 | 0.005115965 | 39.43 | 2 |
| 1 | 12018512 | 12032581 | 14069 | gain | 3205 |  | N | 0 | 1 | 0.005115965 | 39.43 | 3 |
| 1 | 19593401 | 19602807 | 9406 | het_loss | 3203 | CAPZB | N | 0 | 1 | 0.005115965 | 39.43 | 4 |
| 1 | 21698753 | 21700243 | 1490 | het_loss | 3161 |  | N | 0 | 1 | 0.005115965 | 39.43 | 5 |
| 1 | 24364786 | 24391166 | 26380 | gain | 3199 | IFNLR1 | Y | 0 | 1 | 0.005115965 | 39.43 | 6 |
| 1 | 28666669 | 28737671 | 71002 | gain | 3161 | PHACTR4, RCC1, SNHG3 | Y | 0 | 1 | 0.005115965 | 39.43 | 7 |
| 1 | 49372054 | 49380088 | 8034 | het_loss | 3145 | AGBL4 | N | 0 | 1 | 0.005115965 | 39.43 | 8 |
| 1 | 153816159 | 153827698 | 11539 | het_loss | 3168 |  | N | 0 | 1 | 0.005115965 | 39.43 | 9 |
| 1 | 205607255 | 205610341 | 3086 | gain | 3007 |  | N | 0 | 1 | 0.005115965 | 39.43 | 10 |
| 1 | 215760485 | 215762451 | 1966 | het_loss | 3117 | GPATCH2 | N | 0 | 1 | 0.005115965 | 39.43 | 11 |
| 1 | 215866737 | 215869900 | 3163 | het_loss | 3151 | GPATCH2 | N | 0 | 1 | 0.005115965 | 39.43 | 12 |
| 2 | 10352668 | 10356083 | 3415 | het_loss | 3007 |  | N | 0 | 1 | 0.005115965 | 39.43 | 13 |
| 2 | 24457024 | 24462631 | 5607 | hom_loss | 3204 |  | N | 0 | 1 | 0.005115965 | 39.43 | 14 |
| 2 | 38468717 | 38471950 | 3233 | het_loss | 3175 |  | N | 0 | 1 | 0.005115965 | 39.43 | 15 |
| 2 | 38516138 | 38524237 | 8099 | het_loss | 3151 |  | N | 0 | 1 | 0.005115965 | 39.43 | 16 |
| 2 | 38726517 | 38731845 | 5328 | het_loss | 3159 |  | N | 0 | 1 | 0.005115965 | 39.43 | 17 |
| 2 | 40620890 | 40624089 | 3199 | het_loss | 3202 |  | N | 0 | 1 | 0.005115965 | 39.43 | 18 |
| 2 | 46641006 | 46643501 | 12495 | gain | 3145 | RHOQ | N | 0 | 1 | 0.005115965 | 39.43 | 19 |
| 2 | 55764753 | 55771586 | 6833 | gain | 3143 | PNPT1 | Y | 1 | 3 | 0.001318303 | 40.7 | 20 |
| 2 | 55764753 | 55771586 | 6833 | gain | 3193 | PNPT1 | Y | 1 | 3 | 0.001318303 | 40.7 | 21 |
| 2 | 55764753 | 55771586 | 6833 | gain | 3282 | PNPT1 | Y | 1 | 3 | 0.001318303 | 40.7 | 22 |
| 2 | 55771587 | 55772965 | 1378 | gain | 3143 | PNPT1 | N | 2 | 3 | 0.003126725 | 20.33 | 23 |
| 2 | 55771587 | 55772965 | 1378 | gain | 3193 | PNPT1 | N | 2 | 3 | 0.003126725 | 20.33 | 24 |
| 2 | 55771587 | 55772965 | 1378 | gain | 3282 | PNPT1 | N | 2 | 3 | 0.003126725 | 20.33 | 25 |
| 2 | 55772966 | 55790559 | 17593 | gain | 3143 | PNPT1 | Y | 1 | 3 | 0.001318303 | 40.7 | 26 |
| 2 | 55772966 | 55790559 | 17593 | gain | 3193 | PNPT1 | Y | 1 | 3 | 0.001318303 | 40.7 | 27 |
| 2 | 55772966 | 55790559 | 17593 | gain | 3282 | PNPT1 | Y | 1 | 3 | 0.001318303 | 40.7 | 28 |
| 2 | 71190677 | 71191310 | 633 | het_loss | 3175 | MCEE | Y | 0 | 1 | 0.005115965 | 39.43 | 29 |
| 2 | 71191311 | 71198107 | 6796 | het_loss | 3175 | MCEE | N | 1 | 2 | 0.014314826 | 26.77 | 30 |
| 2 | 71191311 | 71198107 | 6796 | het_loss | 3204 | MCEE | N | 1 | 2 | 0.014314826 | 26.77 | 31 |
| 2 | 71198108 | 71200120 | 2012 | het_loss | 3143 | MCEE | N | 2 | 5 | 3.02E−05 | 34.83 | 32 |
| 2 | 71198108 | 71200120 | 2012 | het_loss | 3175 | MCEE | N | 2 | 5 | 3.02E−05 | 34.83 | 33 |
| 2 | 71198108 | 71200120 | 2012 | het_loss | 3193 | MCEE | N | 2 | 5 | 3.02E−05 | 34.83 | 34 |
| 2 | 71198108 | 71200120 | 2012 | het_loss | 3200 | MCEE | N | 2 | 5 | 3.02E−05 | 34.83 | 35 |
| 2 | 71198108 | 71200120 | 2012 | het_loss | 3204 | MCEE | N | 2 | 5 | 3.02E−05 | 34.83 | 36 |
| 2 | 74827730 | 74913493 | 85763 | gain | 3118 | HK2 | Y | 0 | 1 | 0.005115965 | 39.43 | 37 |
| 2 | 105418748 | 105435274 | 16526 | het_loss | 3193 | FHL2 | Y | 0 | 1 | 0.005115965 | 39.43 | 38 |
| 2 | 110182348 | 110210249 | 27901 | gain | 3174 | MALL, MIR4267, MIR4436B1, MIR4436B2 | Y | 2 | 1 | 0.198831257 | 6.6 | 39 |
| 2 | 127823042 | 127828410 | 5368 | het_loss | 3273 |  | N | 0 | 1 | 0.005115965 | 39.43 | 40 |
| 2 | 134911636 | 134914254 | 2618 | het_loss | 3273 | MGAT5 | N | 0 | 1 | 0.005115965 | 39.43 | 41 |
| 2 | 203005216 | 203019933 | 14717 | het_loss | 3009 | BMPR2 | N | 2 | 2 | 0.02731135 | 13.37 | 42 |
| 2 | 203005216 | 203019933 | 14717 | het_loss | 3192 | BMPR2 | N | 2 | 2 | 0.02731135 | 13.37 | 43 |
| 2 | 203005216 | 203019933 | 14717 | hom_loss | 3152 | BMPR2 | N | 0 | 1 | 0.005115965 | 39.43 | 44 |
| 2 | 230212897 | 230216339 | 3442 | het_loss | 3154 | DNER | N | 0 | 1 | 0.005115965 | 39.43 | 45 |
| 3 | 122979920 | 122994402 | 14482 | gain | 3202 | IQCB1 | Y | 0 | 1 | 0.005115965 | 39.43 | 46 |
| 4 | 26565071 | 26566345 | 1274 | het_loss | 3010 | STIM2 | N | 85 | 5 | 0.671895631 | 0.75 | 47 |
| 4 | 26565071 | 26566345 | 1274 | het_loss | 3125 | STIM2 | N | 85 | 5 | 0.671895631 | 0.75 | 48 |
| 4 | 26565071 | 26566345 | 1274 | het_loss | 3168 | STIM2 | N | 85 | 5 | 0.671895631 | 0.75 | 49 |
| 4 | 26565071 | 26566345 | 1274 | het_loss | 3282 | STIM2 | N | 85 | 5 | 0.671895631 | 0.75 | 50 |
| 4 | 26565071 | 26566345 | 1274 | het_loss | 3284 | STIM2 | N | 85 | 5 | 0.671895631 | 0.75 | 51 |
| 4 | 26565071 | 26566345 | 1274 | hom_loss | 3273 | STIM2 | N | 1 | 1 | 0.13732578 | 13.21 | 52 |
| 4 | 54838623 | 54873909 | 35286 | gain | 3153 | PDGFRA | Y | 0 | 1 | 0.005115965 | 39.43 | 53 |
| 4 | 90791460 | 90843887 | 52427 | gain | 3168 |  | N | 0 | 1 | 0.005115965 | 39.43 | 54 |
| 4 | 90800863 | 90808258 | 7395 | het_loss | 3009 |  | N | 0 | 2 | 0.005115965 | 66.59 | 55 |
| 4 | 90800863 | 90808258 | 7395 | het_loss | 3284 |  | N | 0 | 2 | 0.005115965 | 66.59 | 56 |
| 5 | 45331278 | 45785151 | 453873 | gain | 3157 | HCN1 | Y | 0 | 1 | 0.005115965 | 39.43 | 57 |
| 5 | 49771219 | 49774457 | 3238 | gain | 3273 | EMB | Y | 0 | 1 | 0.005115965 | 39.43 | 58 |
| 5 | 66619415 | 66636116 | 16701 | gain | 3010 |  | N | 0 | 1 | 0.005115965 | 39.43 | 59 |
| 5 | 78480194 | 78497296 | 17102 | gain | 3205 |  | N | 0 | 1 | 0.005115965 | 39.43 | 60 |
| 5 | 78497296 | 78500551 | 3255 | gain | 3132 |  | N | 0 | 2 | 0.005115965 | 66.59 | 61 |
| 5 | 78497296 | 78500551 | 3255 | gain | 3185 |  | N | 0 | 2 | 0.005115965 | 66.59 | 62 |
| 5 | 78500552 | 78521408 | 20856 | gain | 3132 |  | N | 0 | 3 | 2.49E−05 | 94.48 | 63 |
| 5 | 78500552 | 78521408 | 20856 | gain | 3185 |  | N | 0 | 3 | 2.49E−05 | 94.48 | 64 |
| 5 | 78500552 | 78521408 | 20856 | gain | 3205 |  | N | 0 | 3 | 2.49E−05 | 94.48 | 65 |
| 5 | 78521409 | 78526637 | 5228 | gain | 3132 |  | N | 0 | 2 | 0.005115965 | 66.59 | 66 |
| 5 | 78521409 | 78526637 | 5228 | gain | 3205 |  | N | 0 | 2 | 0.005115965 | 66.59 | 67 |
| 5 | 78526638 | 78531091 | 4453 | gain | 3132 |  | N | 0 | 1 | 0.005115965 | 39.43 | 68 |

TABLE 2-continued

CNV -subregions of interest in this study

| Chr | CNV Subregion Start | CNV Subregion Stop | CNV Subregion Size | CNV Type | PML Case ID | RefSeq Gene Symbol | Exon overlap | NVE cases | PML cases | FET | OR | CNV Subregion No (SRN) |
|---|---|---|---|---|---|---|---|---|---|---|---|---|
| 5 | 83490494 | 83495169 | 4675 | het_loss | 3204 | EDIL3 | N | 0 | 1 | 0.005115965 | 39.43 | 69 |
| 5 | 133372071 | 133379727 | 7656 | hom_loss | 3153 | | N | 0 | 1 | 0.005115965 | 39.43 | 70 |
| 5 | 137836466 | 137843309 | 6843 | hom_loss | 3279 | | N | 1 | 1 | 0.13732578 | 13.21 | 71 |
| 5 | 150159466 | 150161037 | 1571 | het_loss | 3117 | | N | 15 | 4 | 0.040487703 | 3.62 | 72 |
| 5 | 150159466 | 150161037 | 1571 | het_loss | 3180 | | N | 15 | 4 | 0.040487703 | 3.62 | 73 |
| 5 | 150159466 | 150161037 | 1571 | het_loss | 3199 | | N | 15 | 4 | 0.040487703 | 3.62 | 74 |
| 5 | 150159466 | 150161037 | 1571 | het_loss | 3278 | | N | 15 | 4 | 0.040487703 | 3.62 | 75 |
| 5 | 150161038 | 150181399 | 20361 | het_loss | 3117 | | N | 14 | 4 | 0.033744017 | 3.88 | 76 |
| 5 | 150161038 | 150181399 | 20361 | het_loss | 3180 | | N | 14 | 4 | 0.033744017 | 3.88 | 77 |
| 5 | 150161038 | 150181399 | 20361 | het_loss | 3199 | | N | 14 | 4 | 0.033744017 | 3.88 | 78 |
| 5 | 150161038 | 150181399 | 20361 | het_loss | 3278 | | N | 14 | 4 | 0.033744017 | 3.88 | 79 |
| 5 | 150181400 | 150185189 | 3789 | het_loss | 3117 | | N | 13 | 4 | 0.027710312 | 4.18 | 80 |
| 5 | 150181400 | 150185189 | 3789 | het_loss | 3180 | | N | 13 | 4 | 0.027710312 | 4.18 | 81 |
| 5 | 150181400 | 150185189 | 3789 | het_loss | 3199 | | N | 13 | 4 | 0.027710312 | 4.18 | 82 |
| 5 | 150181400 | 150185189 | 3789 | het_loss | 3278 | | N | 13 | 4 | 0.027710312 | 4.18 | 83 |
| 5 | 150185190 | 150191626 | 6436 | hom_loss | 3009 | | N | 6 | 7 | 8.59E−06 | 16.65 | 84 |
| 5 | 150185190 | 150191626 | 6436 | hom_loss | 3143 | | N | 6 | 7 | 8.59E−06 | 16.65 | 85 |
| 5 | 150185190 | 150191626 | 6436 | hom_loss | 3152 | | N | 6 | 7 | 8.59E−06 | 16.65 | 86 |
| 5 | 150185190 | 150191626 | 6436 | hom_loss | 3154 | | N | 6 | 7 | 8.59E−06 | 16.65 | 87 |
| 5 | 150185190 | 150191626 | 6436 | hom_loss | 3193 | | N | 6 | 7 | 8.59E−06 | 16.65 | 88 |
| 5 | 150185190 | 150191626 | 6436 | hom_loss | 3196 | | N | 6 | 7 | 8.59E−06 | 16.65 | 89 |
| 5 | 150185190 | 150191626 | 6436 | hom_loss | 3281 | | N | 6 | 7 | 8.59E−06 | 16.65 | 90 |
| 5 | 150191627 | 150201145 | 9518 | hom_loss | 3009 | | N | 6 | 7 | 8.59E−06 | 16.65 | 91 |
| 5 | 150191627 | 150201145 | 9518 | hom_loss | 3143 | | N | 6 | 7 | 8.59E−06 | 16.65 | 92 |
| 5 | 150191627 | 150201145 | 9518 | hom_loss | 3152 | | N | 6 | 7 | 8.59E−06 | 16.65 | 93 |
| 5 | 150191627 | 150201145 | 9518 | hom_loss | 3154 | | N | 6 | 7 | 8.59E−06 | 16.65 | 94 |
| 5 | 150191627 | 150201145 | 9518 | hom_loss | 3193 | | N | 6 | 7 | 8.59E−06 | 16.65 | 95 |
| 5 | 150191627 | 150201145 | 9518 | hom_loss | 3196 | | N | 6 | 7 | 8.59E−06 | 16.65 | 96 |
| 5 | 150191627 | 150201145 | 9518 | hom_loss | 3281 | | N | 6 | 7 | 8.59E−06 | 16.65 | 97 |
| 5 | 150201146 | 150202601 | 1455 | hom_loss | 3152 | | N | 1 | 3 | 0.001318303 | 40.7 | 98 |
| 5 | 150201146 | 150202601 | 1455 | hom_loss | 3154 | | N | 1 | 3 | 0.001318303 | 40.7 | 99 |
| 5 | 150201146 | 150202601 | 1455 | hom_loss | 3193 | | N | 1 | 3 | 0.001318303 | 40.7 | 100 |
| 5 | 150202602 | 150204134 | 1532 | het_loss | 3132 | | N | 51 | 8 | 0.062987683 | 2.17 | 101 |
| 5 | 150202602 | 150204134 | 1532 | het_loss | 3180 | | N | 51 | 8 | 0.062987683 | 2.17 | 102 |
| 5 | 150202602 | 150204134 | 1532 | het_loss | 3196 | | N | 51 | 8 | 0.062987683 | 2.17 | 103 |
| 5 | 150202602 | 150204134 | 1532 | het_loss | 3273 | | N | 51 | 8 | 0.062987683 | 2.17 | 104 |
| 5 | 150202602 | 150204134 | 1532 | het_loss | 3277 | | N | 51 | 8 | 0.062987683 | 2.17 | 105 |
| 5 | 150202602 | 150204134 | 1532 | het_loss | 3278 | | N | 51 | 8 | 0.062987683 | 2.17 | 106 |
| 5 | 150202602 | 150204134 | 1532 | het_loss | 3280 | | N | 51 | 8 | 0.062987683 | 2.17 | 107 |
| 5 | 150202602 | 150204134 | 1532 | het_loss | 3282 | | N | 51 | 8 | 0.062987683 | 2.17 | 108 |
| 5 | 179590681 | 179626660 | 35979 | het_loss | 3172 | MAPK9 | Y | 0 | 1 | 0.005115965 | 39.43 | 109 |
| 6 | 2882577 | 2947403 | 64826 | het_loss | 3196 | DKFZP686I15217, NQO2, SERPINB6 | Y | 0 | 1 | 0.005115965 | 39.43 | 110 |
| 6 | 2964646 | 2966011 | 1365 | het_loss | 3193 | HTATSF1P2, NQO2 | Y | 0 | 1 | 0.005115965 | 39.43 | 111 |
| 6 | 51766024 | 51773250 | 7226 | het_loss | 3167 | PKHD1 | N | 0 | 1 | 0.005115965 | 39.43 | 112 |
| 6 | 51952217 | 51953475 | 1258 | gain | 3127 | PKHD1 | N | 0 | 1 | 0.005115965 | 39.43 | 113 |
| 6 | 51953476 | 51965723 | 12247 | gain | 3127 | PKHD1 | N | 0 | 2 | 0.005115965 | 66.59 | 114 |
| 6 | 51953476 | 51965723 | 12247 | gain | 3205 | PKHD1 | N | 0 | 2 | 0.005115965 | 66.59 | 115 |
| 6 | 51965724 | 51969378 | 3654 | gain | 3127 | PKHD1 | N | 0 | 1 | 0.005115965 | 39.43 | 116 |
| 6 | 74396294 | 74398409 | 2115 | het_loss | 3009 | SLC17A5 | N | 0 | 2 | 0.005115965 | 66.59 | 117 |
| 6 | 74396294 | 74398409 | 2115 | het_loss | 3160 | SLC17A5 | N | 0 | 2 | 0.005115965 | 66.59 | 118 |
| 6 | 74398410 | 74404837 | 6427 | het_loss | 3009 | SLC17A5 | Y | 0 | 1 | 0.005115965 | 39.43 | 119 |
| 6 | 86416979 | 86431527 | 14548 | het_loss | 3197 | | N | 0 | 1 | 0.005115965 | 39.43 | 120 |
| 6 | 91131823 | 91135670 | 3847 | het_loss | 3171 | | N | 0 | 1 | 0.005115965 | 39.43 | 121 |
| 6 | 107882367 | 107890605 | 8238 | het_loss | 3201 | PDSS2 | Y | 0 | 1 | 0.005115965 | 39.43 | 122 |
| 6 | 166418511 | 166422386 | 3875 | het_loss | 3125 | | N | 11 | 10 | 3.49E−07 | 13.49 | 123 |
| 6 | 166418511 | 166422386 | 3875 | het_loss | 3163 | | N | 11 | 10 | 3.49E−07 | 13.49 | 124 |
| 6 | 166418511 | 166422386 | 3875 | het_loss | 3192 | | N | 11 | 10 | 3.49E−07 | 13.49 | 125 |
| 6 | 166418511 | 166422386 | 3875 | het_loss | 3193 | | N | 11 | 10 | 3.49E−07 | 13.49 | 126 |
| 6 | 166418511 | 166422386 | 3875 | het_loss | 3194 | | N | 11 | 10 | 3.49E−07 | 13.49 | 127 |
| 6 | 166418511 | 166422386 | 3875 | het_loss | 3200 | | N | 11 | 10 | 3.49E−07 | 13.49 | 128 |
| 6 | 166418511 | 166422386 | 3875 | het_loss | 3205 | | N | 11 | 10 | 3.49E−07 | 13.49 | 129 |
| 6 | 166418511 | 166422386 | 3875 | het_loss | 3280 | | N | 11 | 10 | 3.49E−07 | 13.49 | 130 |
| 6 | 166418511 | 166422386 | 3875 | het_loss | 3281 | | N | 11 | 10 | 3.49E−07 | 13.49 | 131 |
| 6 | 166418511 | 166422386 | 3875 | het_loss | 3284 | | N | 11 | 10 | 3.49E−07 | 13.49 | 132 |
| 6 | 166418511 | 166422386 | 3875 | hom_loss | 3009 | | N | 0 | 3 | 2.49E−05 | 94.48 | 133 |
| 6 | 166418511 | 166422386 | 3875 | hom_loss | 3152 | | N | 0 | 3 | 2.49E−05 | 94.48 | 134 |
| 6 | 166418511 | 166422386 | 3875 | hom_loss | 3175 | | N | 0 | 3 | 2.49E−05 | 94.48 | 135 |
| 7 | 65741238 | 65768682 | 27444 | gain | 3152 | KCTD7 | Y | 0 | 2 | 0.005115965 | 66.59 | 136 |
| 7 | 65741238 | 65768682 | 27444 | gain | 3202 | KCTD7 | Y | 0 | 2 | 0.005115965 | 66.59 | 137 |
| 7 | 157174966 | 157177843 | 2877 | het_loss | 3009 | PTPRN2 | N | 0 | 1 | 0.005115965 | 39.43 | 138 |
| 7 | 157425841 | 157496238 | 70397 | gain | 3189 | PTPRN2 | N | 1 | 1 | 0.13732578 | 13.21 | 139 |

TABLE 2-continued

CNV -subregions of interest in this study

| Chr | CNV Subregion Start | CNV Subregion Stop | CNV Subregion Size | CNV Type | PML Case ID | RefSeq Gene Symbol | Exon overlap | NVE cases | PML cases | FET | OR | CNV Subregion No (SRN) |
|---|---|---|---|---|---|---|---|---|---|---|---|---|
| 7 | 158000082 | 158007892 | 7810 | het_loss | 3279 | PTPRN2 | N | 1 | 1 | 0.13732578 | 13.21 | 140 |
| 7 | 158007893 | 158010672 | 2779 | het_loss | 3279 | PTPRN2 | N | 5 | 1 | 0.358539546 | 2.63 | 141 |
| 7 | 158010673 | 158024569 | 13896 | het_loss | 3279 | MIR595, PTPRN2 | Y | 1 | 1 | 0.13732578 | 13.21 | 142 |
| 8 | 23103186 | 23125443 | 22257 | het_loss | 3140 | TNFRSF10A | Y | 0 | 1 | 0.005115965 | 39.43 | 143 |
| 8 | 39914488 | 39919594 | 5106 | het_loss | 3126 | IDO2 | N | 0 | 1 | 0.005115965 | 39.43 | 144 |
| 8 | 79905654 | 79910286 | 4632 | het_loss | 3159 | | N | 0 | 1 | 0.005115965 | 39.43 | 145 |
| 8 | 99790200 | 99799839 | 9639 | het_loss | 3006 | STK3 | N | 0 | 1 | 0.005115965 | 39.43 | 146 |
| 8 | 102049360 | 102064431 | 15071 | het_loss | 3173 | | N | 0 | 3 | 2.49E−05 | 94.48 | 147 |
| 8 | 102049360 | 102064431 | 15071 | het_loss | 3175 | | N | 0 | 3 | 2.49E−05 | 94.48 | 148 |
| 8 | 102049360 | 102064431 | 15071 | het_loss | 3282 | | N | 0 | 3 | 2.49E−05 | 94.48 | 149 |
| 9 | 571398 | 580721 | 9323 | het_loss | 3006 | KANK1 | N | 2 | 1 | 0.198831257 | 6.6 | 150 |
| 9 | 580722 | 584647 | 3925 | het_loss | 3006 | KANK1 | N | 3 | 3 | 0.005933668 | 13.54 | 151 |
| 9 | 580722 | 584647 | 3925 | het_loss | 3200 | KANK1 | N | 3 | 3 | 0.005933668 | 13.54 | 152 |
| 9 | 580722 | 584647 | 3925 | het_loss | 3282 | KANK1 | N | 3 | 3 | 0.005933668 | 13.54 | 153 |
| 9 | 584648 | 598488 | 13840 | het_loss | 3200 | KANK1 | N | 2 | 2 | 0.02731135 | 13.37 | 154 |
| 9 | 584648 | 598488 | 13840 | het_loss | 3282 | KANK1 | N | 2 | 2 | 0.02731135 | 13.37 | 155 |
| 9 | 634039 | 637589 | 3550 | het_loss | 3273 | KANK1 | N | 0 | 2 | 0.005115965 | 66.59 | 156 |
| 9 | 634039 | 637589 | 3550 | het_loss | 3282 | KANK1 | N | 0 | 2 | 0.005115965 | 66.59 | 157 |
| 9 | 74050088 | 74059447 | 9359 | het_loss | 3165 | GDA | Y | 0 | 1 | 0.005115965 | 39.43 | 158 |
| 9 | 93140394 | 93447826 | 307432 | gain | 3198 | AUH, MIR3163, MIR3910-1, MIR3910-2, NFIL3 | Y | 0 | 1 | 0.005115965 | 39.43 | 159 |
| 9 | 118564159 | 118575633 | 11474 | gain | 3193 | ASTN2 | N | 0 | 1 | 0.005115965 | 39.43 | 160 |
| 9 | 118657526 | 118664593 | 7067 | het_loss | 3144 | ASTN2 | N | 0 | 1 | 0.005115965 | 39.43 | 161 |
| 9 | 119220847 | 119233078 | 12231 | gain | 3005 | | N | 0 | 1 | 0.005115965 | 39.43 | 162 |
| 10 | 899657 | 1071401 | 171744 | gain | 3161 | GTPBP4, IDI2, IDI2-AS1, LARP4B | Y | 0 | 1 | 0.005115965 | 39.43 | 163 |
| 10 | 76217585 | 76411591 | 194006 | gain | 3179 | KAT6B | Y | 0 | 1 | 0.005115965 | 39.43 | 164 |
| 10 | 116004069 | 116004388 | 4319 | het_loss | 3010 | VWA2 | Y | 0 | 1 | 0.005115965 | 39.43 | 165 |
| 11 | 14677012 | 14689025 | 12013 | het_loss | 3199 | PDE3B | N | 0 | 1 | 0.005115965 | 39.43 | 166 |
| 11 | 34608313 | 34615878 | 7565 | het_loss | 3117 | EHF | Y | 0 | 1 | 0.005115965 | 39.43 | 167 |
| 11 | 62382087 | 62398462 | 16375 | het_loss | 3205 | SLC3A2 | Y | 0 | 1 | 0.005115965 | 39.43 | 168 |
| 11 | 76631014 | 76643625 | 12611 | het_loss | 3193 | GDPD4 | Y | 0 | 1 | 0.005115965 | 39.43 | 169 |
| 12 | 11616557 | 12114030 | 497473 | het_loss | 3126 | ETV6 | Y | 0 | 1 | 0.005115965 | 39.43 | 170 |
| 12 | 12438904 | 12778142 | 339238 | het_loss | 3126 | APOLD1, CDKN1B, CREBL2, DUSP16, GPR19, LOH12CR1 | Y | 0 | 1 | 0.005115965 | 39.43 | 171 |
| 12 | 12968705 | 12971310 | 2605 | gain | 3127 | | N | 0 | 1 | 0.005115965 | 39.43 | 172 |
| 12 | 91845527 | 92201342 | 355815 | het_loss | 3126 | EEA1, LOC643339 | Y | 0 | 1 | 0.005115965 | 39.43 | 173 |
| 12 | 92215898 | 92567120 | 351222 | het_loss | 3126 | LOC643339, MRPL42, NUDT4, NUDT4P1, SOCS2, SOCS2-AS1, UBE2N | Y | 0 | 1 | 0.005115965 | 39.43 | 174 |
| 12 | 92568362 | 93307172 | 738810 | het_loss | 3126 | CCDC41, CRADD, PLXNC1 | Y | 0 | 1 | 0.005115965 | 39.43 | 175 |
| 12 | 111061085 | 111064486 | 3401 | het_loss | 3004 | TRAFD1 | Y | 0 | 1 | 0.005115965 | 39.43 | 176 |
| 13 | 40939924 | 41026908 | 86984 | gain | 3140 | RGCC | Y | 0 | 1 | 0.005115965 | 39.43 | 177 |
| 13 | 75006025 | 75016304 | 10279 | gain | 3009 | COMMD6 | Y | 0 | 2 | 0.005115965 | 66.59 | 178 |
| 13 | 75006025 | 75016304 | 10279 | gain | 3152 | COMMD6 | Y | 0 | 2 | 0.005115965 | 66.59 | 179 |
| 13 | 91811087 | 91814369 | 3282 | het_loss | 3143 | GPC5 | N | 1 | 1 | 0.13732578 | 13.21 | 180 |
| 13 | 91811087 | 91811118 | 31 | hom_loss | 3173 | GPC5 | N | 0 | 1 | 0.005115965 | 39.43 | 181 |
| 13 | 110754499 | 110778301 | 23802 | gain | 3006 | ARHGEF7, TEX29 | Y | 0 | 1 | 0.005115965 | 39.43 | 182 |
| 14 | 20021118 | 20055469 | 34351 | gain | 3205 | RNASE10 | Y | 0 | 1 | 0.005115965 | 39.43 | 183 |
| 14 | 20426824 | 20481852 | 55028 | hom_loss | 3200 | ECRP, RNASE3 | Y | 0 | 1 | 0.005115965 | 39.43 | 184 |
| 14 | 20430810 | 20458350 | 27540 | het_loss | 3192 | ECRP | Y | 3 | 1 | 0.256004559 | 4.39 | 185 |
| 14 | 20458351 | 20481852 | 23501 | het_loss | 3192 | | N | 4 | 1 | 0.309147091 | 3.29 | 186 |
| 14 | 20481853 | 20490129 | 8276 | het_loss | 3192 | | N | 1 | 1 | 0.13732578 | 13.21 | 187 |
| 14 | 21096689 | 21105611 | 8922 | het_loss | 3125 | | N | 0 | 5 | 1.16E−07 | 152.56 | 188 |
| 14 | 21096689 | 21105611 | 8922 | het_loss | 3175 | | N | 0 | 5 | 1.16E−07 | 152.56 | 189 |
| 14 | 21096689 | 21105611 | 8922 | het_loss | 3194 | | N | 0 | 5 | 1.16E−07 | 152.56 | 190 |
| 14 | 21096689 | 21105611 | 8922 | het_loss | 3204 | | N | 0 | 5 | 1.16E−07 | 152.56 | 191 |
| 14 | 21096689 | 21105611 | 8922 | het_loss | 3273 | | N | 0 | 5 | 1.16E−07 | 152.56 | 192 |
| 14 | 21120750 | 21125513 | 4763 | gain | 3143 | | N | 1 | 2 | 0.014314826 | 26.77 | 193 |
| 14 | 21120750 | 21125513 | 4763 | gain | 3173 | | N | 1 | 2 | 0.014314826 | 26.77 | 194 |
| 14 | 60901636 | 60909492 | 7856 | het_loss | 3193 | PRKCH | N | 0 | 1 | 0.005115965 | 39.43 | 195 |
| 14 | 60912874 | 60921269 | 8395 | het_loss | 3174 | PRKCH | N | 0 | 1 | 0.005115965 | 39.43 | 196 |
| 14 | 63937192 | 63944459 | 7267 | het_loss | 3205 | MTHFD1 | Y | 0 | 1 | 0.005115965 | 39.43 | 197 |
| 14 | 95754535 | 95759056 | 4521 | het_loss | 3009 | BDKRB2 | N | 0 | 3 | 2.49E−05 | 94.48 | 198 |
| 14 | 95754535 | 95759056 | 4521 | het_loss | 3173 | BDKRB2 | N | 0 | 3 | 2.49E−05 | 94.48 | 199 |
| 14 | 95754535 | 95759056 | 4521 | het_loss | 3202 | BDKRB2 | N | 0 | 3 | 2.49E−05 | 94.48 | 200 |
| 15 | 66065925 | 66082418 | 16493 | het_loss | 3010 | | N | 0 | 1 | 0.005115965 | 39.43 | 201 |
| 15 | 70432627 | 70443017 | 10390 | gain | 3169 | HEXA | Y | 0 | 1 | 0.005115965 | 39.43 | 202 |

TABLE 2-continued

CNV -subregions of interest in this study

| Chr | CNV Subregion Start | CNV Subregion Stop | CNV Subregion Size | CNV Type | PML Case ID | RefSeq Gene Symbol | Exon overlap | NVE cases | PML cases | FET | OR | CNV Subregion No (SRN) |
|---|---|---|---|---|---|---|---|---|---|---|---|---|
| 15 | 75096101 | 75101523 | 5422 | gain | 3200 | PSTPIP1 | Y | 0 | 1 | 0.005115965 | 39.43 | 203 |
| 15 | 75101524 | 75105788 | 4264 | gain | 3132 | PSTPIP1 | Y | 0 | 2 | 0.005115965 | 66.59 | 204 |
| 15 | 75101524 | 75105788 | 4264 | gain | 3200 | PSTPIP1 | Y | 0 | 2 | 0.005115965 | 66.59 | 205 |
| 15 | 75105789 | 75109086 | 3297 | gain | 3127 | PSTPIP1 | Y | 0 | 5 | 1.16E-07 | 152.56 | 206 |
| 15 | 75105789 | 75109086 | 3297 | gain | 3132 | PSTPIP1 | Y | 0 | 5 | 1.16E-07 | 152.56 | 207 |
| 15 | 75105789 | 75109086 | 3297 | gain | 3199 | PSTPIP1 | Y | 0 | 5 | 1.16E-07 | 152.56 | 208 |
| 15 | 75105789 | 75109086 | 3297 | gain | 3200 | PSTPIP1 | Y | 0 | 5 | 1.16E-07 | 152.56 | 209 |
| 15 | 75105789 | 75109086 | 3297 | gain | 3279 | PSTPIP1 | Y | 0 | 5 | 1.16E-07 | 152.56 | 210 |
| 15 | 75109087 | 75115806 | 6719 | gain | 3127 | PSTPIP1 | Y | 1 | 5 | 9.14E-06 | 69.72 | 211 |
| 15 | 75109087 | 75115806 | 6719 | gain | 3132 | PSTPIP1 | Y | 1 | 5 | 9.14E-06 | 69.72 | 212 |
| 15 | 75109087 | 75115806 | 6719 | gain | 3199 | PSTPIP1 | Y | 1 | 5 | 9.14E-06 | 69.72 | 213 |
| 15 | 75109087 | 75115806 | 6719 | gain | 3200 | PSTPIP1 | Y | 1 | 5 | 9.14E-06 | 69.72 | 214 |
| 15 | 75109087 | 75115806 | 6719 | gain | 3279 | PSTPIP1 | Y | 1 | 5 | 9.14E-06 | 69.72 | 215 |
| 15 | 75115807 | 75117798 | 1991 | gain | 3200 | PSTPIP1 | Y | 1 | 1 | 0.13732578 | 13.21 | 216 |
| 15 | 88999998 | 89016848 | 16850 | het_loss | 3172 |  | N | 0 | 1 | 0.005115965 | 39.43 | 217 |
| 16 | 6823677 | 6884976 | 61299 | het_loss | 3126 | RBFOX1 | N | 0 | 1 | 0.005115965 | 39.43 | 218 |
| 16 | 6886815 | 6896330 | 9515 | het_loss | 3126 | RBFOX1 | N | 0 | 1 | 0.005115965 | 39.43 | 219 |
| 16 | 6942078 | 6945539 | 3461 | gain | 3173 | RBFOX1 | N | 1 | 3 | 0.001318303 | 40.7 | 220 |
| 16 | 6942078 | 6945539 | 3461 | gain | 3175 | RBFOX1 | N | 1 | 3 | 0.001318303 | 40.7 | 221 |
| 16 | 6942078 | 6945539 | 3461 | gain | 3282 | RBFOX1 | N | 1 | 3 | 0.001318303 | 40.7 | 222 |
| 16 | 23844022 | 23848772 | 4750 | het_loss | 3198 | PRKCB | N | 7 | 1 | 0.447101793 | 1.88 | 223 |
| 16 | 23892842 | 23893968 | 1126 | gain | 3199 | PRKCB | N | 0 | 1 | 0.005115965 | 39.43 | 224 |
| 16 | 23893969 | 23903495 | 9526 | gain | 3199 | PRKCB | N | 0 | 2 | 0.005115965 | 66.59 | 225 |
| 16 | 23893969 | 23903495 | 9526 | gain | 3205 | PRKCB | N | 0 | 2 | 0.005115965 | 66.59 | 226 |
| 16 | 23903496 | 23908248 | 4752 | gain | 3205 | PRKCB | Y | 0 | 1 | 0.005115965 | 39.43 | 227 |
| 16 | 69047888 | 69050151 | 2263 | gain | 3174 | FUK | N | 0 | 2 | 0.005115965 | 66.59 | 228 |
| 16 | 69047888 | 69050151 | 2263 | gain | 3185 | FUK | N | 0 | 2 | 0.005115965 | 66.59 | 229 |
| 16 | 69052450 | 69081640 | 29190 | het_loss | 3197 | COG4, FUK | Y | 0 | 1 | 0.005115965 | 39.43 | 230 |
| 16 | 70653499 | 70665447 | 11948 | gain | 3143 | HPR | Y | 0 | 6 | 1.16E-07 | 182.82 | 231 |
| 16 | 70653499 | 70665447 | 11948 | gain | 3152 | HPR | Y | 0 | 6 | 1.16E-07 | 182.82 | 232 |
| 16 | 70653499 | 70665447 | 11948 | gain | 3192 | HPR | Y | 0 | 6 | 1.16E-07 | 182.82 | 233 |
| 16 | 70653499 | 70665447 | 11948 | gain | 3200 | HPR | Y | 0 | 6 | 1.16E-07 | 182.82 | 234 |
| 16 | 70653499 | 70665447 | 11948 | gain | 3282 | HPR | Y | 0 | 6 | 1.16E-07 | 182.82 | 235 |
| 16 | 70653499 | 70665447 | 11948 | gain | 3284 | HPR | Y | 0 | 6 | 1.16E-07 | 182.82 | 236 |
| 17 | 69341925 | 70202523 | 860598 | gain | 3183 | BTBD17, C17orf77, CD300A, CD300C, CD300E, CD300LB, CD300LD, CD300LF, DNAI2, GPR142, GPRC5C, KIF19, MGC16275, RAB37, RPL38, TTYH2 | Y | 1 | 1 | 0.13732578 | 13.21 | 237 |
| 17 | 75608151 | 75611602 | 3451 | het_loss | 3144 | TBC1D16 | N | 1 | 7 | 5.37E-08 | 100.4 | 238 |
| 17 | 75608151 | 75611602 | 3451 | het_loss | 3152 | TBC1D16 | N | 1 | 7 | 5.37E-08 | 100.4 | 239 |
| 17 | 75608151 | 75611602 | 3451 | het_loss | 3163 | TBC1D16 | N | 1 | 7 | 5.37E-08 | 100.4 | 240 |
| 17 | 75608151 | 75611602 | 3451 | het_loss | 3192 | TBC1D16 | N | 1 | 7 | 5.37E-08 | 100.4 | 241 |
| 17 | 75608151 | 75611602 | 3451 | het_loss | 3200 | TBC1D16 | N | 1 | 7 | 5.37E-08 | 100.4 | 242 |
| 17 | 75608151 | 75611602 | 3451 | het_loss | 3204 | TBC1D16 | N | 1 | 7 | 5.37E-08 | 100.4 | 243 |
| 17 | 75608151 | 75611602 | 3451 | het_loss | 3284 | TBC1D16 | N | 1 | 7 | 5.37E-08 | 100.4 | 244 |
| 17 | 75608151 | 75611602 | 3451 | hom_loss | 3009 | TBC1D16 | N | 0 | 1 | 0.005115965 | 39.43 | 245 |
| 17 | 75611602 | 75615433 | 3831 | hom_loss | 3175 | TBC1D16 | N | 0 | 1 | 0.005115965 | 39.43 | 246 |
| 17 | 75611603 | 75615433 | 3830 | het_loss | 3144 | TBC1D16 | N | 1 | 4 | 0.000112689 | 55.01 | 247 |
| 17 | 75611603 | 75615433 | 3830 | het_loss | 3152 | TBC1D16 | N | 1 | 4 | 0.000112689 | 55.01 | 248 |
| 17 | 75611603 | 75615433 | 3830 | het_loss | 3163 | TBC1D16 | N | 1 | 4 | 0.000112689 | 55.01 | 249 |
| 17 | 75611603 | 75615433 | 3830 | het_loss | 3200 | TBC1D16 | N | 1 | 4 | 0.000112689 | 55.01 | 250 |
| 17 | 76241510 | 76247304 | 5794 | gain | 3205 | RPTOR | N | 0 | 1 | 0.005115965 | 39.43 | 251 |
| 17 | 76247305 | 76265683 | 18378 | gain | 3127 | RPTOR | N | 0 | 2 | 0.005115965 | 66.59 | 252 |
| 17 | 76247305 | 76265683 | 18378 | gain | 3205 | RPTOR | N | 0 | 2 | 0.005115965 | 66.59 | 253 |
| 17 | 76265684 | 76267844 | 2160 | gain | 3205 | RPTOR | N | 0 | 1 | 0.005115965 | 39.43 | 254 |
| 18 | 9985530 | 10125331 | 139801 | gain | 3175 |  | N | 0 | 1 | 0.005115965 | 39.43 | 255 |
| 18 | 12764095 | 12781985 | 17890 | gain | 3191 | PTPN2 | Y | 0 | 1 | 0.005115965 | 39.43 | 256 |
| 18 | 27026203 | 27029351 | 3148 | het_loss | 3125 |  | N | 0 | 3 | 2.49E-05 | 94.48 | 257 |
| 18 | 27026203 | 27029351 | 3148 | het_loss | 3143 |  | N | 0 | 3 | 2.49E-05 | 94.48 | 258 |
| 18 | 27026203 | 27029351 | 3148 | het_loss | 3175 |  | N | 0 | 3 | 2.49E-05 | 94.48 | 259 |
| 18 | 42537949 | 42663605 | 125656 | gain | 3125 | PIAS2, ST8SIA5 | Y | 0 | 1 | 0.005115965 | 39.43 | 260 |
| 18 | 46917195 | 46945018 | 27823 | het_loss | 3161 |  | N | 0 | 1 | 0.005115965 | 39.43 | 261 |
| 18 | 59457622 | 59465699 | 8077 | het_loss | 3145 | SERPINB4 | Y | 0 | 1 | 0.005115965 | 39.43 | 262 |
| 19 | 3270755 | 3291144 | 20389 | gain | 3205 |  | N | 0 | 1 | 0.005115965 | 39.43 | 263 |
| 19 | 46386511 | 46388364 | 1853 | hom_loss | 3175 |  | N | 0 | 1 | 0.005115965 | 39.43 | 264 |
| 19 | 52496536 | 52501292 | 4756 | gain | 3124 |  | N | 0 | 1 | 0.005115965 | 39.43 | 265 |
| 19 | 55247874 | 55250186 | 2312 | het_loss | 3163 | FLJ26850 | N | 4 | 5 | 0.000161709 | 17.38 | 266 |
| 19 | 55247874 | 55250186 | 2312 | het_loss | 3173 | FLJ26850 | N | 4 | 5 | 0.000161709 | 17.38 | 267 |
| 19 | 55247874 | 55250186 | 2312 | het_loss | 3192 | FLJ26850 | N | 4 | 5 | 0.000161709 | 17.38 | 268 |

TABLE 2-continued

CNV -subregions of interest in this study

| Chr | CNV Subregion Start | CNV Subregion Stop | CNV Subregion Size | CNV Type | PML Case ID | RefSeq Gene Symbol | Exon overlap | NVE cases | PML cases | FET | OR | CNV Subregion No (SRN) |
|---|---|---|---|---|---|---|---|---|---|---|---|---|
| 19 | 55247874 | 55250186 | 2312 | het_loss | 3200 | FLJ26850 | N | 4 | 5 | 0.000161709 | 17.38 | 269 |
| 19 | 55247874 | 55250186 | 2312 | het_loss | 3280 | FLJ26850 | N | 4 | 5 | 0.000161709 | 17.38 | 270 |
| 19 | 55250187 | 55252420 | 2233 | het_loss | 3163 | FLJ26850 | N | 4 | 6 | 1.80E−05 | 21.15 | 271 |
| 19 | 55250187 | 55252420 | 2233 | het_loss | 3173 | FLJ26850 | N | 4 | 6 | 1.80E−05 | 21.15 | 272 |
| 19 | 55250187 | 55252420 | 2233 | het_loss | 3192 | FLJ26850 | N | 4 | 6 | 1.80E−05 | 21.15 | 273 |
| 19 | 55250187 | 55252420 | 2233 | het_loss | 3194 | FLJ26850 | N | 4 | 6 | 1.80E−05 | 21.15 | 274 |
| 19 | 55250187 | 55252420 | 2233 | het_loss | 3200 | FLJ26850 | N | 4 | 6 | 1.80E−05 | 21.15 | 275 |
| 19 | 55250187 | 55252420 | 2233 | het_loss | 3280 | FLJ26850 | N | 4 | 6 | 1.80E−05 | 21.15 | 276 |
| 19 | 55250187 | 55252420 | 2233 | hom_loss | 3175 | FLJ26850 | N | 0 | 2 | 0.005115965 | 66.59 | 277 |
| 19 | 55250187 | 55252420 | 2233 | hom_loss | 3202 | FLJ26850 | N | 0 | 2 | 0.005115965 | 66.59 | 278 |
| 19 | 56964168 | 57308449 | 344281 | gain | 3155 | FPR2, FPR3, ZNF350, ZNF432, ZNF577, ZNF613, ZNF614, ZNF615, ZNF649, ZNF841 | Y | 3 | 2 | 0.043434433 | 8.91 | 279 |
| 19 | 56964168 | 57308449 | 344281 | gain | 3157 | FPR2, FPR3, ZNF350, ZNF432, ZNF577, ZNF613, ZNF614, ZNF615, ZNF649, ZNF841 | Y | 3 | 2 | 0.043434433 | 8.91 | 280 |
| 19 | 59016855 | 59023850 | 6995 | het_loss | 3117 | NLRP12 | Y | 0 | 1 | 0.005115965 | 39.43 | 281 |
| 19 | 59249279 | 59250741 | 1462 | hom_loss | 3160 | VSTM1 | N | 37 | 2 | 1 | 0.7 | 282 |
| 19 | 59249279 | 59250741 | 1462 | hom_loss | 3164 | VSTM1 | N | 37 | 2 | 1 | 0.7 | 283 |
| 19 | 59250742 | 59251831 | 1089 | hom_loss | 3117 | VSTM1 | N | 38 | 4 | 0.533838399 | 1.39 | 284 |
| 19 | 59250742 | 59251831 | 1089 | hom_loss | 3160 | VSTM1 | N | 38 | 4 | 0.533838399 | 1.39 | 285 |
| 19 | 59250742 | 59251831 | 1089 | hom_loss | 3164 | VSTM1 | N | 38 | 4 | 0.533838399 | 1.39 | 286 |
| 19 | 59250742 | 59251831 | 1089 | hom_loss | 3277 | VSTM1 | N | 38 | 4 | 0.533838399 | 1.39 | 287 |
| 20 | 17844577 | 17954650 | 110073 | gain | 3166 | MGME1, OVOL2, SNORD17, SNX5 | Y | 0 | 1 | 0.005115965 | 39.43 | 288 |
| 20 | 42706680 | 42711434 | 4754 | het_loss | 3125 | ADA | N | 0 | 1 | 0.005115965 | 39.43 | 289 |
| 21 | 15237071 | 15312960 | 75889 | gain | 3009 | NRIP1 | Y | 0 | 1 | 0.005115965 | 39.43 | 290 |
| 21 | 29643302 | 29647950 | 4648 | het_loss | 3202 | BACH1 | Y | 0 | 1 | 0.005115965 | 39.43 | 291 |
| 21 | 44634707 | 44637543 | 2836 | gain | 3200 | TRPM2 | Y | 1 | 3 | 0.001318303 | 40.7 | 292 |
| 21 | 44634707 | 44637543 | 2836 | gain | 3205 | TRPM2 | Y | 1 | 3 | 0.001318303 | 40.7 | 293 |
| 21 | 44634707 | 44637543 | 2836 | gain | 3279 | TRPM2 | Y | 1 | 3 | 0.001318303 | 40.7 | 294 |
| 21 | 44637544 | 44641658 | 4114 | gain | 3127 | TRPM2 | Y | 1 | 5 | 9.14E−06 | 69.72 | 295 |
| 21 | 44637544 | 44641658 | 4114 | gain | 3185 | TRPM2 | Y | 1 | 5 | 9.14E−06 | 69.72 | 296 |
| 21 | 44637544 | 44641658 | 4114 | gain | 3200 | TRPM2 | Y | 1 | 5 | 9.14E−06 | 69.72 | 297 |
| 21 | 44637544 | 44641658 | 4114 | gain | 3205 | TRPM2 | Y | 1 | 5 | 9.14E−06 | 69.72 | 298 |
| 21 | 44637544 | 44641658 | 4114 | gain | 3279 | TRPM2 | Y | 1 | 5 | 9.14E−06 | 69.72 | 299 |
| 21 | 44641659 | 44643973 | 2314 | gain | 3127 | TRPM2 | Y | 1 | 4 | 0.000112689 | 55.01 | 300 |
| 21 | 44641659 | 44643973 | 2314 | gain | 3185 | TRPM2 | Y | 1 | 4 | 0.000112689 | 55.01 | 301 |
| 21 | 44641659 | 44643973 | 2314 | gain | 3200 | TRPM2 | Y | 1 | 4 | 0.000112689 | 55.01 | 302 |
| 21 | 44641659 | 44643973 | 2314 | gain | 3279 | TRPM2 | Y | 1 | 4 | 0.000112689 | 55.01 | 303 |
| 21 | 44643974 | 44657372 | 13398 | het_loss | 3161 | TRPM2 | Y | 1 | 1 | 0.13732578 | 13.21 | 304 |
| 21 | 44643975 | 44657372 | 13397 | gain | 3127 | TRPM2 | Y | 0 | 5 | 1.16E−07 | 152.56 | 305 |
| 21 | 44643975 | 44657372 | 13397 | gain | 3185 | TRPM2 | Y | 0 | 5 | 1.16E−07 | 152.56 | 306 |
| 21 | 44643975 | 44657372 | 13397 | gain | 3200 | TRPM2 | Y | 0 | 5 | 1.16E−07 | 152.56 | 307 |
| 21 | 44643975 | 44657372 | 13397 | gain | 3205 | TRPM2 | Y | 0 | 5 | 1.16E−07 | 152.56 | 308 |
| 21 | 44643975 | 44657372 | 13397 | gain | 3279 | TRPM2 | Y | 0 | 5 | 1.16E−07 | 152.56 | 309 |
| 21 | 44657373 | 44660198 | 2825 | gain | 3127 | TRPM2 | Y | 0 | 3 | 2.49E−05 | 94.48 | 310 |
| 21 | 44657373 | 44660198 | 2825 | gain | 3200 | TRPM2 | Y | 0 | 3 | 2.49E−05 | 94.48 | 311 |
| 21 | 44657373 | 44660198 | 2825 | gain | 3279 | TRPM2 | Y | 0 | 3 | 2.49E−05 | 94.48 | 312 |
| 21 | 44660199 | 44666832 | 6633 | gain | 3127 | TRPM2 | Y | 0 | 4 | 2.49E−05 | 123.12 | 313 |
| 21 | 44660199 | 44666832 | 6633 | gain | 3200 | TRPM2 | Y | 0 | 4 | 2.49E−05 | 123.12 | 314 |
| 21 | 44660199 | 44666832 | 6633 | gain | 3205 | TRPM2 | Y | 0 | 4 | 2.49E−05 | 123.12 | 315 |
| 21 | 44660199 | 44666832 | 6633 | gain | 3279 | TRPM2 | Y | 0 | 4 | 2.49E−05 | 123.12 | 316 |
| 21 | 44666833 | 44669596 | 2763 | gain | 3127 | TRPM2 | Y | 0 | 3 | 2.49E−05 | 94.48 | 317 |
| 21 | 44666833 | 44669596 | 2763 | gain | 3205 | TRPM2 | Y | 0 | 3 | 2.49E−05 | 94.48 | 318 |
| 21 | 44666833 | 44669596 | 2763 | gain | 3279 | TRPM2 | Y | 0 | 3 | 2.49E−05 | 94.48 | 319 |
| 21 | 44669597 | 44671482 | 1885 | gain | 3205 | TRPM2 | Y | 0 | 2 | 0.005115965 | 66.59 | 320 |
| 21 | 44669597 | 44671482 | 1885 | gain | 3279 | TRPM2 | Y | 0 | 2 | 0.005115965 | 66.59 | 321 |
| 21 | 44671483 | 44681194 | 9711 | gain | 3205 | TRPM2 | Y | 0 | 1 | 0.005115965 | 39.43 | 322 |
| 21 | 45348895 | 45354709 | 5925 | het_loss | 3179 | ADARB1 | N | 0 | 1 | 0.005115965 | 39.43 | 323 |
| 22 | 37689058 | 37715385 | 26327 | gain | 3169 | APOBEC3A, APOBEC3A_B, APOBEC3B | Y | 0 | 1 | 0.005115965 | 39.43 | 324 |
| 22 | 39257585 | 39261621 | 4036 | het_loss | 3005 | MKL1 | N | 0 | 1 | 0.005115965 | 39.43 | 325 |
| 22 | 40642402 | 40655210 | 12808 | gain | 3205 | TNFRSF13C | Y | 0 | 1 | 0.005115965 | 39.43 | 326 |
| 22 | 40655820 | 40659632 | 3812 | gain | 3185 | | N | 0 | 2 | 0.005115965 | 66.59 | 327 |
| 22 | 40655820 | 40659632 | 3812 | gain | 3205 | | N | 0 | 2 | 0.005115965 | 66.59 | 328 |
| 22 | 40659633 | 40663049 | 3416 | gain | 3127 | | N | 0 | 3 | 2.49E−05 | 94.48 | 329 |
| 22 | 40659633 | 40663049 | 3416 | gain | 3185 | | N | 0 | 3 | 2.49E−05 | 94.48 | 330 |

TABLE 2-continued

CNV-subregions of interest in this study

| Chr | CNV Subregion Start | CNV Subregion Stop | CNV Subregion Size | CNV Type | PML Case ID | RefSeq Gene Symbol | Exon overlap | NVE cases | PML cases | FET | OR | CNV Subregion No (SRN) |
|---|---|---|---|---|---|---|---|---|---|---|---|---|
| 22 | 40659633 | 40663049 | 3416 | gain | 3205 | | N | 0 | 3 | 2.49E−05 | 94.48 | 331 |
| 22 | 40663050 | 40668079 | 5029 | gain | 3127 | CENPM | Y | 0 | 5 | 1.16E−07 | 152.56 | 332 |
| 22 | 40663050 | 40668079 | 5029 | gain | 3185 | CENPM | Y | 0 | 5 | 1.16E−07 | 152.56 | 333 |
| 22 | 40663050 | 40668079 | 5029 | gain | 3190 | CENPM | Y | 0 | 5 | 1.16E−07 | 152.56 | 334 |
| 22 | 40663050 | 40668079 | 5029 | gain | 3202 | CENPM | Y | 0 | 5 | 1.16E−07 | 152.56 | 335 |
| 22 | 40663050 | 40668079 | 5029 | gain | 3205 | CENPM | Y | 0 | 5 | 1.16E−07 | 152.56 | 336 |
| 22 | 40668080 | 40671866 | 3786 | gain | 3127 | CENPM | Y | 0 | 3 | 2.49E−05 | 94.48 | 337 |
| 22 | 40668080 | 40671866 | 3786 | gain | 3185 | CENPM | Y | 0 | 3 | 2.49E−05 | 94.48 | 338 |
| 22 | 40668080 | 40671866 | 3786 | gain | 3205 | CENPM | Y | 0 | 3 | 2.49E−05 | 94.48 | 339 |
| 22 | 40671867 | 40673250 | 1383 | gain | 3185 | CENPM | Y | 0 | 2 | 0.005115965 | 66.59 | 340 |
| 22 | 40671867 | 40673250 | 1383 | gain | 3205 | CENPM | Y | 0 | 2 | 0.005115965 | 66.59 | 341 |
| 22 | 40673251 | 40675788 | 2537 | gain | 3205 | | N | 0 | 1 | 0.005115965 | 39.43 | 342 |
| 23 | 232907 | 234429 | 1522 | het_loss | 3007 | PPP2R3B | N | 0 | 1 | 0.005115965 | 39.43 | 343 |
| 23 | 7585301 | 7769322 | 184021 | gain | 3172 | | N | 5 | 1 | 0.358539546 | 2.63 | 344 |
| 23 | 7769323 | 7773949 | 4626 | gain | 3172 | VCX | Y | 7 | 1 | 0.447101793 | 1.88 | 345 |
| 23 | 7773982 | 7779354 | 5372 | het_loss | 3132 | | N | 0 | 3 | 2.49E−05 | 94.48 | 346 |
| 23 | 7773982 | 7779354 | 5372 | het_loss | 3171 | | N | 0 | 3 | 2.49E−05 | 94.48 | 347 |
| 23 | 7773982 | 7779354 | 5372 | het_loss | 3204 | | N | 0 | 3 | 2.49E−05 | 94.48 | 348 |
| 23 | 7773982 | 7779353 | 5371 | gain | 3172 | | N | 5 | 1 | 0.358539546 | 2.63 | 349 |
| 23 | 7779354 | 7815400 | 36046 | gain | 3172 | | N | 6 | 1 | 0.404443314 | 2.19 | 350 |
| 23 | 7779355 | 8093113 | 313758 | het_loss | 3171 | MIR651, PNPLA4 | Y | 0 | 1 | 0.005115965 | 39.43 | 351 |
| 23 | 7815401 | 7830994 | 15593 | gain | 3172 | PNPLA4 | Y | 7 | 1 | 0.447101793 | 1.88 | 352 |
| 23 | 48358646 | 48408854 | 50208 | het_loss | 3009 | | N | 0 | 1 | 0.005115965 | 39.43 | 353 |
| 23 | 64710574 | 64725828 | 15254 | gain | 3125 | | N | 0 | 1 | 0.005115965 | 39.43 | 354 |
| 23 | 73083877 | 73086192 | 2315 | hom_loss | 3193 | JPX | N | 1 | 2 | 0.014314826 | 26.77 | 355 |
| 23 | 73083877 | 73086192 | 2315 | hom_loss | 3200 | JPX | N | 1 | 2 | 0.014314826 | 26.77 | 356 |
| 23 | 122337025 | 122340879 | 3854 | hom_loss | 3125 | GRIA3 | N | 0 | 1 | 0.005115965 | 39.43 | 357 |
| 23 | 148452844 | 148461889 | 9045 | het_loss | 3163 | | N | 7 | 2 | 0.129983268 | 3.8 | 358 |
| 23 | 148452844 | 148461889 | 9045 | het_loss | 3205 | | N | 7 | 2 | 0.129983268 | 3.8 | 359 |
| 23 | 148459108 | 148461889 | 2781 | hom_loss | 3144 | | N | 0 | 2 | 0.005115965 | 66.59 | 360 |
| 23 | 148459108 | 148461889 | 2781 | hom_loss | 3193 | | N | 0 | 2 | 0.005115965 | 66.59 | 361 |
| 23 | 149901706 | 149902701 | 995 | gain | 3117 | HMGB3 | Y | 0 | 2 | 0.005115965 | 66.59 | 362 |
| 23 | 149901706 | 149902701 | 995 | gain | 3118 | HMGB3 | Y | 0 | 2 | 0.005115965 | 66.59 | 363 |

Table 2 is identical to Table 1, with a number of exceptions. Firstly, the CNV coordinates listed refer to the actual CNV-subregions found to be unique or significantly different between the disease and normal cohorts, as opposed to Table 1, which lists the original CNVs. Secondly, an extra column details whether genic CNV-subregions of interest overlap an exon or not. Third and fourth, 2 extra columns detail the number of normal cases and the number of disease cases that harbor the relevant CNV-subregion. Finally, 2 columns report Fisher's 2-tailed Exact Test (FET) and the odds ratio (OR). Standard chromosomal numbering used by those skilled in the art is used in Table 2 for the autosomal chromosomes (1-22) but, for convenience with analysis methods, chromosome X is designated as chromosome 23 herein. All coordinates are in hg18.

TABLE 3

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| ADARB1 | intronic | 104 | double-stranded RNA-specific editase 1 isoform 1 | This gene encodes the enzyme responsible for pre-mRNA editing of the glutamate receptor subunit B by site-specific deamination of adenosines. Studies in rat found that this enzyme acted on its own pre-mRNA molecules to convert an AA dinucleotide to an AI dinucleotide which resulted in a new splice site. Alternative splicing of this gene results in several transcript variants, some of which have been characterized by the presence or absence of an ALU cassette insert and a short or long C-terminal region. [provided by RefSeq, July 2008]. Transcript Variant: This variant (1), also known as ADAR2a-L1 or DRADA2a, lacks the ALU cassette insert and contains the long C-terminal region, as compared to variant 2. The resulting isoform (1), also known as hRED1-Short, lacks an internal segment, compared to isoform 2. Publication Note: This RefSeq record includes a subset of the publications that are available for this gene. Please see the Gene record to access additional publications. ##RefSeq-Attributes-START## undergoes RNA editing :: PMID: 11717408, 12045112 ##RefSeq-Attributes-END## ##Evidence-Data-START## Transcript exon combination :: AB194370.1, U76420.1 [ECO: 0000332] RNAseq introns :: single sample supports all introns ERS025084, ERS025085 [ECO: 0000348] ##Evidence-Data-END## | 2 |
| AGBL4 | intronic | 84871 | cytosolic carboxypeptidase 6 | N/A | 3 |
| APOBEC3A | exonic | 200315 | DNA dC->dU-editing enzyme APOBEC-3A isoform a | This gene is a member of the cytidine deaminase gene family. It is one of seven related genes or pseudogenes found in a cluster, thought to result from gene duplication, on chromosome 22. Members of the cluster encode proteins that are structurally and functionally related to the C to U RNA-editing cytidine deaminase APOBEC1. The protein encoded by this gene lacks the zinc binding activity of other family members. The protein plays a role in immunity, by restricting transmission of foreign DNA such as viruses. One mechanism of foreign DNA restriction is deamination of foreign double-stranded DNA cytidines to uridines, which leads to DNA degradation. However, other mechanisms are also thought to be involved, as anti-viral effect is not dependent on deaminase activity. Two transcript variants encoding different isoforms have been found for this gene. [provided by RefSeq, July 2012]. Transcript Variant: This variant (1) represents the longer transcript and encodes the longer isoform (a). Publication Note: This RefSeq record includes a subset of the publications that are available for this gene. Please see the Gene record to access additional publications. ##Evidence-Data-START## Transcript exon combination :: U03891.2, BC126416.1 [ECO: 0000332] RNAseq introns :: single sample supports all introns ERS025081, ERS025084 [ECO: 0000348] ##Evidence-Data-END## | 4 |
| APOBEC3A_B | intronic | 100913187 | probable DNA dC->dU-editing enzyme APOBEC-3A | This gene is a member of the cytidine deaminase gene family. It is one of seven related genes or pseudogenes found in a cluster, thought to result from gene duplication, on chromosome 22. Members of the cluster encode proteins that are structurally and functionally related to the C to U RNA-editing cytidine deaminase APOBEC1. The protein encoded by this gene lacks the zinc binding activity of other family members. The protein plays a role in immunity, by restricting transmission of foreign DNA such as viruses. One mechanism of foreign DNA restriction is deamination of foreign double-stranded DNA cytidines to uridines, which leads to DNA degradation. However, other | 5 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | mechanisms are also thought to be involved, as anti-viral effect is not dependent on deaminase activity. The protein encoded by this gene is the same as that encoded by APOBEC3A; however, this gene is a hybrid gene that results from the deletion of approximately 29.5 kb of sequence between the APOBEC3A gene and the adjacent gene APOBEC3B. The breakpoints of the deletion are within the two genes, so the deletion hybrid is predicted to have the promoter and coding region of APOBEC3A, but the 3' UTR of APOBEC3B. [provided by RefSeq, July 2012]. Publication Note: This RefSeq record includes a subset of the publications that are available for this gene. Please see the Gene record to access additional publications. ##Evidence-Data-START## RNAseq introns :: single sample supports all introns ERS025081, ERS025084 [ECO: 0000348] ##Evidence-Data-END## | |
| APOBEC3B | exonic | 9582 | DNA dC->dU-editing enzyme APOBEC-3B isoform a | This gene is a member of the cytidine deaminase gene family. It is one of seven related genes or pseudogenes found in a cluster, thought to result from gene duplication, on chromosome 22. Members of the cluster encode proteins that are structurally and functionally related to the C to U RNA-editing cytidine deaminase APOBEC1. It is thought that the proteins may be RNA editing enzymes and have roles in growth or cell cycle control. A hybrid gene results from the deletion of approximately 29.5 kb of sequence between this gene, APOBEC3B, and the adjacent gene APOBEC3A. The breakpoints of the deletion are within the two genes, so the deletion allele is predicted to have the promoter and coding region of APOBEC3A, but the 3' UTR of APOBEC3B. Two transcript variants encoding different isoforms have been found for this gene. [provided by RefSeq, July 2012] Transcript Variant: This variant (1) represents the longer transcript and encodes the longer isoform (a). Publication Note: This RefSeq record includes a subset of the publications that are available for this gene. Please see the Gene record to access additional publications. ##Evidence-Data-START## Transcript exon combination :: AY743217.1 [ECO: 0000332] RNAseq introns :: mixed/partial sample support ERS025081, ERS025082 [ECO: 0000350] ##Evidence-Data-END## | 6 |
| APOLD1 | exonic | 81575 | apolipoprotein L domain-containing protein 1 isoform 1 | APOLD1 is an endothelial cell early response protein that may play a role in regulation of endothelial cell signaling and vascular function (Regard et al., 2004 [PubMed 15102925]). [supplied by OMIM, December 2008]. Transcript Variant: This variant (1) represents the longer transcript and encodes the longer isoform (1). Sequence Note: This RefSeq record was created from transcript and genomic sequence data to make the sequence consistent with the reference genome assembly. The extent of this transcript is supported by transcript alignments. ##Evidence-Data-START## Transcript exon combination :: BC042478.1, DR000985.1 [ECO: 0000332] RNAseq introns :: single sample supports all introns ERS025086 [ECO: 0000348] ##Evidence-Data-END## | 7 |
| ARHGEF7 | exonic | 8874 | rho guanine nucleotide exchange factor 7 isoform a | Rho GTPases play a fundamental role in numerous cellular processes triggered by extracellular stimuli that work through G protein coupled receptors. The encoded protein belongs to a family of cytoplasmic proteins that activate the Ras-like family of Rho proteins by exchanging bound GDP for GTP. It forms a complex with the small GTP binding protein Rac1 and recruits Rac1 to membrane ruffles and to focal adhesions. This protein can induce membrane ruffling. Multiple alternatively spliced transcript variants encoding different isoforms have been described for this gene. [provided by RefSeq, July 2008]. Transcript Variant: This variant (1) differs in the 5' UTR, 3' UTR, coding region, | 8 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | and uses a downstream start codon, compared to variant 3. Both variants 1 and 5 encode isoform a, which has a shorter N-terminus and a longer and distinct C-terminus, compared to isoform c. Publication Note: This RefSeq record includes a subset of the publications that are available for this gene. Please see the Gene record to access additional publications. ##Evidence-Data-START## Transcript exon combination :: D63476.1 [ECO: 0000332] RNAseq introns :: single sample supports all introns ERS025081, ERS025082 [ECO: 0000348] ##Evidence-Data-END## | |
| ASTN2 | intronic | 23245 | astrotactin-2 isoform a precursor | This gene encodes a protein that is expressed in the brain and may function in neuronal migration, based on functional studies of the related astrotactin 1 gene in human and mouse. A deletion at this locus has been associated with schizophrenia. Multiple transcript variants encoding different proteins have been found for this locus. [provided by RefSeq, May 2010]. Transcript Variant: This variant (1) represents the longest transcript and encodes the longest isoform (a). ##Evidence-Data-START## Transcript exon combination :: BC146756.1, AB014534.1 [ECO: 0000332] RNAseq introns :: single sample supports all introns ERS025082 [ECO: 0000348] ##Evidence-Data-END## | 9 |
| AUH | exonic | 549 | methylglutaconyl-CoA hydratase, mitochondrial precursor | The methylglutaconyl-CoA hydratase, mitochondrial protein binds to the AU-rich element (ARE), a common element found in the 3' UTR of rapidly decaying mRNA such as c-fos, c-myc and granulocyte/macrophage colony stimulating factor. ARE elements are involved in directing RNA to rapid degradation and deadenylation. AUH is also homologous to enol-CoA hydratase, an enzyme involved in fatty acid degradation, and has been shown to have intrinsic hydratase enzymatic activity. AUH is thus a bifunctional chimera between RNA binding and metabolic enzyme activity. A possible subcellular localization in the mitochondria has been demonstrated for the mouse homolog of this protein which shares 92% identity with the human protein. It has been suggested that AUH may have a novel role as a mitochondrial located AU-binding protein. Human AUH is expressed as a single mRNA species of 1.8 kb, and translated as a 40-kDa precursor protein which is subsequently processed to a 32-kDa mature form. [provided by RefSeq, May 2010]. Publication Note: This RefSeq record includes a subset of the publications that are available for this gene. Please see the Gene record to access additional publications. ##RefSeq-Attributes-START## gene product(s) localized to mito. :: reported by MitoCarta ##RefSeq-Attributes-END## ##Evidence-Data-START## Transcript exon combination :: X79888.1, AL533438.3 [ECO: 0000332] RNAseq introns :: single sample supports all introns ERS025084, ERS025088 [ECO: 0000348] ##Evidence-Data-END## | 10 |
| BACH1 | exonic | 571 | BTB Domain And CNC Homolog 1 | This gene encodes a transcription factor that belongs to the cap'n'collar type of basic region leucine zipper factor family (CNC-bZip). The encoded protein contains broad complex, tramtrack, bric-a-brac/poxvirus and zinc finger (BTB/POZ) domains, which is atypical of CNC-bZip family members. These BTB/POZ domains facilitate protein-protein interactions and formation of homo-and/or hetero-oligomers. When this encoded protein forms a heterodimer with MafK, it functions as a repressor of Maf recognition element (MARE) and transcription is repressed. Multiple alternatively spliced transcript variants have been identified for this gene. [provided by RefSeq, May 2009]. Transcript Variant: This variant (3), also named BACH1t, differs in the 5' UTR, 3' coding region and 3' UTR (compared to variant 1). This variant is represented as non- | 11 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | coding because the use of the 5′-most supported translational start codon, as used in variant 1, renders the transcript a candidate for nonsense-mediated mRNA decay (NMD). This transcript represents the splice variant reported by Kanezaki et al. (PMID: 11069897). Publication Note: This RefSeq record includes a subset of the publications that are available for this gene. Please see the Gene record to access additional publications. ##Evidence-Data-START## RNAseq introns :: mixed/partial sample support ERS025084, ERS025088 [ECO: 0000350] ##Evidence-Data-END## | |
| BDKRB2 | intronic | 624 | B2 bradykinin receptor | This gene encodes a receptor for bradykinin. The 9 aa bradykinin peptide elicits many responses including vasodilation, edema, smooth muscle spasm and pain fiber stimulation. This receptor associates with G proteins that stimulate a phosphatidylinositol-calcium second messenger system. Alternate start codons result in two isoforms of the protein. [provided by RefSeq, July 2008]. Publication Note: This RefSeq record includes a subset of the publications that are available for this gene. Please see the Gene record to access additional publications. ##Evidence-Data-START## Transcript exon combination :: DC369062.1, DC417219.1 [ECO: 0000332] RNAseq introns :: single sample supports all introns ERS025090 [ECO: 0000348] ##Evidence-Data-END## | 12 |
| BMPR2 | intronic | 659 | bone morphogenetic protein receptor type-2 precursor | This gene encodes a member of the bone morphogenetic protein (BMP) receptor family of transmembrane serine/threonine kinases The ligands of this receptor are BMPs, which are members of the TGF-beta superfamily. BMPs are involved in endochondral bone formation and embryogenesis. These proteins transduce their signals through the formation of heteromeric complexes of two different types of serine (threonine) kinase receptors: type I receptors of about 50-55 kD and type II receptors of about 70-80 kD. Type II receptors bind ligands in the absence of type I receptors, but they require their respective type I receptors for signaling, whereas type I receptors require their respective type II receptors for ligand binding. Mutations in this gene have been associated with primary pulmonary hypertension, both familial and fenfluramine-associated, and with pulmonary venoocclusive disease. [provided by RefSeq, July 2008]. Sequence Note: This RefSeq record was created from transcript and genomic sequence data to make the sequence consistent with the reference genome assembly. The extent of this transcript is supported by transcript alignments. Publication Note: This RefSeq record includes a subset of the publications that are available for this gene. Please see the Gene record to access additional publications. ##Evidence-Data-START## Transcript exon combination :: BC052985.2, AK292430.1 [ECO: 0000332] RNAseq introns :: single sample supports all introns ERS025081, ERS025082 [ECO: 0000348] ##Evidence-Data-END## | 13 |
| BTBD17 | exonic | 388419 | BTB/POZ domain-containing protein 17 precursor | N/A | 14 |
| C17orf77 | exonic | 146723 | uncharacterized protein C17orf77 precursor | N/A | 15 |
| CAPZB | intronic | 832 | F-actin-capping protein subunit beta isoform 1 | This gene encodes the beta subunit of the barbed-end actin binding protein, which belongs to the F-actin capping protein family. The capping protein is a heterodimeric actin capping protein that blocks actin filament assembly and disassembly at the fast growing (barbed) filament ends and functions in regulating actin filament dynamics as well as in stabilizing actin filament lengths | 16 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| CCDC41 | exonic | 51134 | centrosomal protein of 83 kDa | in muscle and nonmuscle cells. A pseudogene of this gene is located on the long arm of chromosome 2. Multiple alternatively spliced transcript variants encoding different isoforms have been found. [provided by RefSeq, August 2013]. Transcript Variant: This variant (1) encodes isoform 1. Publication Note: This RefSeq record includes a subset of the publications that are available for this gene. Please see the Gene record to access additional publications. ##Evidence-Data-START## Transcript exon combination :: BC107752.1, BM451686.1 [ECO: 0000332] RNAseq introns :: single sample supports all introns ERS025088 [ECO: 0000348] ##Evidence-Data-END## | 17 |
| CD300A | exonic | 11314 | CMRF35-like molecule 8 isoform 1 precursor | N/A This gene encodes a member of the CD300 glycoprotein family of cell surface proteins found on leukocytes involved in immune response signaling pathways. This gene is located on chromosome 17 in a cluster with all but one of the other family members. Multiple transcript variants encoding different isoforms have been found for this gene. [provided by RefSeq, February 2012]. Transcript Variant: This variant (1) represents the longer transcript and encodes the longer protein (isoform 1), also referred to as IRC1a. Publication Note: This RefSeq record includes a subset of the publications that are available for this gene. Please see the Gene record to access additional publications. ##Evidence-Data-START## Transcript exon combination :: BC032352.1, AL531420.3 [ECO: 0000332] RNAseq introns :: single sample supports all introns ERS025081, ERS025083 [ECO: 0000348] ##Evidence-Data-END## | 18 |
| CD300C | exonic | 10871 | CMRF35-like molecule 6 precursor | The CMRF35 antigen, which was identified by reactivity with a monoclonal antibody, is present on monocytes, neutrophils, and some T and B lymphocytes (Jackson et al., 1992 [PubMed 1349532]). [supplied by OMIM, March 2008]. ##Evidence-Data-START## Transcript exon combination :: BC022279.1, BM922826.1 [ECO: 0000332] RNAseq introns :: single sample supports all introns ERS025084, ERS025087 [ECO: 0000348] ##Evidence-Data-END## | 19 |
| CD300E | exonic | 342510 | CMRF35-like molecule 2 precursor | This gene encodes a member of the CD300 glycoprotein family of cell surface proteins expressed on myeloid cells. The protein interacts with the TYRO protein tyrosine kinase-binding protein and is thought to act as an activating receptor. [provided by RefSeq, November 2012]. Sequence Note: This RefSeq record was created from transcript and genomic sequence data to make the sequence consistent with the reference genome assembly. The genomic coordinates used for the transcript record were based on transcript alignments. An in-frame AUG is located 41 codons upstream of the annotated translation start site but is not being annotated as a start site since it is not conserved and is in a weak Kozak sequence context. ##RefSeq-Attributes-START## ##Evidence-Data-START## CDS uses downstream in-frame AUG :: downstream AUG is associated with N-terminal localization signal ##RefSeq-Attributes-END## ##Evidence-Data-START## Transcript exon combination :: AK303545.1, BX648376.1 [ECO: 0000332] RNAseq introns :: single sample supports all introns ERS025084, ERS025088 [ECO: 0000348] ##Evidence-Data-END## | 20 |
| CD300LB | exonic | 124599 | CMRF35-like molecule 7 precursor | CD300LB is a nonclassical activating receptor of the immunoglobulin (Ig) superfamily expressed on myeloid cells (Martinez-Barriocanal and Sayos, 2006 [PubMed 16920917]). [supplied by OMIM, March 2008]. CCDS Note: The coding region has been updated to shorten the N-terminus to one that is more supported by available conservation data and paralogous family members. The update has a | 21 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| CD300LD | exonic | 100131439 | CMRF35-like molecule 4 precursor | predicted N-terminal signal peptide, which is consistent with functional support for the protein (e.g., PMIDs 16920917, 19359216). ##Evidence-Data-START## Transcript exon combination :: BC028091.1, AY359025.1 [ECO: 0000332] RNAseq introns :: single sample supports all introns ERS025084, ERS025088 [ECO: 0000348] ##Evidence-Data-END## ##RefSeq-Attributes-START## CDS uses downstream in-frame AUG :: downstream AUG is associated with N-terminal localization signal ##RefSeq-Attributes-END## N/A | 22 |
| CD300LF | exonic | 146722 | CMRF35-like molecule 1 precursor | CD300LF is an inhibitory receptor of the Ig superfamily expressed on myeloid cells. It mediates negative regulatory signals by recruiting SHP1 (PTPN6; MIM 176883) or SHIP (INPP5D; MIM 601582) (Sui et al., 2004 [PubMed 15184070]; Alvarez-Errico et al., 2004 [PubMed 15549731]). [supplied by OMIM, March 2008]. Sequence Note: The RefSeq transcript and protein were derived from genomic sequence to make the sequence consistent with the reference genome assembly. The genomic coordinates used for the transcript record were based on alignments. Publication Note: This RefSeq record includes a subset of the publications that are available for this gene. Please see the Gene record to access additional publications. ##Evidence-Data-START## Transcript exon combination :: AF251706.1, AY358845.1 [ECO: 0000332] RNAseq introns :: single sample supports all introns ERS025084 [ECO: 0000348] ##Evidence-Data-END## | 23 |
| CDKN1B | exonic | 1027 | cyclin-dependent kinase inhibitor 1B | This gene encodes a cyclin-dependent kinase inhibitor, which shares a limited similarity with CDK inhibitor CDKN1A/p21. The encoded protein binds to and prevents the activation of cyclin E-CDK2 or cyclin D-CDK4 complexes, and thus controls the cell cycle progression at G1. The degradation of this protein, which is triggered by its CDK dependent phosphorylation and subsequent ubiquitination by SCF complexes, is required for the cellular transition from quiescence to the proliferative state. [provided by RefSeq, July 2008]. Publication Note: This RefSeq record includes a subset of the publications that are available for this gene. Please see the Gene record to access additional publications. ##Evidence-Data-START## Transcript exon combination :: BC001971.1, AY004255.1 [ECO: 0000332] RNAseq introns :: single sample supports all introns ERS025081, ERS025082 [ECO: 0000348] ##Evidence-Data-END## | 24 |
| CENPM | exonic | 79019 | centromere protein M isoform a | The centromere is a specialized chromatin domain, present throughout the cell cycle, that acts as a platform on which the transient assembly of the kinetochore occurs during mitosis. All active centromeres are characterized by the presence of long arrays of nucleosomes in which CENPA (MIM 117139) replaces histone H3 (see MIM 601128). CENPM is an additional factor required for centromere assembly (Foltz et al., 2006 [PubMed 16622419]). [supplied by OMIM, March 2008]. Transcript Variant: This variant (1) represents the longer transcript and encodes the longer isoform (a). Publication Note: This RefSeq record includes a subset of the publications that are available for this gene. Please see the Gene record to access additional publications. ##Evidence-Data-START## Transcript exon combination :: BC000705.2, BC007495.2 [ECO: 0000332] RNAseq introns :: single sample supports all introns ERS025085, ERS025088 [ECO: 0000348] ##Evidence-Data-END## | 25 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| COG4 | exonic | 25839 | conserved oligomeric Golgi complex subunit 4 isoform 1 | The protein encoded by this gene is a component of an oligomeric protein complex involved in the structure and function of the Golgi apparatus. Defects in this gene may be a cause of congenital disorder of glycosylation type IIj. Two transcript variants encoding different isoforms have been found for this gene. [provided by RefSeq, August 2010]. Transcript Variant: This variant (1) represents the longer transcript and encodes the longer isoform (1). ##Evidence-Data-START## Transcript exon combination :: BC072438.1, AK022874.1 [ECO: 0000332] RNAseq introns :: mixed/partial sample support ERS025081, ERS025082 [ECO: 0000350] ##Evidence-Data-END## | 26 |
| COMMD6 | exonic | 170622 | COMM domain-containing protein 6 isoform a | COMMD6 belongs to a family of NF-kappa-B (see RELA; MIM 164014)-inhibiting proteins characterized by the presence of a COMM domain (see COMMD1; MIM 607238) (de Bie et al., 2006 [PubMed 16573520]). [supplied by OMIM, March 2009]. ##Evidence-Data-START## Transcript exon combination :: HY028175.1, DW440523.1 [ECO: 0000332] RNAseq introns :: single sample supports all introns ERS025088 [ECO: 0000348] ##Evidence-Data-END## | 27 |
| CRADD | exonic | 8738 | death domain-containing protein CRADD | The protein encoded by this gene is a death domain (CARD/DD)-containing protein and has been shown to induce cell apoptosis. Through its CARD domain, this protein interacts with, and thus recruits, caspase 2/ICH1 to the cell death signal transduction complex that includes tumor necrosis factor receptor 1 (TNFR1A), RIPK1/RIP kinase, and numbers of other CARD domain-containing proteins. [provided by RefSeq, July 2008]. Publication Note: This RefSeq record includes a subset of the publications that are available for this gene. Please see the Gene record to access additional publications. ##Evidence-Data-START## Transcript exon combination :: BX480215.1, BC017042.1 [ECO: 0000332] RNAseq introns :: single sample supports all introns ERS025081, ERS025083 [ECO: 0000348] ##Evidence-Data-END## | 28 |
| CREBL2 | exonic | 1389 | cAMP-responsive element-binding protein-like 2 | cAMP response element (CRE)-binding protein-like-2 (CREBL2) was identified in a search to find genes in a commonly deleted region on chromosome 12p13 flanked by ETV6 and CDKN1B genes, frequently associated with hematopoietic malignancies, as well as breast, non-small-cell lung and ovarian cancers. CREBL2 shares a 41% identity with CRE-binding protein (CREB) over a 48-base long region which encodes the bZip domain of CREB. The bZip domain consists of about 30 amino acids rich in basic residues involved in DNA binding, followed by a leucine zipper motif involved in protein dimerization. This suggests that CREBL2 encodes a protein with DNA binding capabilities. The occurance of CREBL2 deletion in malignancy suggests that CREBL2 may act as a tumor suppressor gene. [provided by RefSeq, July 2008]. ##Evidence-Data-START## Transcript exon combination :: BC106052.1, AF039081.1 [ECO: 0000332] RNAseq introns :: single sample supports all introns ERS025081, ERS025082 [ECO: 0000348] ##Evidence-Data-END## | 29 |
| DNAI2 | exonic | 64446 | dynein intermediate chain 2, axonemal isoform 1 | The protein encoded by this gene belongs to the dynein intermediate chain family, and is part of the dynein complex of respiratoiy cilia and sperm flagella. Mutations in this gene are associated with primaly ciliaiy dyskinesia type 9. Alternatively spliced transcript variants encoding different isoforms have been noted for this gene. [provided by RefSeq, March 2010]. Transcript Variant: This variant (1) encodes the longer isoform (1). ##Evidence-Data-START## Transcript exon combination :: AF250288.1 [ECO: 0000332] RNAseq introns :: | 30 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| DNER | intronic | 92737 | delta and Notch-like epidermal growth factor-related receptor precursor | single sample supports all introns ERS025085 [ECO: 0000348] ##Evidence-Data-END## ##RefSeq-Attributes-START## NMD candidate :: translation inferred from conservation ##RefSeq-Attributes-END## | 31 |
| DUSP16 | exonic | 80824 | dual specificity protein phosphatase 16 | N/A | 32 |
| | | | | This gene encodes a mitogen-activated protein kinase phosphatase that is a member of the dual specificity protein phosphatase subfamily. These phosphatases inactivate their target kinases by dephosphorylating both the phosphoserine/threonine and phosphotyrosine residues. The encoded protein specifically regulates the c-Jun amino-terminal kinase (JNK) and extracellular signal-regulated kinase (ERK) pathways. [provided by RefSeq, May 2010]. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: AF506796.1, AB052156.1 [ECO: 0000332] RNAseq introns :: single sample supports all introns ERS025084, ERS025088 [ECO: 0000348] ##Evidence-Data-END## | |
| ECRP | exonic | 643332 | N/A | N/A | 33 |
| EDIL3 | intronic | 10085 | EGF-like repeat and discoidin I-like domain-containing protein 3 isoform 1 precursor | The protein encoded by this gene is an integrin ligand. It plays an important role in mediating angiogenesis and may be important in vessel wall remodeling and development. It also influences endothelial cell behavior. [provided by RefSeq, July 2008]. Transcript Variant: This variant (1) encodes the longer isoform (1). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: BC030828.1, U70312.1 [ECO: 0000332] RNAseq introns :: mixed/partial sample support ERS025081, ERS025082 [ECO: 0000350] ##Evidence-Data-END## | 34 |
| EEA1 | exonic | 8411 | early endosome antigen 1 | N/A | 35 |
| EHF | both | 26298 | ETS homologous factor isoform 1 precursor | This gene encodes a protein that belongs to an ETS transcription factor subfamily characterized by epithelial-specific expression (ESEs). The encoded protein acts as a transcriptional repressor and may be involved in epithelial differentiation and carcinogenesis. Three transcript variants encoding different isoforms have been found for this gene. [provided by RefSeq, June 2011]. Transcript Variant: This variant (1) encodes the longest isoform (1). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the | 36 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | publications that are available for this gene. Please see the Gene record to access additional publications. ##Evidence-Data-START## Transcript exon combination :: AK310867.1 [ECO: 0000332] RNAseq introns :: single sample supports all introns ERS025084, ERS025086 [ECO: 0000348] ##Evidence-Data-END## | |
| EMB | exonic | 133418 | embigin precursor | This gene encodes a transmembrane glycoprotein that is a member of the immunoglobulin superfamily. The encoded protein may be involved in cell growth and development by mediating interactions between the cell and extracellular matrix. A pseudogene of this gene is found on chromosome 1. [provided by RefSeq, January 2009]. ##Evidence-Data-START## Transcript exon combination :: BC059398.1, AK300860.1 [ECO: 0000332] RNAseq introns :: mixed/partial sample support ERS025081, ERS025082 [ECO: 0000350] ##Evidence-Data-END## | 37 |
| ETV6 | exonic | 2120 | transcription factor ETV6 | This gene encodes an ETS family transcription factor. The product of this gene contains two functional domains: a N-terminal pointed (PNT) domain that is involved in protein-protein interactions with itself and other proteins, and a C-terminal DNA-binding domain. Gene knockout studies in mice suggest that it is required for hematopoiesis and maintenance of the developing vascular network. This gene is known to be involved in a large number of chromosomal rearrangements associated with leukemia and congenital fibrosarcoma. [provided by RefSeq, September 2008]. Publication Note: This RefSeq record includes a subset of the publications that are available for this gene. Please see the Gene record to access additional publications. ##Evidence-Data-START## Transcript exon combination :: BC043399.1, U11732.1 [ECO: 0000332] RNAseq introns :: single sample supports all introns ERS025081, ERS025082 [ECO: 0000348] ##Evidence-Data-END## | 38 |
| FHL2 | exonic | 2274 | four and a half LIM domains protein 2 | This gene encodes a member of the four-and-a-half-LIM-only protein family. Family members contain two highly conserved, tandemly arranged, zinc finger domains with four highly conserved cysteines binding a zinc atom in each zinc finger. This protein is thought to have a role in the assembly of extracellular membranes. Also, this gene is down-regulated during transformation of normal myoblasts to rhabdomyosarcoma cells and the encoded protein may function as a link between presenilin-2 and an intracellular signaling pathway. Multiple alternatively spliced variants, encoding the same protein, have been identified. [provided by RefSeq, August 2011]. Transcript Variant: This variant (1) differs in the 5' UTR compared to variant 2. Variants 1, 2, 4 and 5 encode the same isoform. Publication Note: This RefSeq record includes a subset of the publications that are available for this gene. Please see the Gene record to access additional publications. ##RefSeq-Attributes-START## CDS uses downstream in-frame AUG :: lack of evidence for use of upstream AUG ##RefSeq-Attributes-END## ##Evidence-Data-START## Transcript exon combination :: BC093049.1, AL523628.3 [ECO: 0000332] RNAseq introns :: single sample supports all introns ERS025084, ERS025088 [ECO: 0000348] ##Evidence-Data-END## | 39 |
| FLJ26850 | intronic | 400710 | N/A | N/A | 40 |
| FPR2 | exonic | 2358 | N-formyl peptide receptor 2 | N/A | 41 |
| FPR3 | exonic | 2359 | N-formyl peptide receptor 3 | N/A | 42 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| FUK | both | 197258 | L-fucose kinase | The protein encoded by this gene belongs to the GHMP (galacto-, homoserine, mevalonate and phosphomevalonate) kinase family and catalyzes the phospholylation of L-fucose to form beta-L-fucose 1-phosphate. This enzyme catalyzes the first step in the utilization of free L-fucose in glycoprotein and glycolipid synthesis. L-fucose may be important in mediating a number of cell-cell interactions such as blood group antigen recognition, inflammation, and metastatis. While several transcript variants may exist for this gene, the full-length nature of only one has been described to date. [provided by RefSeq, July 2008]. ##Evidence-Data-START## Transcript exon combination :: AI441184.1, BC032542.1 [ECO: 0000332] RNAseq introns :: mixed/partial sample support ERS025081, ERS025082 [ECO: 0000350] ##Evidence-Data-END## | 43 |
| GDA | exonic | 9615 | guanine deaminase isoform a | This gene encodes an enzyme responsible for the hydrolytic deamination of guanine. Studies in rat ortholog suggest this gene plays a role in microtubule assembly. Multiple transcript variants encoding different isoforms have been found for this gene. [provided by RefSeq, November 2011]. Transcript Variant: This variant (1) encodes the longest isoform (a). Sequence Note: This RefSeq record was created from transcript and genomic sequence data to make the sequence consistent with the reference genome assembly. The genomic coordinates used for the transcript record were based on transcript alignments. ##Evidence-Data-START## RNAseq introns :: mixed/partial sample support ERS025082, ERS025083 [ECO: 0000350] ##Evidence-Data-END## | 44 |
| GDPD4 | exonic | 220032 | glycerophosphodiester phosphodiesterase domain-containing protein 4 | N/A | 45 |
| GPATCH2 | intronic | 55105 | G patch domain-containing protein 2 | N/A | 46 |
| GPC5 | intronic | 2262 | glypican-5 precursor | Cell surface heparan sulfate proteoglycans are composed of a membrane-associated protein core substituted with a variable number of heparan sulfate chains. Members of the glypican-related integral membrane proteoglycan family (GRIPS) contain a core protein anchored to the cytoplasmic membrane via a glycosyl phosphatidylinositol linkage. These proteins may play a role in the control of cell division and growth regulation. [provided by RefSeq, July 2008]. Publication Note: This RefSeq record includes a subset of the publications that are available for this gene. Please see the Gene record to access additional publications. ##Evidence-Data-START## Transcript exon combination :: BC030584.1, BC039730.1 [ECO: 0000332] RNAseq introns :: mixed/partial sample support ERS025082, ERS025083 [ECO: 0000350] ##Evidence-Data-END## | 47 |
| GPR19 | exonic | 2842 | probable G-protein coupled receptor 19 | N/A | 48 |
| GPR142 | exonic | 350383 | probable G-protein coupled receptor 142 | GPR142 is a member of the rhodopsin family of G protein-coupled receptors (GPRs) (Fredriksson et al., 2003 [PubMed 14623098]). [supplied by OMIM, March 2008]. ##Evidence-Data-START## Transcript exon combination :: AB196530.1, AY288421.1 [ECO: 0000332] ##Evidence-Data-END## | 49 |
| GPRC5C | exonic | 55890 | G-protein coupled receptor family C group 5 member C isoform a | The protein encoded by this gene is a member of the type 3 G protein-coupled receptor family. Members of this superfamily are characterized by a signature 7-transmembrane domain motif. The specific function of this protein is unknown; however, this protein may mediate the cellular effects of retinoic acid on the G | 50 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | protein signal transduction cascade. Two transcript variants encoding different isoforms have been found for this gene. [provided by RefSeq, July 2008]. Transcript Variant: This variant (1) represents the longer transcript and encodes the longer isoform (a). ##Evidence-Data-START## Transcript exon combination :: BC110848.1, AK131210.1 [ECO: 0000332] RNAseq introns :: single sample supports all introns ERS025081, ERS025083 [ECO: 0000348] ##Evidence-Data-END## | |
| GRIA3 | intronic | 2892 | glutamate receptor 3 isoform 1 precursor | Glutamate receptors are the predominant excitatory neurotransmitter receptors in the mammalian brain and are activated in a variety of normal neurophysiologic processes. These receptors are heteromeric protein complexes composed of multiple subunits, arranged to form ligand-gated ion channels. The classification of glutamate receptors is based on their activation by different pharmacologic agonists. The subunit encoded by this gene belongs to a family of AMPA (alpha-amino-3-hydroxy-5-methyl-4-isoxazole propionate)-sensitive glutamate receptors, and is subject to RNA editing (AGA->GGA; R->G). Alternative splicing at this locus results in different isoforms, which may valy in their signal transduction properties. [provided by RefSeq, July 2008]. Transcript Variant: This variant (1) encodes isoform 1 (also known as flip isoform). RNA editing (AGA->GGA) changes Arg775Gly. Publication Note: This RefSeq record includes a subset of the publications that are available for this gene. Please see the Gene record to access additional publications. ##RefSeq-Attributes-START## undergoes RNA editing :: PMID: 10688364, 7992055 ##RefSeq-Attributes-END## ##Evidence-Data-START## Transcript exon combination :: U10301.1 [ECO: 0000332] RNAseq introns :: single sample supports all introns ERS025082, ERS025084 [ECO: 0000348] ##Evidence-Data-END## | 51 |
| GTPBP4 | exonic | 23560 | nucleolar GTP-binding protein 1 | GTP-binding proteins are GTPases and function as molecular switches that can flip between two states: active, when GTP is bound, and inactive, when GDP is bound. 'Active' in this context usually means that the molecule acts as a signal to trigger other events in the cell. When an extracellular ligand binds to a G-protein-linked receptor, the receptor changes its conformation and switches on the trimeric G proteins that associate with it by causing them to eject their GDP and replace it with GTP. The switch is turned off when the G protein hydrolyzes its own bound GTP, converting it back to GDP. But before that occurs, the active protein has an opportunity to diffuse away from the receptor and deliver its message for a prolonged period to its downstream target. [provided by RefSeq, July 2008]. ##Evidence-Data-START## Transcript exon combination :: AK001552.1, AK222861.1 [ECO: 0000332] RNAseq introns :: single sample supports all introns ERS025081, ERS025082 [ECO: 0000348] ##Evidence-Data-END## | 52 |
| HCN1 | exonic | 348980 | potassium/sodium hyperpolarization-activated cyclic nucleotide-gated channel 1 | The membrane protein encoded by this gene is a hyperpolarization-activated cation channel that contributes to the native pacemaker currents in heart and neurons. The encoded protein can homodimerize or heterodimerize with other pore-forming subunits to form a potassium channel. This channel may act as a receptor for sour tastes. [provided by RefSeq, October 2011]. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional | 53 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| HEXA | exonic | 3073 | beta-hexosaminidase subunit alpha preproprotein | publications. ##Evidence-Data-START## Transcript exon combination :: AF488549.1, AF064876.1 [ECO: 0000332] RNAseq introns :: mixed/partial sample support ERS025081, ERS025082 [ECO: 0000350] ##Evidence-Data-END## This gene encodes the alpha subunit of the lysosomal enzyme beta-hexosaminidase that, together with the cofactor GM2 activator protein, catalyzes the degradation of the ganglioside GM2, and other molecules containing terminal N-acetyl hexosamines. Beta-hexosaminidase is composed of two subunits, alpha and beta, which are encoded by separate genes. Both beta-hexosaminidase alpha and beta subunits are members of family 20 of glycosyl hydrolases. Mutations in the alpha or beta subunit genes lead to an accumulation of GM2 ganglioside in neurons and neurodegenerative disorders termed the GM2 gangliosidoses. Alpha subunit gene mutations lead to Tay-Sachs disease (GM2-gangliosidosis type I). [provided by RefSeq, July 2009]. Sequence Note: This RefSeq record was created from transcript and genomic sequence data because no single transcript was available for the full length of the gene. The extent of this transcript is supported by transcript alignments. Publication Note: This RefSeq record includes a subset of the publications that are available for this gene. Please see the Gene record to access additional publications. ##Evidence-Data-START## Transcript exon combination :: M13520.1, CR627386.1 [ECO: 0000332] RNAseq introns :: single sample supports all introns ERS025084, ERS025088 [ECO: 0000348] ##Evidence-Data-END## | 54 |
| HK2 | exonic | 3099 | hexokinase-2 | Hexokinases phosphorylate glucose to produce glucose-6-phosphate, the first step in most glucose metabolism pathways. This gene encodes hexokinase 2, the predominant form found in skeletal muscle. It localizes to the outer membrane of mitochondria. Expression of this gene is insulin-responsive, and studies in rat suggest that it is involved in the increased rate of glycolysis seen in rapidly growing cancer cells. [provided by RefSeq, April 2009]. Publication Note: This RefSeq record includes a subset of the publications that are available for this gene. Please see the Gene record to access additional publications. ##Evidence-Data-START## Transcript exon combination :: BC064369.1, AF148513.1 [ECO: 0000332] RNAseq introns :: single sample supports all introns ERS025083, ERS025084 [ECO: 0000348] ##Evidence-Data-END## | 55 |
| HMGB3 | exonic | 3149 | high mobility group protein B3 | HMGB3 belongs to the high mobility group (HMG) protein superfamily. Like HMG1 (MIM 163905) and HMG2 (MIM 163906), HMGB3 contains DNA-binding HMG box domains and is classified into the HMG box subfamily. Members of the HMG box subfamily are thought to play a fundamental role in DNA replication, nucleosome assembly and transcription (Wilke et al., 1997 [PubMed 9370291]; Nemeth et al., 2006 [PubMed 16945912]). [supplied by OMIM, March 2008]. ##Evidence-Data-START## Transcript exon combination :: Y10043.1, BG176733.1 [ECO: 0000332] RNAseq introns :: single sample supports all introns ERS025081, ERS025082 [ECO: 0000348] ##Evidence-Data-END## | 56 |
| HPR | exonic | 3250 | haptoglobin-related protein precursor | This gene encodes a haptoglobin-related protein that binds hemoglobin as efficiently as haptoglobin. Unlike haptoglobin, plasma concentration of this protein is unaffected in patients with sickle cell anemia and extensive intravascular hemolysis, suggesting a difference in binding between haptoglobin-hemoglobin and haptoglobin-related protein-hemoglobin complexes to CD163, the hemoglobin scavenger receptor. This protein may also be a clinically | 57 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| HTATSF1P2 | exonic | 401233 | N/A | important predictor of recurrence of breast cancer. [provided by RefSeq, October 2011]. Publication Note: This RefSeq record includes a subset of the publications that are available for this gene. Please see the Gene record to access additional publications. ##Evidence-Data-START## Transcript exon combination :: CB147217.1, CB122261.1 [ECO: 0000332] RNAseq introns :: single sample supports all introns ERS025084, ERS025088 [ECO: 0000348] ##Evidence-Data-END## | 58 |
| ID2 | exonic | 91734 | isopentenyl-diphosphate Delta-isomerase 2 | N/A | 59 |
| IDI2-AS1 | exonic | 55853 | N/A | N/A | 60 |
| IDO2 | intronic | 169355 | indoleamine 2,3-dioxygenase 2 | Along with the enzymes encoded by the INDO (MIM 147435) and TDO2 (MIM 191070) genes, the enzyme encoded by the INDOL1 gene metabolizes tryptophan in the kynurenine pathway (Ball et al., 2007 [PubMed 17499941]). [supplied by OMIM, February 2011]. Sequence Note: The RefSeq transcript 3' UTR was derived from genomic sequence to make the sequence consistent with the reference genome assembly. The genomic coordinates used were based on transcript alignments. | 61 |
| IFNLR1 | exonic | 163702 | interferon lambda receptor 1 isoform 1 precursor | The protein encoded by this gene belongs to the class II cytokine receptor family. This protein forms a receptor complex with interleukin 10 receptor, beta (IL10RB). The receptor complex has been shown to interact with three closely related cytokines, including interleukin 28A (IL28A), interleukin 28B (IL28B), and interleukin 29 (IL29). The expression of all three cytokines can be induced by viral infection. The cells overexpressing this protein have been found to have enhanced responses to IL28A and IL29, but decreased response to IL28B. Three alternatively spliced transcript variants encoding distinct isoforms have been reported. [provided by RefSeq, July 2008]. Transcript Variant: This variant (1) represents the longest transcript and it encodes the longest protein (isoform 1). Publication Note: This RefSeq record includes a subset of the publications that are available for this gene. Please see the Gene record to access additional publications. ##Evidence-Data-START## Transcript exon combination :: AF439325.1, AK160364.1 [ECO: 0000332] RNAseq introns :: single sample supports all introns ERS025084 [ECO: 0000348] ##Evidence-Data-END## | 62 |
| IQCB1 | exonic | 9657 | IQ calmodulin-binding motif-containing protein 1 isoform a | This gene encodes a nephrocystin protein that interacts with calmodulin and the retinitis pigmentosa GTPase regulator protein. The encoded protein has a central coiled-coil region and two calmodulin-binding IQ domains. It is localized to the primary cilia of renal epithelial cells and connecting cilia of photoreceptor cells. The protein is thought to play a role in ciliary function. Defects in this gene result in Senior-Loken syndrome type 5. Alternative splicing results in multiple transcript variants. [provided by RefSeq, November 2009]. Transcript Variant: This variant (1) encodes the longer isoform (a). Publication Note: This RefSeq record includes a subset of the publications that are available for this gene. Please see the Gene record to access additional publications. ##Evidence-Data-START## Transcript exon combination :: D25278.1, AY714228.1 [ECO: 0000332] RNAseq introns :: mixed/partial sample support ERS025081, ERS025082 [ECO: 0000350] ##Evidence-Data-END## | 63 |
| JPX | intronic | 554203 | | JPX is a nonprotein-coding RNA transcribed from a gene within the X-inactivation center (XIC; MIM 314670) that appears to participate in X | 64 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| KANK1 | intronic | 23189 | KN motif and ankyrin repeat domain-containing protein 1 isoform a | chromosome inactivation (Tian et al., 2010 [PubMed 21029862]). [supplied by OMIM, February 2011]. ##Evidence-Data-START## Transcript exon combination :: BC071776.1 [ECO: 0000332] RNAseq introns :: mixed/partial sample support ERS025081, ERS025082 [ECO: 0000350] ##Evidence-Data-END## The protein encoded by this gene belongs to the Kank family of proteins, which contain multiple ankyrin repeat domains. This family member functions in cytoskeleton formation by regulating actin polymerization. This gene is a candidate tumor suppressor for renal cell carcinoma. Mutations in this gene cause cerebral palsy spastic quadriplegic type 2, a central nervous system development disorder. A t(5; 9) translocation results in fusion of the platelet-derived growth factor receptor beta gene (PDGFRB) on chromosome 5 with this gene in a myeloproliferative neoplasm featuring severe thrombocythemia. Alternative splicing of this gene results in multiple transcript variants. A related pseuodgene has been identified on chromosome 20. [provided by RefSeq, March 2012]. Transcript Variant: This variant (1) represents the shortest transcript but encodes the longer isoform (a, also known as Kank-L). Variants 1, 3 and 4 all encode isoform a. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: AL833161.1, AK292989.1 [ECO: 0000332] RNAseq introns :: single sample supports all introns ERS025084, ERS025085 [ECO: 0000348] ##Evidence-Data-END## | 65 |
| KAT6B | exonic | 23522 | histone acetyltransferase KAT6B isoform 1 | The protein encoded by this gene is a histone acetyltransferase and component of the MOZ/MORF protein complex. In addition to its acetyltransferase activity, the encoded protein has transcriptional activation activity in its N-terminal end and transcriptional repression activity in its C-terminal end. This protein is necessary for RUNX2-dependent transcriptional activation and could be involved in brain development. Mutations have been found in patients with genitopatellar syndrome. A translocation of this gene and the CREBBP gene results in acute myeloid leukemias. Three transcript variants encoding different isoforms have been found for this gene. [provided by RefSeq, March 2012]. Transcript Variant: This variant (1) represents the longest transcript and encodes the longest isoform (1). Publication Note: This RefSeq record includes a subset of the publications that are available for this gene. Please see the Gene record to access additional publications. ##Evidence-Data-START## Transcript exon combination :: AF217500.1, BC150618.1 [ECO: 0000332] RNAseq introns :: single sample supports all introns ERS025083, ERS025084 [ECO: 0000348] ##Evidence-Data-END## | 66 |
| KCTD7 | exonic | 154881 | BTB/POZ domain-containing protein KCTD7 isoform 1 | This gene encodes a member of the potassium channel tetramerization domain-containing protein family. Family members are identified on a structural basis and contain an amino-terminal domain similar to the T1 domain present in the voltage-gated potassium channel. Mutations in this gene have been associated with progressive myoclonic epilepsy-3. Alternative splicing results in multiple transcript variants. [provided by RefSeq, January 2011]. Transcript Variant: This variant (1) represents the longer transcript and encodes the longer isoform (1). Sequence Note: This RefSeq record was created from transcript and genomic | 67 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | sequence data to make the sequence consistent with the reference genome assembly. The genomic coordinates used for the transcript record were based on transcript alignments. ##Evidence-Data-START## Transcript exon combination :: AK056631.1, BU902852.1 [ECO: 0000332] RNAseq introns :: single sample supports all introns ERS025081, ERS025083 [ECO: 0000348] ##Evidence-Data-END## | |
| KIF19 | exonic | 124602 | kinesin-like protein KIF19 | N/A | 68 |
| LARP4B | exonic | 23185 | la-related protein 4B | This gene encodes a member of an evolutionarily conserved protein family implicated in RNA metabolism and translation. Members of this family are characterized by the presence of an La motif, which is often located adjacent to one or more RNA recognition motifs (RRM). Together, the two motifs constitute the functional region of the protein and enable its interaction with the RNA substrate. This protein family is divided into five sub-families: the genuine La proteins and four La-related protein (LARP) sub-families. The protein encoded by this gene belongs to LARP sub-family 4. It is a cytoplasmic protein that may play a stimulatory role in translation. [provided by RefSeq, October 2012]. Sequence Note: This RefSeq record was created from transcript and genomic sequence data to make the sequence consistent with the reference genome assembly. The genomic coordinates used for the transcript record were based on transcript alignments. ##Evidence-Data-START## CDS exon combination :: BC152443.1, D86971.2 [ECO: 0000331] RNAseq introns :: mixed/partial sample support ERS025088 [ECO: 0000350] ##Evidence-Data-END## | 69 |
| LOC643339 | exonic | 643339 | N/A | N/A | 70 |
| LOH12CR1 | exonic | 118426 | loss of heterozygosity 12 chromosomal region 1 protein | N/A | 71 |
| MALL | exonic | 7851 | MAL-like protein | This gene encodes an element of the machinery for raft-mediated trafficking in endothelial cells. The encoded protein, a member of the MAL proteolipid family, predominantly localizes in glycolipid- and cholesterol-enriched membrane (GEM) rafts. It interacts with caveolin-1. [provided by RefSeq, July 2008]. ##Evidence-Data-START## Transcript exon combination :: AK125647.1, AK056616.1 [ECO: 0000332] RNAseq introns :: single sample supports all introns ERS025084, ERS025088 [ECO: 0000348] ##Evidence-Data-END## | 72 |
| MAPK9 | exonic | 5601 | mitogen-activated protein kinase 9 isoform alpha1 | The protein encoded by this gene is a member of the MAP kinase family. MAP kinases act as an integration point for multiple biochemical signals, and are involved in a wide variety of cellular processes such as proliferation, differentiation, transcription regulation and development. This kinase targets specific transcription factors, and thus mediates immediate-early gene expression in response to various cell stimuli. It is most closely related to MAPK8, both of which are involved in UV radiation induced apoptosis, thought to be related to the cytochrome c-mediated cell death pathway. This gene and MAPK8 are also known as c-Jun N-terminal kinases. This kinase blocks the ubiquitination of tumor suppressor p53, and thus it increases the stability of p53 in nonstressed cells. Studies of this gene's mouse counterpart suggest a key role in T-cell differentiation. Several alternatively spliced transcript variants encoding distinct isoforms have been reported. [provided by RefSeq, September 2008]. Transcript Variant: This variant (JNK2-a1) uses a different acceptor splice site in the last | 73 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | coding exon compared to transcript variant JNK2-a2, resulting in a frameshift and a shorter isoform (JNK2 alpha1) with a different C-terminus, compared to isoform JNK2 alpha2. The JNK2-a1 variant differs from the JNK2-b1 variant in the use of an alternate internal coding exon of the same length. Thus, JNK2 alpha1 isoform is the same length as JNK2 beta1 isoform, with a few aa differences in an internal protein segment. Sequence Note: This RefSeq record was created from transcript and genomic sequence data because no single transcript was available for the full length of the gene. The extent of this transcript is supported by transcript alignments. Publication Note: This RefSeq record includes a subset of the publications that are available for this gene. Please see the Gene record to access additional publications. ##Evidence-Data-START## CDS exon combination :: U34821.1 [ECO: 0000331] RNAseq introns :: mixed/partial sample support ERS025081, ERS025082 [ECO: 0000350] ##Evidence-Data-END## | |
| MCEE | both | 84693 | methylmalonyl-CoA epimerase, mitochondrial precursor | The product of this gene catalyzes the interconversion of D- and L-methylmalonyl-CoA during the degradation of branched chain amino acids. odd chain-length fatty acids, and other metabolites. Mutations in this gene result in methylmalonyl-CoA epimerase deficiency, which is presented as mild to moderate methylmalonic aciduria. [provided by RefSeq, July 2008]. ##Evidence-Data-START## Transcript exon combination :: BC020825.1, BG567074.1 [ECO: 0000332] RNAseq introns :: single sample supports all introns ERS025081, ERS025082 [ECO: 0000348] ##Evidence-Data-END## | 74 |
| MGAT5 | intronic | 4249 | alpha-1,6-mannosylglycoprotein 6-beta-N-acetylglucosaminyl transferase A | The protein encoded by this gene belongs to the glycosyltransferase family. It catalyzes the addition of beta-1,6-N-acetylglucosamine to the alpha-linked mannose of biantennary N-linked oligosaccharides present on the newly synthesized glycoproteins. It is one of the most important enzymes involved in the regulation of the biosynthesis of glycoprotein oligosaccharides. Alterations of the oligosaccharides on cell surface glycoproteins cause significant changes in the adhesive or migratory behavior of a cell. Increase in the activity of this enzyme has been correlated with the progression of invasive malignancies. [provided by RefSeq, October 2011]. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ##Evidence-Data-START## Transcript exon combination :: D17716.1, AF113921.1 [ECO: 0000332] RNAseq introns :: single sample supports all introns ERS025081, ERS025082 [ECO: 0000348] ##Evidence-Data-END## | 75 |
| MGC16275 | exonic | 85001 | N/A | N/A | 76 |
| MGME1 | exonic | 92667 | mitochondrial genome maintenance exonuclease 1 | N/A | 77 |
| MIR200A | exonic | 406983 | | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The | 78 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| MIR200B | exonic | 406984 | | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. Publication Note: This RefSeq record includes a subset of the publications that are available for this gene. Please see the Gene record to access additional publications. | 79 |
| MIR429 | exonic | 554210 | | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by | 80 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| MIR595 | exonic | 693180 | | Drosha cleavage. Publication Note: This RefSeq record includes a subset of the publications that are available for this gene. Please see the Gene record to access additional publications.<br>microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. | 81 |
| MIR651 | exonic | 723779 | | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. | 82 |
| MIR3163 | exonic | 100423029 | | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target | 83 |

TABLE 3-continued

A non-redundant list of genes listed in Table 2

| RefSeq Gene Symbol | Exon overlap | NCBI Gene ID | Gene Description RefSeq_Summary | Gene # (GN) |
|---|---|---|---|---|
| | | | mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. | |
| MIR3910-1 | exonic | 100500821 | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. | 84 |
| MIR3910-2 | exonic | 100500902 | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. | 85 |
| MIR4267 | exonic | 100422994 | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes | 86 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. | |
| MIR4436B1 | exonic | 100616123 | | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. | 87 |
| MIR4436B2 | exonic | 100847033 | | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. | 88 |
| MKL1 | intronic | 57591 | MKL/myocardin-like protein 1 | The protein encoded by this gene interacts with the transcription factor myocardin, a key regulator of smooth muscle cell differentiation. The encoded protein is predominantly nuclear and may help transduce signals from the cytoskeleton to the nucleus. This gene is involved in a specific translocation event that creates a fusion of this gene and the RNA-binding motif protein-15 gene. This translocation has been associated with acute megakaryocytic leukemia. [provided by RefSeq, July 2008]. Publication Note: This RefSeq record includes a subset of the publications that are available for this gene. Please see | 89 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | the Gene record to access additional publications. ##Evidence-Data-START## Transcript exon combination :: AB037859.2, AJ297258.1 [ECO: 0000332] RNAseq introns :: mixed/partial sample support ERS025081, ERS025082 [ECO: 0000350] ##Evidence-Data-END## | |
| MRPL42 | exonic | 28977 | 39S ribosomal protein L42, mitochondrial precursor | Mammalian mitochondrial ribosomal proteins are encoded by nuclear genes and help in protein synthesis within the mitochondrion. Mitochondrial ribosomes (mitoribosomes) consist of a small 28S subunit and a large 39S subunit. They have an estimated 75% protein to rRNA composition compared to prokaryotic ribosomes, where this ratio is reversed. Another difference between mammalian mitoribosomes and prokaryotic ribosomes is that the latter contain a 5S rRNA. Among different species, the proteins comprising the mitoribosome differ greatly in sequence, and sometimes in biochemical properties, which prevents easy recognition by sequence homology. This gene encodes a protein identified as belonging to both the 28S and the 39S subunits. Alternative splicing results in multiple transcript variants. Pseudogenes corresponding to this gene are found on chromosomes 4q, 6p, 6q, 7p, and 15q. [provided by RefSeq, May 2011]. Transcript Variant: This variant (1) encodes the supported protein. Both variants 1 and 2 encode the same protein. Sequence Note: This RefSeq record was created from transcript and genomic sequence data to make the sequence consistent with the reference genome assembly. The genomic coordinates used for the transcript record were based on transcript alignments. ##RefSeq-Attributes-START## gene product(s) localized to mito. :: reported by MitoCarta ##RefSeq-Attributes-END## ##Evidence-Data-START## Transcript exon combination :: AK000285.1, AF151038.1 [ECO: 0000332] RNAseq introns :: single sample supports all introns ERS025081, ERS025082 [ECO: 0000348] ##Evidence-Data-END## | 90 |
| MTHFD1 | exonic | 4522 | C-1-tetrahydrofolate synthase, cytoplasmic | This gene encodes a protein that possesses three distinct enzymatic activities, 5,10-methylenetetrahydrofolate dehydrogenase, 5,10-methenyltetrahydrofolate cyclohydrolase and 10-formyltetrahydrofolate synthetase. Each of these activities catalyzes one of three sequential reactions in the interconversion of 1-carbon derivatives of tetrahydrofolate, which are substrates for methionine, thymidylate, and de novo purine syntheses. The trifunctional enzymatic activities are conferred by two major domains, an aminoterminal portion containing the dehydrogenase and cyclohydrolase activities and a larger synthetase domain. [provided by RefSeq, July 2008]. Publication Note: This RefSeq record includes a subset of the publications that are available for this gene. Please see the Gene record to access additional publications. ##RefSeq-Attributes-START## CDS uses downstream in-frame AUG :: experimental evidence (PMID: 3053686) ##RefSeq-Attributes-END## ##Evidence-Data-START## Transcript exon combination :: BC054420.1, J04031.1 [ECO: 0000332] RNAseq introns :: single sample supports all introns ERS025081, ERS025082 [ECO: 0000348] ##Evidence-Data-END## | 91 |
| NFIL3 | exonic | 4783 | nuclear factor interleukin-3-regulated protein | Expression of interleukin-3 (IL3; MIM 147740) is restricted to activated T cells, natural killer (NK) cells, and mast cell lines. Transcription initiation depends on the activating capacity of specific protein factors, such as NFIL3, that bind to regulatory regions of the gene, usually upstream of the transcription start site (Zhang et al., 1995 [PubMed 7565758]). [supplied by OMIM, February 2009]. Publication Note: This RefSeq record includes a subset of the publications that are available for this gene. Please see the Gene record to access additional | 92 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| NLRP12 | exonic | 91662 | NACHT, LRR and PYD domains-containing protein 12 isoform 2 | publications. ##Evidence-Data-START## Transcript exon combination :: S79880.1, U26173.1 [ECO: 0000332] RNAseq introns :: single sample supports all introns ERS025081, ERS025082 [ECO: 0000348] ##Evidence-Data-END## This gene encodes a member of the CATERPILLER family of cytoplasmic proteins. The encoded protein, which contains an N-terminal pyrin domain, a NACHT domain, a NACHT-associated domain, and a C-terminus leucine-rich repeat region, functions as an attenuating factor of inflammation by suppressing inflammatory responses in activated monocytes. Mutations in this gene cause familial cold autoinflammatory syndrome type 2. Alternative splicing results in multiple transcript variants. [provided by RefSeq, March 2013]. Transcript Variant: This variant (2) uses an alternate splice site in the central coding region, compared to variant 3, resulting in an isoform (2) that is 1 aa shorter than isoform 3. Publication Note: This RefSeq record includes a subset of the publications that are available for this gene. Please see the Gene record to access additional publications. ##Evidence-Data-START## Transcript exon combination :: AY095146.1, BC028069.1 [ECO: 0000332] RNAseq introns :: single sample supports all introns ERS025089 [ECO: 0000348] ##Evidence-Data-END## | 93 |
| NQO2 | exonic | 4835 | ribosyldihydronicotinamide dehydrogenase [quinone] | NQO2 (EC 1.10.99.2) is a flavoprotein that catalyzes the 2-electron reduction of various quinones, redox dyes, and the vitamin K menadione. NQO2 predominantly uses dihydronicotinamide riboside (NRH) as the electron donor (summary by Wu et al., 1997 [PubMed 9367528]). [supplied by OMIM, July 2010]. Publication Note: This RefSeq record includes a subset of the publications that are available for this gene. Please see the Gene record to access additional publications. ##Evidence-Data-START## Transcript exon combination :: J02888.1, AK311746.1 [ECO: 0000332] RNAseq introns :: single sample supports all introns ERS025081, ERS025082 [ECO: 0000348] ##Evidence-Data-END## | 94 |
| NRIP1 | exonic | 8204 | nuclear receptor-interacting protein 1 | Nuclear receptor interacting protein 1 (NRIP1) is a nuclear protein that specifically interacts with the hormone-dependent activation domain AF2 of nuclear receptors. Also known as RIP140, this protein modulates transcriptional activity of the estrogen receptor. [provided by RefSeq, July 2008]. Sequence Note: The RefSeq transcript and protein were derived from transcript and genomic sequence to make the sequence consistent with the reference genome assembly. The extent of this RefSeq transcript is supported by transcript alignments. Publication Note: This RefSeq record includes a subset of the publications that are available for this gene. Please see the Gene record to access additional publications. ##Evidence-Data-START## Transcript exon combination :: AK289786.1, DA230125.1 [ECO: 0000332] RNAseq introns :: single sample supports all introns ERS025098 [ECO: 0000348] ##Evidence-Data-END## | 95 |
| NUDT4 | exonic | 11163 | diphosphoinositol polyphosphate phosphohydrolase 2 isoform alpha | The protein encoded by this gene regulates the turnover of diphosphoinositol polyphosphates. The turnover of these high-energy diphosphoinositol polyphosphates represents a molecular switching activity with important regulatory consequences. Molecular switching by diphosphoinositol polyphosphates may contribute to regulating intracellular trafficking. Several alternatively spliced transcript variants have been described, but the full-length nature of some variants has not been determined. Isoforms DIPP2alpha and DIPP2beta are distinguishable from each other solely by DIPP2beta possessing one additional amino acid due to intron boundary skidding in alternate splicing. [provided by RefSeq, July 2008]. Transcript Variant: This variant (1) encodes the | 96 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| NUDT4P1 | exonic | 440672 | N/A | predominant isoform (alpha). ##Evidence-Data-START## Transcript exon combination :: AF191651.1, AF191650.1 [ECO: 0000332] RNAseq introns :: single sample supports all introns ERS025081, ERS025082 [ECO: 0000348] ##Evidence-Data-END## | 97 |
| OVOL2 | exonic | 58495 | transcription factor Ovo-like 2 | N/A | 98 |
| PDE3B | intronic | 5140 | cGMP-inhibited 3′,5′-cyclic phosphodiesterase B | N/A | 99 |
| PDGFRA | exonic | 5156 | platelet-derived growth factor receptor alpha precursor | This gene encodes a cell surface tyrosine kinase receptor for members of the platelet-derived growth factor family. These growth factors are mitogens for cells of mesenchymal origin. The identity of the growth factor bound to a receptor monomer determines whether the functional receptor is a homodimer or a heterodimer, composed of both platelet-derived growth factor receptor alpha and beta polypeptides. Studies suggest that this gene plays a role in organ development, wound healing, and tumor progression. Mutations in this gene have been associated with idiopathic hypereosinophilic syndrome, somatic and familial gastrointestinal stromal tumors, and a variety of other cancers. [provided by RefSeq, March 2012]. Sequence Note: This RefSeq record was created from transcript and genomic sequence data because no single transcript was available for the full length of the gene. The extent of this transcript is supported by transcript alignments and orthologous data. Publication Note: This RefSeq record includes a subset of the publications that are available for this gene. Please see the Gene record to access additional publications. ##Evidence-Data-START## Transcript exon combination :: M21574.1, M22734.1 [ECO: 0000332] RNAseq introns :: single sample supports all introns ERS025081, ERS025084 [ECO: 0000348] ##Evidence-Data-END## | 100 |
| PDSS2 | exonic | 57107 | decaprenyl-diphosphate synthase subunit 2 | The protein encoded by this gene is an enzyme that synthesizes the prenyl side-chain of coenzyme Q, or ubiquinone, one of the key elements in the respiratory chain. The gene product catalyzes the formation of all trans-polyprenyl pyrophosphates from isopentyl diphosphate in the assembly of polyisoprenoid side chains, the first step in coenzyme Q biosynthesis. Defects in this gene are a cause of coenzyme Q10 deficiency. [provided by RefSeq, October 2009]. Publication Note: This RefSeq record includes a subset of the publications that are available for this gene. Please see the Gene record to access additional publications. ##Evidence-Data-START## Transcript exon combination :: BC039906.1, AF254956.1 [ECO: 0000332] RNAseq introns :: single sample supports all introns ERS025084, ERS025088 [ECO: 0000348] ##Evidence-Data-END## | 101 |
| PHACTR4 | exonic | 65979 | phosphatase and actin regulator 4 isoform 1 | This gene encodes a member of the phosphatase and actin regulator (PHACTR) family. Other PHACTR family members have been shown to inhibit protein phosphatase 1 (PP1) activity, and the homolog of this gene in the mouse has been shown to interact with actin and PP1. Multiple transcript variants encoding different isoforms have been found for this gene. [provided by RefSeq, July 2008]. Transcript Variant: This variant (1) represents the longer transcript but encodes the shorter isoform (1). Sequence Note: This RefSeq record was created from transcript and genomic sequence data to make the sequence consistent with the reference genome assembly. The genomic coordinates used for the transcript record were based on transcript alignments. ##Evidence-Data-START## | 102 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| PIAS2 | exonic | 9063 | E3 SUMO-protein ligase PIAS2 isoform alpha | Transcript exon combination :: CR749449.1, BC029266.1 [ECO: 0000332] RNAseq introns :: single sample supports all introns ERS025084, ERS025087 [ECO: 0000348] ###Evidence-Data-END### This gene encodes a member of the protein inhibitor of activated STAT (PIAS) family. PIAS proteins function as SUMO E3 ligases and play important roles in many cellular processes by mediating the sumoylation of target proteins. Alternatively spliced transcript variants encoding multiple isoforms have been observed for this gene. Isoforms of the encoded protein enhance the sumoylation of specific target proteins including the p53 tumor suppressor protein, c-Jun, and the androgen receptor. A pseudogene of this gene is located on the short arm of chromosome 4. The symbol MIZ1 has also been associated with ZBTB17 which is a different gene located on chromosome 1. [provided by RefSeq, August 2011]. Transcript Variant: This variant (alpha) utilizes an alternate 3' coding exon, compared to variant beta, resulting in a shorter isoform (alpha) that has a unique C-terminus compared to isoform beta. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. ###Evidence-Data-START## Transcript exon combination :: BC015190.1 ###Evidence-Data-START## Transcript exon combination :: BC015190.1 ###Evidence-Data-START## RNAseq introns :: single sample supports all introns ERS025088 [ECO: 0000348] ###Evidence-Data-END### | 103 |
| PIK3CD | exonic | 5293 | phosphatidylinositol 4,5-bisphosphate 3-kinase catalytic subunit delta isoform | Phosphoinositide 3-kinases (PI3Ks) phosphorylate inositol lipids and are involved in the immune response. The protein encoded by this gene is a class I PI3K found primarily in leukocytes. Like other class I PI3Ks (p110-alpha p110-beta, and p110-gamma), the encoded protein binds p85 adapter proteins and GTP-bound RAS. However, unlike the other class I PI3Ks, this protein phosphorylates itself, not p85 protein. [provided by RefSeq, July 2010]. Publication Note: This RefSeq record includes a subset of the publications that are available for this gene. Please see the Gene record to access additional publications. ###Evidence-Data-START## Transcript exon combination :: U86453.1, Y10055.2 [ECO: 0000332] RNAseq introns :: single sample supports all introns ERS025089 [ECO: 0000348] ###Evidence-Data-END### | 104 |
| PKHD1 | intronic | 5314 | fibrocystin isoform 1 precursor | The protein encoded by this gene is predicted to have a single transmembrane (TM)-spanning domain and multiple copies of an immunoglobulin-like plexin-transcription-factor domain. Alternative splicing results in two transcript variants encoding different isoforms. Other alternatively spliced transcripts have been described, but the full length sequences have not been determined. Several of these transcripts are predicted to encode truncated products which lack the TM and may be secreted. Mutations in this gene cause autosomal recessive polycystic kidney disease, also known as polycystic kidney and hepatic disease-1. [provided by RefSeq, July 2008]. Transcript Variant: This variant (1) encodes the longer isoform of this protein. Publication Note: This RefSeq record includes a subset of the publications that are available for this gene. Please see the Gene record to access additional publications. ###Evidence-Data-START## Transcript exon combination :: AY074797.1, AF480064.1 [ECO: 0000332] RNAseq introns :: mixed/partial sample support ERS025084, ERS025085 [ECO: 0000350] ###Evidence-Data-END### | 105 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| PLXNC1 | exonic | 10154 | Plexin C1 | This gene encodes a member of the plexin family. Plexins are transmembrane receptors for semaphorins, a large family of proteins that regulate axon guidance, cell motility and migration, and the immune response. The encoded protein and its ligand regulate melanocyte adhesion, and viral semaphorins may modulate the immune response by binding to this receptor. The encoded protein may be a tumor suppressor protein for melanoma. Alternatively spliced transcript variants have been observed for this gene. [provided by RefSeq, January 2011]. Transcript Variant: This variant (2) lacks multiple 5' exons but contains an alternate 5' exon, compared to variant 1. This variant is represented as non-coding due to the presence of an upstream ORF that is predicted to interfere with translation of the longest in-frame ORF. Translation of the upstream ORF renders the transcript a candidate for nonsense-mediated mRNA decay (NMD). Publication Note: This RefSeq record includes a subset of the publications that are available for this gene. Please see the Gene record to access additional publications. ##Evidence-Data-START## RNAseq introns :: single sample supports all introns ERS025084, ERS025088 [ECO: 0000348] ##Evidence-Data-END## | 106 |
| PNPLA4 | exonic | 8228 | patatin-like phospholipase domain-containing protein 4 isoform 1 precursor | This gene encodes a member of the patatin-like family of phospholipases. The encoded enzyme has both triacylglycerol lipase and transacylase activities and may be involved in adipocyte triglyceride homeostasis. Alternate splicing results in multiple transcript variants. A pseudogene of this gene is found on chromosome Y. [provided by RefSeq, February 2010]. Transcript Variant: This variant (1) represents the longest transcript and encodes the longer isoform (1). Variants 1 and 2 encode the same isoform (1). Sequence Note: The RefSeq transcript and protein were derived from transcript and genomic sequence to make the sequence consistent with the reference genome assembly. The extent of this transcript is supported by transcript alignments. ##Evidence-Data-START## Transcript exon combination :: U03886.1, AK289888.1 [ECO: 0000332] RNAseq introns :: single sample supports all introns ERS025091, ERS025098 [ECO: 0000348] ##Evidence-Data-END## | 107 |
| PNPT1 | both | 87178 | polyribonucleotide nucleotidyltransferase 1, mitochondrial precursor | The protein encoded by this gene belongs to the evolutionarily conserved polynucleotide phosphorylase family comprised of phosphate dependent 3'-to-5' exoribonucleases implicated in RNA processing and degradation. This enzyme is predominantly localized in the mitochondrial intermembrane space and is involved in import of RNA to mitochondria. Mutations in this gene have been associated with combined oxidative phosphorylation deficiency-13 and autosomal recessive nonsyndromic deafness-70. Related pseudogenes are found on chromosomes 3 and 7. [provided by RefSeq, December 2012]. Publication Note: This RefSeq record includes a subset of the publications that are available for this gene. Please see the Gene record to access additional publications. ##Evidence-Data-START## Transcript exon combination :: BC053660.1, AJ458465.1 [ECO: 0000332] RNAseq introns :: mixed/partial sample support ERS025081, ERS025082 [ECO: 0000350] ##Evidence-Data-END## ##RefSeq-Attributes-START## gene product(s) localized to mito. :: PMID: 12798676; reported by MitoCarta ##RefSeq-Attributes-END## | 108 |
| PPP2R3B | intronic | 28227 | serine/threonine-protein phosphatase 2A regulatory subunit B″ subunit beta | Protein phosphatase 2 (formerly named type 2A) is one of the four major Ser/Thr phosphatases and is implicated in the negative control of cell growth and division. Protein phosphatase 2 holoenzymes are heterotrimeric proteins composed of a structural subunit A, a catalytic subunit C, and a regulatory subunit B. The regulatory subunit is encoded by a diverse set of genes that have | 109 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | been grouped into the B/PR55, B'/PR61, and B"/PR72 families. These different regulatory subunits confer distinct enzymatic specificities and intracellular localizations to the holoenzyme. The product of this gene belongs to the B" family. The B" family has been further divided into subfamilies. The product of this gene belongs to the beta subfamily of regulatoly subunit B". [provided by RefSeq, April 2010]. Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: BK000521.1, BC063429.1 [ECO: 0000332] RNAseq introns :: single sample supports all introns ERS025084 [ECO: 0000348] ##Evidence-Data-END## | |
| PRKCB | both | 5579 | protein kinase C beta type isoform 1 | Protein kinase C (PKC) is a family of serine- and threonine-specific protein kinases that can be activated by calcium and second messenger diacylglycerol. PKC family members phosphorylate a wide variety of protein targets and are known to be involved in diverse cellular signaling pathways. PKC family members also serve as major receptors for phorbol esters, a class of tumor promoters. Each member of the PKC family has a specific expression profile and is believed to play a distinct role in cells. The protein encoded by this gene is one of the PKC family members. This protein kinase has been reported to be involved in many different cellular functions, such as B cell activation, apoptosis induction, endothelial cell proliferation, and intestinal sugar absorption. Studies in mice also suggest that this kinase may also regulate neuronal functions and correlate fear-induced conflict behavior after stress. Alternatively spliced transcript variants encoding distinct isoforms have been reported. [provided by RefSeq, July 2008]. Transcript Variant: This variant (1) uses an alternate splice junction at the 5' end of the last exon compared to variant 2. The resulting isoform (1) has a distinct and shorter C-terminus compared to isoform 2. Sequence Note: This RefSeq record was created from transcript and genomic sequence data because no single transcript was available for the full length of the gene. The extent of this transcript is supported by transcript alignments. Publication Note: This RefSeq record includes a subset of the publications that are available for this gene. Please see the Gene record to access additional publications. ##Evidence-Data-START## Transcript exon combination :: X06318.1 [ECO: 0000332] RNAseq introns :: single sample supports all introns ERS025082, ERS025084 [ECO: 0000348] ##Evidence-Data-END## | 110 |
| PRKCH | intronic | 5583 | protein kinase C eta type | Protein kinase C (PKC) is a family of serine- and threonine-specific protein kinases that can be activated by calcium and the second messenger diacylglycerol. PKC family members phosphorylate a wide variety of protein targets and are known to be involved in diverse cellular signaling pathways. PKC family members also serve as major receptors for phorbol esters, a class of tumor promoters. Each member of the PKC family has a specific expression profile and is believed to play a distinct role in cells. The protein encoded by this gene is one of the PKC family members. It is a calcium-independent and phospholipids-dependent protein kinase. It is predominantly expressed in epithelial tissues and has been shown to reside specifically in the cell nucleus. This protein kinase can regulate keratinocyte differentiation by activating the MAP kinase MAPK13 (p38delta)-activated protein kinase cascade that targets CCAAT/enhancer-binding protein alpha (CEBPA). It is also found to mediate the transcription | 111 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| PSTPIP1 | exonic | 9051 | proline-serine-threonine phosphatase-interacting protein 1 | activation of the transglutaminase 1 (TGM1) gene. [provided by RefSeq, July 2008]. Publication Note: This RefSeq record includes a subset of the publications that are available for this gene. Please see the Gene record to access additional publications. ##Evidence-Data-START## Transcript exon combination :: BC037268.1, AK290183.1 [ECO: 0000332] RNAseq introns :: single sample supports all introns ERS025081, ERS025083 [ECO: 0000348] ##Evidence-Data-END##
The protein encoded by this gene binds to the cytoplasmic tail of CD2, an effector of T cell activation and adhesion, negatively affecting CD2-triggered T cell activation. The encoded protein appears to be a scaffold protein and a regulator of the actin cytoskeleton. It has also been shown to bind ABL1, PTPN18, WAS, CD2AP, and PTPN12. Mutations in this gene are a cause of PAPA syndrome. [provided by RefSeq, July 2008]. Publication Note: This RefSeq record includes a subset of the publications that are available for this gene. Please see the Gene record to access additional publications. ##Evidence-Data-START## Transcript exon combination :: BC008602.1, U94778.1 [ECO: 0000332] RNAseq introns :: single sample supports all introns ERS025084, ERS025088 [ECO: 0000348] ##Evidence-Data-END## | 112 |
| PTPN2 | exonic | 5771 | tyrosine-protein phosphatase non-receptor type 2 isoform 1 | The protein encoded by this gene is a member of the protein tyrosine phosphatase (PTP) family. Members of the PTP family share a highly conserved catalytic motif, which is essential for the catalytic activity. PTPs are known to be signaling molecules that regulate a variety of cellular processes including cell growth, differentiation, mitotic cycle, and oncogenic transformation. Epidermal growth factor receptor and the adaptor protein Shc were reported to be substrates of this PTP, which suggested the roles in growth factor mediated cell signaling. Multiple alternatively spliced transcript variants encoding different isoforms have been found. Two highly related but distinctly processed pseudogenes that localize to chromosomes 1 and 13, respectively, have been reported. [provided by RefSeq, May 2011]. Transcript Variant: This variant (1) encodes the longest isoform (1). Publication Note: This RefSeq record includes a subset of the publications that are available for this gene. Please see the Gene record to access additional publications. ##Evidence-Data-START## Transcript exon combination :: M25393.1, AK292570.1 [ECO: 0000332] RNAseq introns :: mixed/partial sample support ERS025081, ERS025082 [ECO: 0000350] ##Evidence-Data-END## | 113 |
| PTPRN2 | intronic | 5799 | receptor-type tyrosine-protein phosphatase N2 isoform 1 precursor | The protein encoded by this gene is a member of the protein tyrosine phosphatase (PTP) family. PTPs are known to be signaling molecules that regulate a variety of cellular processes including cell growth, differentiation, mitotic cycle, and oncogenic transformation. This PTP possesses an extracellular region, a single transmembrane region, and a single intracellular catalytic domain, and thus represents a receptor-type PTP. The catalytic domain of this PTP is most closely related to PTPRN/IA-2beta. This PTP and PTPRN are both found to be major autoantigens associated with insulin-dependent diabetes mellitus. Three alternatively spliced transcript variants of this gene, which encode distinct proteins, have been reported. [provided by RefSeq, July 2008]. Transcript Variant: This variant (1) encodes the longest isoform (1). Publication Note: This RefSeq record includes a subset of the publications that are available for this gene. Please see the Gene record to access additional publications. ##Evidence-Data-START## Transcript exon combination :: U66702.1, | 114 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| RAB37 | exonic | 326624 | ras-related protein Rab-37 isoform 2 | AF007555.1 [ECO: 0000332] RNAseq introns :: mixed/partial sample support ERS025081, ERS025082 [ECO: 0000350] ##Evidence-Data-END## Rab proteins are low molecular mass GTPases that are critical regulators of vesicle trafficking. For additional background information on Rab proteins, see MIM 179508. [supplied by OMIM, April 2006]. Transcript Variant: This variant (2) represents use of an alternate promoter, 5' UTR, and alternate start codon, and includes an alternate coding exon, compared to variant 3. The resulting isoform (2) has a distinct and longer N-terminus, compared to isoform 3. ##Evidence-Data-START## Transcript exon combination :: AK098068.1, BX332255.2 [ECO: 0000332] RNAseq introns :: single sample supports all introns ERS025084, ERS025088 [ECO: 0000348] ##Evidence-Data-END## | 115 |
| RBFOX1 | intronic | 54715 | RNA binding protein fox-1 homolog 1 isoform 1 | The Fox-1 family of RNA-binding proteins is evolutionarily conserved, and regulates tissue-specific alternative splicing in metazoa. Fox-1 recognizes a (U)GCAUG stretch in regulated exons or in flanking introns. The protein binds to the C-terminus of ataxin-2 and may contribute to the restricted pathology of spinocerebellar ataxia type 2 (SCA2). Ataxin-2 is the product of the SCA2 gene which causes familial neurodegenerative diseases. Fox-1 and ataxin-2 are both localized in the trans-Golgi network. Several alternatively spliced transcript variants encoding different isoforms have been found for this gene. [provided by RefSeq, November 2011]. Transcript Variant: This variant (1), also known as gamma, encodes the longest isoform (1). Sequence Note: This RefSeq record was created from transcript and genomic sequence data because no single transcript was available for the full length of the gene. The extent of this transcript is supported by transcript alignments. Publication Note: This RefSeq record includes a subset of the publications that are available for this gene. Please see the Gene record to access additional publications. ##Evidence-Data-START## Transcript exon combination :: AF229057.1 [ECO: 0000332] RNAseq introns :: single sample supports all introns ERS025083, ERS025099 [ECO: 0000348] ##Evidence-Data-END## | 116 |
| RCC1 | exonic | 1104 | N/A | N/A | 117 |
| RGCC | exonic | 28984 | regulator of cell cycle RGCC | This gene is thought to regulate cell cycle progression. It is induced by p53 in response to DNA damage, or by sublytic levels of complement system proteins that result in activation of the cell cycle. The encoded protein localizes to the cytoplasm during interphase and to centrosomes during mitosis. The protein forms a complex with polo-like kinase 1. The protein also translocates to the nucleus in response to treatment with complement system proteins, and can associate with and increase the kinase activity of cell division cycle 2 protein. In different assays and cell types, overexpression of this protein has been shown to activate or suppress cell cycle progression. [provided by RefSeq, July 2008]. Publication Note: This RefSeq record includes a subset of the publications that are available for this gene. Please see the Gene record to access additional publications. ##Evidence-Data-START## Transcript exon combination :: BC066334.1, BG037019.1 [ECO: 0000332] RNAseq introns :: single sample supports all introns ERS025081, ERS025092 [ECO: 0000348] ##Evidence-Data-END## | 118 |
| RHOQ | intronic | 23433 | rho-related GTP-binding protein RhoQ precursor | This gene encodes a member of the Rho family of small GTPases, which cycle between inactive GDP-bound and active GTP-bound states and function as molecular switches in signal transduction cascades. Rho proteins promote reorganization of the actin cytoskeleton and regulate cell shape, attachment, and | 119 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | motility. The encoded protein is an important signalling protein for sarcomere assembly and has been shown to play a significant role in the exocytosis of the solute carrier family 2, facilitated glucose transporter member 4 and other proteins, possibly acting as the signal that turns on the membrane fusion machinery. Three related pseudogene have been identified on chromosomes 2 and 14. [provided by RefSeq, August 2011]. Publication Note: This RefSeq record includes a subset of the publications that are available for this gene. Please see the Gene record to access additional publications. ##Evidence-Data-START## Transcript exon combination :: BX428852.2, BC013135.1 [ECO: 0000332] RNAseq introns :: single sample supports all introns ERS025081, ERS025082 [ECO: 0000348] ##Evidence-Data-END## | |
| RNASE3 | exonic | 6037 | eosinophil cationic protein precursor | N/A | 120 |
| RNASE10 | exonic | 338879 | inactive ribonuclease-like protein 10 precursor | N/A | 121 |
| RPL38 | exonic | 6169 | 60S ribosomal protein L38 | Ribosomes, the organelles that catalyze protein synthesis, consist of a small 40S subunit and a large 60S subunit. Together these subunits are composed of 4 RNA species and approximately 80 structurally distinct proteins. This gene encodes a ribosomal protein that is a component of the 60S subunit. The protein belongs to the L38E family of ribosomal proteins. It is located in the cytoplasm. Alternative splice variants have been identified, both encoding the same protein. As is typical for genes encoding ribosomal proteins, there are multiple processed pseudogenes of this gene dispersed through the genome, including one located in the promoter region of the type 1 angiotensin II receptor gene. [provided by RefSeq, July 2008]. Transcript Variant: This variant (1) is the longer and predominant transcript. Variants 1 and 2 encode the same protein. ##Evidence-Data-START## Transcript exon combination :: BQ276548.1, BU569438.1 [ECO: 0000332] RNAseq introns :: single sample supports all introns ERS025081, ERS025082 [ECO: 0000348] ##Evidence-Data-END## | 122 |
| RPTOR | intronic | 57521 | regulatory-associated protein of mTOR isoform 1 | This gene encodes a component of a signaling pathway that regulates cell growth in response to nutrient and insulin levels. The encoded protein forms a stoichiometric complex with the mTOR kinase, and also associates with eukaryotic initiation factor 4E-binding protein-1 and ribosomal protein S6 kinase. The complex positively regulates the downstream effector ribosomal protein S6 kinase, and negatively regulates the mTOR kinase. Multiple transcript variants encoding different isoforms have been found for this gene. [provided by RefSeq, September 2009]. Transcript Variant: This variant (1) represents the longer transcript and encodes the longer isoform (1). Publication Note: This RefSeq record includes a subset of the publications that are available for this gene. Please see the Gene record to access additional publications. ##Evidence-Data-START## Transcript exon combination :: AY090663.1, BC136652.1 [ECO: 0000332] RNAseq introns :: single sample supports all introns ERS025083, ERS025085 [ECO: 0000348] ##Evidence-Data-END## | 123 |
| SERPINB4 | exonic | 6318 | serpin B4 | N/A | 124 |
| SERPINB6 | exonic | 5269 | serpin B6 isoform a | The protein encoded by this gene is a member of the serpin (serine proteinase inhibitor) superfamily, and ovalbumin(ov)-serpin subfamily. It was originally discovered as a placental thrombin inhibitor. The mouse homolog was found to | 125 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | be expressed in the hair cells of the inner ear. Mutations in this gene are associated with nonsyndromic progressive hearing loss, suggesting that this serpin plays an important role in the inner ear in the protection against leakage of lysosomal content during stress, and that loss of this protection results in cell death and sensorineural hearing loss. Alternatively spliced transcript variants have been found for this gene. [provided by RefSeq, September 2010]. Transcript Variant: This variant (1) represents the predominant transcript. Variants 1, 5 and 6 encode the same isoform (a). Publication Note: This RefSeq record includes a subset of the publications that are available for this gene. Please see the Gene record to access additional publications. ##Evidence-Data-START## Transcript exon combination :: AK314578.1, BC098564.1 [ECO: 0000332] RNAseq introns :: mixed/partial sample support ERS025081, ERS025082 [ECO: 0000350] ##Evidence-Data-END## | |
| SLC3A2 | both | 6520 | 4F2 cell-surface antigen heavy chain isoform b | This gene is a member of the solute carrier family and encodes a cell surface, transmembrane protein. The protein exists as the heavy chain of a heterodimer, covalently bound through di-sulfide bonds to one of several possible light chains. The encoded transporter plays a role in regulation of intracellular calcium levels and transports L-type amino acids. Alternatively spliced transcript variants, encoding different isoforms, have been characterized. [provided by RefSeq, November 2010]. Transcript Variant: This variant (2) represents the longest transcript and encodes the longest isoform (b). Publication Note: This RefSeq record includes a subset of the publications that are available for this gene. Please see the Gene record to access additional publications. ##Evidence-Data-START## Transcript exon combination :: AK025584.1 [ECO: 0000332] RNAseq introns :: mixed/partial sample support ERS025082, ERS025084 [ECO: 0000350] ##Evidence-Data-END## | 126 |
| SLC17A5 | both | 26503 | sialin | This gene encodes a membrane transporter that exports free sialic acids that have been cleaved off of cell surface lipids and proteins from lysosomes. Mutations in this gene cause sialic acid storage diseases, including infantile sialic acid storage disorder and and Salla disease, an adult form. [provided by RefSeq, July 2008]. Publication Note: This RefSeq record includes a subset of the publications that are available for this gene. Please see the Gene record to access additional publications. ##Evidence-Data-START## Transcript exon combination :: BC020961.2, AJ387747.1 [ECO: 0000332] RNAseq introns :: single sample supports all introns ERS025081, ERS025082 [ECO: 0000348] ##Evidence-Data-END## | 127 |
| SNHG3 | exonic | 8420 | N/A | N/A | 128 |
| SNORD17 | exonic | 692086 | N/A | N/A | 129 |
| SNX5 | exonic | 27131 | sorting nexin-5 isoform a | This gene encodes a member of the sorting nexin family. Members of this family contain a phox (PX) domain, which is a phosphoinositide binding domain, and are involved in intracellular trafficking. This protein functions in endosomal sorting, the phosphoinositide-signaling pathway, and macropinocytosis. This gene may play a role in the tumorigenesis of papillary thyroid carcinoma. Alternative splicing results in multiple transcript variants encoding different isoforms. [provided by RefSeq, September 2013]. Transcript Variant: This variant (1) differs in the 5' UTR, compared to variant 2. Variants 1 and 2 encode the same protein (isoform a). ##Evidence-Data-START## Transcript exon combination :: | 130 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| SOCS2 | exonic | 8835 | suppressor of cytokine signaling 2 | BC000100.3, AF121855.1 [ECO: 0000332] RNAseq introns :: mixed/partial sample support ERS025081, ERS025082 [ECO: 0000350] ##Evidence-Data-END## | 131 |
|  |  |  |  | This gene encodes a member of the suppressor of cytokine signaling (SOCS) family. SOCS family members are cytokine-inducible negative regulators of cytokine receptor signaling via the Janus kinase/signal transducer and activation of transcription pathway (the JAK/STAT pathway). SOCS family proteins interact with major molecules of signaling complexes to block further signal transduction, in part, by proteasomal depletion of receptors or signal-transducing proteins via ubiquitination. The expression of this gene can be induced by a subset of cytokines, including erythropoietin, GM-CSF, IL10, interferon (IFN)-gamma and by cytokine receptors such as growth horomone receptor. The protein encoded by this gene interacts with the cytoplasmic domain of insulin-like growth factor-1 receptor (IGF1R) and is thought to be involved in the regulation of IGF1R mediated cell signaling. This gene has pseudogenes on chromosomes 20 and 22. Alternative splicing results in multiple transcript variants. [provided by RefSeq, July 2012]. Transcript Variant: This variant (1) differs in the 5' UTR, compared to variant 5. Variants 1-6 encode the same protein. Publication Note: This RefSeq record includes a subset of the publications that are available for this gene. Please see the Gene record to access additional publications :: AK313165.1, AL522912.3 [ECO: 0000332] RNAseq introns :: single sample supports all introns ERS025081, ERS025082 [ECO: 0000348] ##Evidence-Data-END## |  |
| SOCS2-AS1 | exonic | 144481 | N/A | N/A | 132 |
| ST8SIA5 | exonic | 29906 | alpha-2,8-sialyltransferase 8E | The protein encoded by this gene is a type II membrane protein that may be present in the Golgi apparatus. The encoded protein, which is a member of glycosyltransferase family 29, may be involved in the synthesis of gangliosides GD1c, GT1a, GQ1b, and GT3 from GD1a, GT1b, GM1b, and GD3, respectively. [provided by RefSeq, July 2008]. ##Evidence-Data-START## Transcript exon combination :: AK056270.1, BC108910.1 [ECO: 0000332] RNAseq introns :: single sample supports all introns ERS025082, ERS025084 [ECO: 0000348] ##Evidence-Data-END## | 133 |
| STIM2 | intronic | 57620 | stromal interaction molecule 2 isoform 1 precursor | This gene is a member of the stromal interaction molecule (STIM) family and likely arose, along with related family member STIM1, from a common ancestral gene. The encoded protein functions to regulate calcium concentrations in the cytosol and endoplasmic reticulum, and is involved in the activation of plasma membrane Orai Ca(2+) entry channels. This gene initiates translation from a non-AUG (UUG) start site. A signal peptide is cleaved from the resulting protein. Multiple transcript variants result from alternative splicing. [provided by RefSeq, December 2009]. Transcript Variant: This variant (1) encodes the longest isoform (1). Publication Note: This RefSeq record includes a subset of the publications that are available for this gene. Please see the Gene record to access additional publications :: BC136449.1, AK096846.1 [ECO: 0000332] RNAseq introns :: single sample supports all introns ERS025081, ERS025084 [ECO: 0000348] ##Evidence-Data-END## ##RefSeq-Attributes-START## CDS uses downstream in-frame AUG :: experimental evidence (PMID: 11463338) non-AUG initiation codon :: PMID: 11463338 ##RefSeq-Attributes-END## | 134 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| TBC1D16 | intronic | 125058 | TBC1 domain family member 16 isoform a | N/A | 136 |
| TEX29 | exonic | 121793 | testis-expressed sequence 29 protein | N/A | 137 |
| TNFRSF10A | exonic | 8797 | tumor necrosis factor receptor superfamily member 10A | The protein encoded by this gene is a member of the TNF-receptor superfamily. This receptor is activated by tumor necrosis factor-related apoptosis inducing ligand (TNFSF10/TRAIL), and thus transduces cell death signal and induces cell apoptosis. Studies with FADD-deficient mice suggested that FADD, a death domain containing adaptor protein, is required for the apoptosis mediated by this protein. [provided by RefSeq, July 2008]. Publication Note: This RefSeq record includes a subset of the publications that are available for this gene. Please see the Gene record to access additional publications. ##Evidence-Data-START## Transcript exon combination :: BC012866.1, AK291299.1 [ECO: 0000332] RNAseq introns :: single sample supports all introns ERS025081, ERS025084 [ECO: 0000348] ##Evidence-Data-END## | 138 |
| TNFRSF13C | exonic | 115650 | tumor necrosis factor receptor superfamily member 13C | B cell-activating factor (BAFF) enhances B-cell survival in vitro and is a regulator of the peripheral B-cell population. Overexpression of Baff in mice results in mature B-cell hyperplasia and symptoms of systemic lupus erythematosus (SLE). Also, some SLE patients have increased levels of BAFF in serum. Therefore, it has been proposed that abnormally high levels of BAFF may contribute to the pathogenesis of autoimmune diseases by enhancing the survival of autoreactive B cells. The protein encoded by this gene is a receptor for BAFF and is a type III transmembrane protein containing a single extracellular cysteine-rich domain. It is thought that this receptor is the principal receptor required for BAFF-mediated mature B-cell survival. [provided by RefSeq, July 2008]. Sequence Note: The RefSeq transcript and protein were derived from genomic sequence to make the sequence consistent with the reference genome assembly. The genomic coordinates used for the transcript record were based on alignments. Publication Note: This RefSeq record includes a subset of the publications that are available for this gene. Please see the Gene record to access additional publications. ##Evidence-Data-START## Transcript exon combination :: AF373846.1, BC112030.1 [ECO: 0000332] RNAseq introns :: single sample supports all introns ERS025089 [ECO: 0000348] ##Evidence-Data-END## | 139 |
| TNFRSF18 | exonic | 8784 | tumor necrosis factor receptor superfamily member 18 isoform 1 precursor | This gene encodes a member of the TNF-receptor superfamily. The encoded receptor has been shown to have increased expression upon T-cell activation, and it is thought to play a key role in dominant immunological self-tolerance maintained by CD25(+)CD4(+) regulatoiy T cells. Knockout studies in mice also suggest the role of this receptor is in the regulation of CD3-driven T-cell activation and programmed cell death. Three alternatively spliced transcript variants of this gene encoding distinct isoforms have been reported. [provided by RefSeq, February 2011]. Transcript Variant: This variant (1) represents the longest transcript. It contains an extra coding segment, which leads to a frame shift, compared to variant 2. The resulting protein (isoform 1) contains a distinct and shorter C-terminus, as compared to isoform 2. Sequence Note: This RefSeq record was created from transcript and genomic sequence data to make the sequence consistent with the reference genomic assembly. The genomic | 140 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| | | | | coordinates used for the transcript record were based on transcript alignments. Publication Note: This RefSeq record includes a subset of the publications that are available for this gene. Please see the Gene record to access additional publications. ##Evidence-Data-START## Transcript exon combination :: AY358877.1, AF125304.1 [ECO: 0000332] RNAseq introns :: single sample supports all introns ERS025089, ERS025093 [ECO: 0000348] ##Evidence-Data-END## | |
| TRAFD1 | exonic | 10906 | TRAF-type zinc finger domain-containing protein 1 | The innate immune system confers host defense against viral and microbial infection, and TRAFD1 is a negative feedback regulator that controls excessive immune responses (Sanada et al., 2008 [PubMed 18849341]). [supplied by OMIM, December 2009]. Transcript Variant: This variant (1) represents the longer transcript. Variants 1 and 2 both encode the same protein. ##Evidence-Data-START## Transcript exon combination :: AK122620.1 [ECO: 0000332] RNAseq introns :: single sample supports all introns ERS025083, ERS025084 [ECO: 0000348] ##Evidence-Data-END## | 141 |
| TRPM2 | exonic | 7226 | Transient Receptor Potential Cation Channel Subfamily M Member 2 | The protein encoded by this gene is a calcium-permeable cation channel that is regulated by free intracellular ADP-ribose. The encoded protein is activated by oxidative stress and confers susceptibility to cell death. Several alternatively spliced transcript variants of this gene have been described, but their full-length nature is not known. [provided by RefSeq July 2008]. Transcript Variant: This variant (2) uses an alternate in-frame splice junction at the 5' end of an exon compared to variant 1. This results in the introduction of a premature stop codon and renders the transcript a nonsense-mediated mRNA decay (NMD) candidate. Therefore, this transcript is not thought to be protein-coding. Publication Note: This RefSeq record includes a subset of the publications that are available for this gene. Please see the Gene record to access additional publications. ##Evidence-Data-START## RNAseq introns :: mixed/partial sample support ERS025081, ERS025082 [ECO: 0000350] ##Evidence-Data-END## | 142 |
| TTLL10 | exonic | 254173 | inactive polyglycylase TTLL10 isoform 1 | N/A | 143 |
| TTYH2 | exonic | 94015 | protein tweety homolog 2 isoform 1 | This gene encodes a member of the tweety family of proteins. Members of this family function as chloride anion channels. The encoded protein functions as a calcium(2+)-activated large conductance chloride(−) channel, and may play a role in kidney tumorigenesis. Two transcript variants encoding distinct isoforms have been identified for this gene. [provided by RefSeq, July 2008]. Transcript Variant: This variant (1) represents the longer transcript, and encodes the longer isoform (1). ##Evidence-Data-START## Transcript exon combination :: AF319952.1, BC107492.1 [ECO: 0000332] RNAseq introns :: single sample supports all introns ERS025082, ERS025083 [ECO: 0000348] ##Evidence-Data-END## | 144 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| UBE2N | exonic | 7334 | ubiquitin-conjugating enzyme E2 N | The modification of proteins with ubiquitin is an important cellular mechanism for targeting abnormal or short-lived proteins for degradation. Ubiquitination involves at least three classes of enzymes: ubiquitin-activating enzymes, or E1s, ubiquitin-conjugating enzymes, or E2s, and ubiquitin-protein ligases, or E3s. This gene encodes a member of the E2 ubiquitin-conjugating enzyme family. Studies in mouse suggest that this protein plays a role in DNA postreplication repair. [provided by RefSeq, July 2008]. Publication Note: This RefSeq record includes a subset of the publications that are available for this gene. Please see the Gene record to access additional publications. ##Evidence-Data-START## Transcript exon combination :: BC000396.2, D83004.1 [ECO: 0000332] RNAseq introns :: single sample supports all introns ERS025084 [ECO: 0000348] ##Evidence-Data-END## | 145 |
| VCX | exonic | 26609 | variable charge X-linked protein 1 | This gene belongs to the VCX/Y gene family, which has multiple members on both X and Y chromosomes, and all are expressed exclusively in male germ cells. The X-linked members are clustered on chromosome Xp22 and Y-linked members are two identical copies of the gene within a palindromic region on Yq11. The family members share a high degree of sequence identity, with the exception that a 30-bp unit is tandemly repeated in X-linked members but occurs only once in Y-linked members. The VCX gene cluster is polymorphic in terms of copy number; different individuals may have a different number of VCX genes. VCX/Y genes encode small and highly charged proteins of unknown function. The presence of a putative bipartite nuclear localization signal suggests that VCX/Y members are nuclear proteins. This gene contains 10 repeats of the 30-bp unit. [provided by RefSeq, July 2008]. ##Evidence-Data-START## Transcript exon combination :: AF167081.2 [ECO: 0000332] ##Evidence-Data-END## | 146 |
| VSTM1 | intronic | 284415 | V-set and transmembrane domain-containing protein 1 precursor | N/A | 147 |

TABLE 3-continued

A non-redundant list of genes listed in Table 2

| RefSeq Gene Symbol | Exon overlap | NCBI Gene ID | Gene Description | RefSeq_Summary | Gene # (GN) |
|---|---|---|---|---|---|
| VWA2 | exonic | 340706 | von Willebrand factor A domain-containing protein 2 precursor | This gene encodes a member of the von Willebrand factor A-like domain protein superfamily. The encoded protein is localized to the extracellular matrix and may serve as a structural component in basement membranes or in anchoring structures on scaffolds of collagen VII or fibrillin. This gene has been linked to type 1A diabetes and is a candidate serological marker for colon cancer. [provided by RefSeq, January 2013]. Sequence Note: This RefSeq record was created from transcript and genomic sequence data to make the sequence consistent with the reference genome assembly. The genomic coordinates used for the transcript record were based on transcript alignments. CCDS Note: The coding region has been updated to represent an alternative 3' splicing pattern that is more supported by the available transcript and protein data. ##Evidence-Data-START## Transcript exon combination :: AY572972.1, AJ536328.2 [ECO: 0000332] RNAseq introns :: mixed/partial sample support ERS025081, ERS025084 [ECO: 0000350] ##Evidence-Data-END## | 148 |
| ZNF350 | exonic | 59348 | zinc finger protein 350 | N/A | 149 |
| ZNF432 | exonic | 9668 | zinc finger protein 432 | N/A | 150 |
| ZNF577 | exonic | 84765 | N/A | N/A | 151 |
| ZNF613 | exonic | 79898 | zinc finger protein 613 isoform 1 | N/A | 152 |
| ZNF614 | exonic | 80110 | zinc finger protein 614 | N/A | 153 |
| ZNF615 | exonic | 284370 | zinc finger protein 615 isoform 1 | N/A | 154 |
| ZNF649 | exonic | 65251 | zinc finger protein 649 | N/A | 155 |
| ZNF841 | exonic | 284371 | zinc finger protein 841 | N/A | 156 |

For all genes listed in Table 2 (namely, those relevant to CNV-subregions of interest), Table 3 represents a non-redundant list.

TABLE 4

A non-redundant list of transcript variants that correspond to the genes in Table 3

| RefSeq Gene Symbol | Exon overlap | RefSeq Accession Number | mRNA_Description | SEQ ID |
|---|---|---|---|---|
| MIR200B | exonic | NR_029639 | *Homo sapiens* microRNA 200b (MIR200B), microRNA. | 173 |
| MIR200A | exonic | NR_029834 | *Homo sapiens* microRNA 200a (MIR200A), microRNA. | 174 |
| MIR429 | exonic | NR_029957 | *Homo sapiens* microRNA 429 (MIR429), microRNA. | 175 |
| TTLL10 | exonic | NM_001130045 | *Homo sapiens* tubulin tyrosine ligase-like family, member 10 (TTLL10), transcript variant 1, mRNA. | 176 |
| TTLL10 | exonic | NM_153254 | *Homo sapiens* tubulin tyrosine ligase-like family, member 10 (TTLL10), transcript variant 2, mRNA. | 177 |
| TNFRSF18 | exonic | NM_004195 | *Homo sapiens* tumor necrosis factor receptor superfamily, member 18 (TNFRSF18), transcript variant 1, mRNA. | 178 |
| TNFRSF18 | exonic | NM_148901 | *Homo sapiens* tumor necrosis factor receptor superfamily, member 18 (TNFRSF18), transcript variant 2, mRNA. | 179 |
| TNFRSF18 | exonic | NM_148902 | *Homo sapiens* tumor necrosis factor receptor superfamily, member 18 (TNFRSF18), transcript variant 3, mRNA. | 180 |
| PIK3CD | exonic | NM_005026 | *Homo sapiens* phosphatidylinositol-4,5-bisphosphate 3-kinase, catalytic subunit delta (PIK3CD), mRNA. | 181 |
| CAPZB | intronic | NR_038125 | *Homo sapiens* capping protein (actin filament) muscle Z-line, beta (CAPZB), transcript variant 4, non-coding RNA. | 182 |
| CAPZB | intronic | NM_001206540 | *Homo sapiens* capping protein (actin filament) muscle Z-line, beta (CAPZB), transcript variant 2, mRNA. | 183 |
| CAPZB | intronic | NM_004930 | *Homo sapiens* capping protein (actin filament) muscle Z-line, beta (CAPZB), transcript variant 1, mRNA. | 184 |
| IFNLR1 | exonic | NM_170743 | *Homo sapiens* interferon, lambda receptor 1 (IFNLR1), transcript variant 1, mRNA. | 185 |
| IFNLR1 | exonic | NM_173064 | *Homo sapiens* interferon, lambda receptor 1 (IFNLR1), transcript variant 2, mRNA. | 186 |
| IFNLR1 | exonic | NM_173065 | *Homo sapiens* interferon, lambda receptor 1 (IFNLR1), transcript variant 3, mRNA. | 187 |
| PHACTR4 | exonic | NM_001048183 | *Homo sapiens* phosphatase and actin regulator 4 (PHACTR4), transcript variant 1, mRNA. | 188 |
| PHACTR4 | exonic | NM_023923 | *Homo sapiens* phosphatase and actin regulator 4 (PHACTR4), transcript variant 2, mRNA. | 189 |
| SNHG3 | exonic | NR_002909 | *Homo sapiens* small nucleolar RNA host gene 3 (non-protein coding) (SNHG3), transcript variant 2, non-coding RNA. | 190 |
| SNHG3 | exonic | NR_036473 | *Homo sapiens* small nucleolar RNA host gene 3 (non-protein coding) (SNHG3), transcript variant 1, non-coding RNA. | 191 |
| RCC1 | exonic | NM_001048199 | *Homo sapiens* regulator of chromosome condensation 1 (RCC1), transcript variant 4, mRNA. | 192 |
| RCC1 | exonic | NR_030725 | *Homo sapiens* regulator of chromosome condensation 1 (RCC1), transcript variant 5, non-coding RNA. | 193 |
| RCC1 | exonic | NR_030726 | *Homo sapiens* regulator of chromosome condensation 1 (RCC1), transcript variant 6, non-coding RNA. | 194 |
| RCC1 | exonic | NM_001048194 | *Homo sapiens* regulator of chromosome condensation 1 (RCC1), transcript variant 1, mRNA. | 195 |
| RCC1 | exonic | NM_001048195 | *Homo sapiens* regulator of chromosome condensation 1 (RCC1), transcript variant 2, mRNA. | 196 |
| RCC1 | exonic | NM_001269 | *Homo sapiens* regulator of chromosome condensation 1 (RCC1), transcript variant 3, mRNA. | 197 |
| AGBL4 | intronic | NM_032785 | *Homo sapiens* ATP/GTP binding protein-like 4 (AGBL4), mRNA. | 198 |
| GPATCH2 | intronic | NM_018040 | *Homo sapiens* G patch domain containing 2 (GPATCH2), mRNA. | 199 |
| RHOQ | intronic | NM_012249 | *Homo sapiens* ras homolog family member Q (RHOQ), mRNA. | 200 |
| PNPT1 | both | NM_033109 | *Homo sapiens* polyribonucleotide nucleotidyltransferase 1 (PNPT1), mRNA. | 201 |
| MCEE | both | NM_032601 | *Homo sapiens* methylmalonyl CoA epimerase (MCEE), mRNA. | 202 |
| HK2 | exonic | NM_000189 | *Homo sapiens* hexokinase 2 (HK2), mRNA. | 203 |
| FHL2 | exonic | NM_201557 | *Homo sapiens* four and a half LIM domains 2 (FHL2), transcript variant 4, mRNA. | 204 |
| FHL2 | intronic | NM_001039492 | *Homo sapiens* four and a half LIM domains 2 (FHL2), transcript variant 5, mRNA. | 205 |
| FHL2 | intronic | NM_001450 | *Homo sapiens* four and a half LIM domains 2 (FHL2), transcript variant 1, mRNA. | 206 |
| FHL2 | intronic | NM_201555 | *Homo sapiens* four and a half LIM domains 2 (FHL2), transcript variant 2, mRNA. | 207 |
| MIR4267 | exonic | NR_036225 | *Homo sapiens* microRNA 4267 (MIR4267), microRNA. | 208 |
| MALL | exonic | NM_005434 | *Homo sapiens* mal, T-cell differentiation protein-like (MALL), mRNA. | 209 |
| MIR4436B1 | exonic | NR_039941 | *Homo sapiens* microRNA 4436b-1 (MIR4436B1), microRNA. | 210 |
| MIR4436B2 | exonic | NR_049830 | *Homo sapiens* microRNA 4436b-2 (MIR4436B2), microRNA. | 211 |
| MGAT5 | intronic | NM_002410 | *Homo sapiens* mannosyl (alpha-1,6-)-glycoprotein beta-1,6-N-acetyl-glucosaminyltransferase (MGAT5), mRNA. | 212 |
| BMPR2 | intronic | NM_001204 | *Homo sapiens* bone morphogenetic protein receptor, type II (serine/threonine kinase) (BMPR2), mRNA. | 213 |
| DNER | intronic | NM_139072 | *Homo sapiens* delta/notch-like EGF repeat containing (DNER), mRNA. | 214 |
| IQCB1 | exonic | NM_001023570 | *Homo sapiens* IQ motif containing B1 (IQCB1), transcript variant 1, mRNA. | 215 |
| IQCB1 | exonic | NM_001023571 | *Homo sapiens* IQ motif containing B1 (IQCB1), transcript variant 3, mRNA. | 216 |
| STIM2 | intronic | NM_001169117 | *Homo sapiens* stromal interaction molecule 2 (STIM2), transcript variant 3, mRNA. | 217 |
| STIM2 | intronic | NM_001169118 | *Homo sapiens* stromal interaction molecule 2 (STIM2), transcript variant 1, mRNA. | 218 |
| STIM2 | intronic | NM_020860 | *Homo sapiens* stromal interaction molecule 2 (STIM2), transcript variant 2, mRNA. | 219 |
| PDGFRA | exonic | NM_006206 | *Homo sapiens* platelet-derived growth factor receptor, alpha polypeptide (PDGFRA), mRNA. | 220 |
| HCN1 | exonic | NM_021072 | *Homo sapiens* hyperpolarization activated cyclic nucleotide-gated potassium channel 1 (HCN1), mRNA. | 221 |
| EMB | exonic | NM_198449 | *Homo sapiens* embigin (EMB), mRNA. | 222 |
| EDIL3 | intronic | NM_005711 | *Homo sapiens* EGF-like repeats and discoidin I-like domains 3 (EDIL3), transcript variant 1, mRNA. | 223 |

TABLE 4-continued

A non-redundant list of transcript variants that correspond to the genes in Table 3

| RefSeq Gene Symbol | Exon overlap | RefSeq Accession Number | mRNA_Description | SEQ ID |
|---|---|---|---|---|
| MAPK9 | exonic | NM_002752 | Homo sapiens mitogen-activated protein kinase 9 (MAPK9), transcript variant JNK2-a2, mRNA. | 224 |
| MAPK9 | exonic | NM_139068 | Homo sapiens mitogen-activated protein kinase 9 (MAPK9), transcript variant JNK2-a1, mRNA. | 225 |
| MAPK9 | exonic | NM_139069 | Homo sapiens mitogen-activated protein kinase 9 (MAPK9), transcript variant JNK2-b1, mRNA. | 226 |
| MAPK9 | exonic | NM_139070 | Homo sapiens mitogen-activated protein kinase 9 (MAPK9), transcript variant JNK2-b2, mRNA. | 227 |
| MAPK9 | exonic | NM_001135044 | Homo sapiens mitogen-activated protein kinase 9 (MAPK9), transcript variant JNK2-g, mRNA. | 228 |
| SERPINB6 | exonic | NM_001271825 | Homo sapiens serpin peptidase inhibitor, clade B (ovalbumin), member 6 (SERPINB6), transcript variant 6, mRNA. | 229 |
| SERPINB6 | exonic | NM_001271823 | Homo sapiens serpin peptidase inhibitor, clade B (ovalbumin), member 6 (SERPINB6), transcript variant 4, mRNA. | 230 |
| SERPINB6 | exonic | NM_001271822 | Homo sapiens serpin peptidase inhibitor, clade B (ovalbumin), member 6 (SERPINB6), transcript variant 3, mRNA. | 231 |
| SERPINB6 | exonic | NM_001195291 | Homo sapiens serpin peptidase inhibitor, clade B (ovalbumin), member 6 (SERPINB6), transcript variant 2, mRNA. | 232 |
| SERPINB6 | exonic | NM_001271824 | Homo sapiens serpin peptidase inhibitor, clade B (ovalbumin), member 6 (SERPINB6), transcript variant 5, mRNA. | 233 |
| SERPINB6 | exonic | NM_004568 | Homo sapiens serpin peptidase inhibitor, clade B (ovalbumin), member 6 (SERPINB6), transcript variant 1, mRNA. | 234 |
| DKFZP686I15217 | exonic | NR_026855 | Homo sapiens long intergenic non-protein coding RNA 1011 (LINC01011), transcript variant 1, non-coding RNA. | 235 |
| DKFZP686I15217 | exonic | NR_026856 | Homo sapiens long intergenic non-protein coding RNA 1011 (LINC01011), transcript variant 2, non-coding RNA. | 236 |
| NQO2 | exonic | NM_000904 | Homo sapiens NAD(P)H dehydrogenase, quinone 2 (NQO2), mRNA. | 237 |
| HTATSF1P2 | exonic | NR_033884 | Homo sapiens HIV-1 Tat specific factor 1 pseudogene 2 (HTATSF1P2), non-coding RNA. | 238 |
| PKHD1 | intronic | NM_138694 | Homo sapiens polycystic kidney and hepatic disease 1 (autosomal recessive) (PKHD1), transcript variant 1, mRNA. | 239 |
| PKHD1 | intronic | NM_170724 | Homo sapiens polycystic kidney and hepatic disease 1 (autosomal recessive) (PKHD1), transcript variant 2, mRNA. | 240 |
| SLC17A5 | both | NM_012434 | Homo sapiens solute carrier family 17 (acidic sugar transporter), member 5 (SLC17A5), mRNA. | 241 |
| PDSS2 | exonic | NM_020381 | Homo sapiens prenyl (decaprenyl) diphosphate synthase, subunit 2 (PDSS2), mRNA. | 242 |
| KCTD7 | exonic | NM_001167961 | Homo sapiens potassium channel tetramerization domain containing 7 (KCTD7), transcript variant 2, mRNA. | 243 |
| KCTD7 | exonic | NM_153033 | Homo sapiens potassium channel tetramerization domain containing 7 (KCTD7), transcript variant 1, mRNA. | 244 |
| PTPRN2 | intronic | NM_002847 | Homo sapiens protein tyrosine phosphatase, receptor type, N polypeptide 2 (PTPRN2), transcript variant 1, mRNA. | 245 |
| PTPRN2 | intronic | NM_130842 | Homo sapiens protein tyrosine phosphatase, receptor type, N polypeptide 2 (PTPRN2), transcript variant 2, mRNA. | 246 |
| PTPRN2 | intronic | NM_130843 | Homo sapiens protein tyrosine phosphatase, receptor type, N polypeptide 2 (PTPRN2), transcript variant 3, mRNA. | 247 |
| MIR595 | exonic | NR_030325 | Homo sapiens microRNA 595 (MIR595), microRNA. | 248 |
| TNFRSF10A | exonic | NM_003844 | Homo sapiens tumor necrosis factor receptor superfamily, member 10a (TNFRSF10A), mRNA. | 249 |
| IDO2 | intronic | NM_194294 | Homo sapiens indoleamine 2,3-dioxygenase 2 (IDO2), mRNA. | 250 |
| STK3 | intronic | NM_001256313 | Homo sapiens serine/threonine kinase 3 (STK3), transcript variant 3, mRNA. | 251 |
| STK3 | intronic | NM_006281 | Homo sapiens serine/threonine kinase 3 (STK3), transcript variant 1, mRNA. | 252 |
| STK3 | intronic | NM_001256312 | Homo sapiens serine/threonine kinase 3 (STK3), transcript variant 2, mRNA. | 253 |
| KANK1 | intronic | NM_001256876 | Homo sapiens KN motif and ankyrin repeat domains 1 (KANK1), transcript variant 3, mRNA. | 254 |
| KANK1 | intronic | NM_001256877 | Homo sapiens KN motif and ankyrin repeat domains 1 (KANK1), transcript variant 4, mRNA. | 255 |
| KANK1 | intronic | NM_015158 | Homo sapiens KN motif and ankyrin repeat domains 1 (KANK1), transcript variant 1, mRNA. | 256 |
| KANK1 | intronic | NM_153186 | Homo sapiens KN motif and ankyrin repeat domains 1 (KANK1), transcript variant 2, mRNA. | 257 |
| GDA | exonic | NM_001242507 | Homo sapiens guanine deaminase (GDA), transcript variant 4, mRNA. | 258 |
| GDA | exonic | NM_001242505 | Homo sapiens guanine deaminase (GDA), transcript variant 1, mRNA. | 259 |
| GDA | exonic | NM_001242506 | Homo sapiens guanine deaminase (GDA), transcript variant 3, mRNA. | 260 |
| GDA | exonic | NM_004293 | Homo sapiens guanine deaminase (GDA), transcript variant 2, mRNA. | 261 |
| AUH | exonic | NM_001698 | Homo sapiens AU RNA binding protein/enoyl-CoA hydratase (AUH), mRNA. | 262 |
| MIR3163 | exonic | NR_036121 | Homo sapiens microRNA 3163 (MIR3163), microRNA. | 263 |
| NFIL3 | exonic | NM_005384 | Homo sapiens nuclear factor, interleukin 3 regulated (NFIL3), mRNA. | 264 |
| MIR3910-1 | exonic | NR_037472 | Homo sapiens microRNA 3910-1 (MIR3910-1), microRNA. | 265 |
| MIR3910-2 | exonic | NR_037489 | Homo sapiens microRNA 3910-2 (MIR3910-2), microRNA. | 266 |
| ASTN2 | intronic | NM_014010 | Homo sapiens astrotactin 2 (ASTN2), transcript variant 1, mRNA. | 267 |
| ASTN2 | intronic | NM_198186 | Homo sapiens astrotactin 2 (ASTN2), transcript variant 2, mRNA. | 268 |
| ASTN2 | intronic | NM_001184734 | Homo sapiens astrotactin 2 (ASTN2), transcript variant 5, mRNA. | 269 |
| ASTN2 | intronic | NM_198187 | Homo sapiens astrotactin 2 (ASTN2), transcript variant 3, mRNA. | 270 |
| ASTN2 | intronic | NM_198188 | Homo sapiens astrotactin 2 (ASTN2), transcript variant 4, mRNA. | 271 |

TABLE 4-continued

A non-redundant list of transcript variants that correspond to the genes in Table 3

| RefSeq Gene Symbol | Exon overlap | RefSeq Accession Number | mRNA_Description | SEQ ID |
|---|---|---|---|---|
| ASTN2 | intronic | NM_001184735 | *Homo sapiens* astrotactin 2 (ASTN2), transcript variant 6, mRNA. | 272 |
| LARP4B | exonic | NM_015155 | *Homo sapiens* La ribonucleoprotein domain family, member 4B (LARP4B), mRNA. | 273 |
| GTPBP4 | exonic | NM_012341 | *Homo sapiens* GTP binding protein 4 (GTPBP4), mRNA. | 274 |
| IDI2 | exonic | NM_033261 | *Homo sapiens* isopentenyl-diphosphate delta isomerase 2 (IDI2), mRNA. | 275 |
| IDI2-AS1 | exonic | NR_024628 | *Homo sapiens* IDI2 antisense RNA 1 (IDI2-AS1), transcript variant 1, non-coding RNA. | 276 |
| IDI2-AS1 | exonic | NR_024629 | *Homo sapiens* IDI2 antisense RNA 1 (IDI2-AS1), transcript variant 2, non-coding RNA. | 277 |
| IDI2-AS1 | exonic | NR_027708 | *Homo sapiens* IDI2 antisense RNA 1 (IDI2-AS1), transcript variant 3, non-coding RNA. | 278 |
| IDI2-AS1 | exonic | NR_027709 | *Homo sapiens* IDI2 antisense RNA 1 (IDI2-AS1), transcript variant 4, non-coding RNA. | 279 |
| KAT6B | exonic | NM_001256468 | *Homo sapiens* K(lysine) acetyltransferase 6B (KAT6B), transcript variant 2, mRNA. | 280 |
| KAT6B | exonic | NM_001256469 | *Homo sapiens* K(lysine) acetyltransferase 6B (KAT6B), transcript variant 3, mRNA. | 281 |
| KAT6B | exonic | NM_012330 | *Homo sapiens* K(lysine) acetyltransferase 6B (KAT6B), transcript variant 1, mRNA. | 282 |
| VWA2 | exonic | NM_001272046 | *Homo sapiens* von Willebrand factor A domain containing 2 (VWA2), mRNA. | 283 |
| PDE3B | intronic | NM_000922 | *Homo sapiens* phosphodiesterase 3B, cGMP-inhibited (PDE3B), mRNA. | 284 |
| EHF | intronic | NM_001206615 | *Homo sapiens* ets homologous factor (EHF), transcript variant 3, mRNA. | 285 |
| EHF | intronic | NM_012153 | *Homo sapiens* ets homologous factor (EHF), transcript variant 2, mRNA. | 286 |
| EHF | exonic | NM_001206616 | *Homo sapiens* ets homologous factor (EHF), transcript variant 1, mRNA. | 287 |
| SLC3A2 | exonic | NM_001012662 | *Homo sapiens* solute carrier family 3 (amino acid transporter heavy chain), member 2 (SLC3A2), transcript variant 2, mRNA. | 288 |
| SLC3A2 | intronic | NM_001012664 | *Homo sapiens* solute carrier family 3 (amino acid transporter heavy chain), member 2 (SLC3A2), transcript variant 5, mRNA. | 289 |
| SLC3A2 | exonic | NM_002394 | *Homo sapiens* solute carrier family 3 (amino acid transporter heavy chain), member 2 (SLC3A2), transcript variant 3, mRNA. | 290 |
| SLC3A2 | intronic | NM_001013251 | *Homo sapiens* solute carrier family 3 (amino acid transporter heavy chain), member 2 (SLC3A2), transcript variant 6, mRNA. | 291 |
| SLC3A2 | intronic | NR_037193 | *Homo sapiens* solute carrier family 3 (amino acid transporter heavy chain), member 2 (SLC3A2), transcript variant 7, non-coding RNA. | 292 |
| GDPD4 | exonic | NM_182833 | *Homo sapiens* glycerophosphodiester phosphodiesterase domain containing 4 (GDPD4), mRNA. | 293 |
| ETV6 | exonic | NM_001987 | *Homo sapiens* ets variant 6 (ETV6), mRNA. | 294 |
| LOH12CR1 | exonic | NM_058169 | *Homo sapiens* loss of heterozygosity, 12, chromosomal region 1 (LOH12CR1), mRNA. | 295 |
| DUSP16 | exonic | NM_030640 | *Homo sapiens* dual specificity phosphatase 16 (DUSP16), mRNA. | 296 |
| CREBL2 | exonic | NM_001310 | *Homo sapiens* cAMP responsive element binding protein-like 2 (CREBL2), mRNA. | 297 |
| GPR19 | exonic | NM_006143 | *Homo sapiens* G protein-coupled receptor 19 (GPR19), mRNA. | 298 |
| CDKN1B | exonic | NM_004064 | *Homo sapiens* cyclin-dependent kinase inhibitor 1B (p27, Kip1) (CDKN1B), mRNA. | 299 |
| APOLD1 | exonic | NM_001130415 | *Homo sapiens* apolipoprotein L domain containing 1 (APOLD1), transcript variant 1, mRNA. | 300 |
| APOLD1 | intronic | NM_030817 | *Homo sapiens* apolipoprotein L domain containing 1 (APOLD1), transcript variant 2, mRNA. | 301 |
| EEA1 | exonic | NM_003566 | *Homo sapiens* early endosome antigen 1 (EEA1), mRNA. | 302 |
| LOC643339 | exonic | NR_040096 | *Homo sapiens* uncharacterized LOC643339 (LOC643339), non-coding RNA. | 303 |
| NUDT4 | exonic | NM_019094 | *Homo sapiens* nudix (nucleoside diphosphate linked moiety X)-type motif 4 (NUDT4), transcript variant 1, mRNA. | 304 |
| NUDT4 | exonic | NM_199040 | *Homo sapiens* nudix (nucleoside diphosphate linked moiety X)-type motif 4 (NUDT4), transcript variant 2, mRNA. | 305 |
| NUDT4P1 | exonic | NR_002212 | *Homo sapiens* nudix (nucleoside diphosphate linked moiety X)-type motif 4 pseudogene 1 (NUDT4P1), non-coding RNA. | 306 |
| UBE2N | exonic | NM_003348 | *Homo sapiens* ubiquitin-conjugating enzyme E2N (UBE2N), mRNA. | 307 |
| MRPL42 | exonic | NM_014050 | *Homo sapiens* mitochondrial ribosomal protein L42 (MRPL42), transcript variant 1, mRNA. | 308 |
| MRPL42 | exonic | NM_172177 | *Homo sapiens* mitochondrial ribosomal protein L42 (MRPL42), transcript variant 2, mRNA. | 309 |
| MRPL42 | exonic | NR_038159 | *Homo sapiens* mitochondrial ribosomal protein L42 (MRPL42), transcript variant 3, non-coding RNA. | 310 |
| MRPL42 | exonic | NR_038160 | *Homo sapiens* mitochondrial ribosomal protein L42 (MRPL42), transcript variant 4, non-coding RNA. | 311 |
| MRPL42 | exonic | NR_038161 | *Homo sapiens* mitochondrial ribosomal protein L42 (MRPL42), transcript variant 5, non-coding RNA. | 312 |
| SOCS2-AS1 | exonic | NR_038263 | *Homo sapiens* SOCS2 antisense RNA 1 (SOCS2-AS1), non-coding RNA. | 313 |
| SOCS2 | exonic | NM_003877 | *Homo sapiens* suppressor of cytokine signaling 2 (SOCS2), transcript variant 1, mRNA. | 314 |
| SOCS2 | exonic | NM_001270467 | *Homo sapiens* suppressor of cytokine signaling 2 (SOCS2), transcript variant 2, mRNA. | 315 |
| SOCS2 | exonic | NM_001270468 | *Homo sapiens* suppressor of cytokine signaling 2 (SOCS2), transcript variant 3, mRNA. | 316 |
| SOCS2 | exonic | NM_001270469 | *Homo sapiens* suppressor of cytokine signaling 2 (SOCS2), transcript variant 4, mRNA. | 317 |
| SOCS2 | exonic | NM_001270470 | *Homo sapiens* suppressor of cytokine signaling 2 (SOCS2), transcript variant 5, mRNA. | 318 |
| SOCS2 | exonic | NM_001270471 | *Homo sapiens* suppressor of cytokine signaling 2 (SOCS2), transcript variant 6, mRNA. | 319 |
| CRADD | exonic | NM_003805 | *Homo sapiens* CASP2 and RIPK1 domain containing adaptor with death domain (CRADD), mRNA. | 320 |
| PLXNC1 | exonic | NM_005761 | *Homo sapiens* plexin C1 (PLXNC1), transcript variant 1, mRNA. | 321 |
| PLXNC1 | exonic | NR_037687 | *Homo sapiens* plexin C1 (PLXNC1), transcript variant 2, non-coding RNA. | 322 |
| CCDC41 | exonic | NM_001042399 | *Homo sapiens* coiled-coil domain containing 41 (CCDC41), transcript variant 2, mRNA. | 323 |
| CCDC41 | exonic | NM_016122 | *Homo sapiens* coiled-coil domain containing 41 (CCDC41), transcript variant 1, mRNA. | 324 |
| TRAFD1 | exonic | NM_001143906 | *Homo sapiens* TRAF-type zinc finger domain containing 1 (TRAFD1), transcript variant 1, mRNA. | 325 |
| TRAFD1 | exonic | NM_006700 | *Homo sapiens* TRAF-type zinc finger domain containing 1 (TRAFD1), transcript variant 2, mRNA. | 326 |
| RGCC | exonic | NM_014059 | *Homo sapiens* regulator of cell cycle (RGCC), mRNA. | 327 |
| COMMD6 | exonic | NM_203495 | *Homo sapiens* COMM domain containing 6 (COMMD6), transcript variant 2, mRNA. | 328 |
| COMMD6 | exonic | NM_203497 | *Homo sapiens* COMM domain containing 6 (COMMD6), transcript variant 1, mRNA. | 329 |
| GPC5 | intronic | NM_004466 | *Homo sapiens* glypican 5 (GPC5), mRNA. | 330 |

TABLE 4-continued

A non-redundant list of transcript variants that correspond to the genes in Table 3

| RefSeq Gene Symbol | Exon overlap | RefSeq Accession Number | mRNA_Description | SEQ ID |
|---|---|---|---|---|
| ARHGEF7 | exonic | NM_003899 | *Homo sapiens* Rho guanine nucleotide exchange factor (GEF) 7 (ARHGEF7), transcript variant 1, mRNA. | 331 |
| ARHGEF7 | exonic | NM_001113513 | *Homo sapiens* Rho guanine nucleotide exchange factor (GEF) 7 (ARHGEF7), transcript variant 5, mRNA. | 332 |
| TEX29 | exonic | NM_152324 | *Homo sapiens* testis expressed 29 (TEX29), mRNA. | 333 |
| ARHGEF7 | intronic | NM_001113511 | *Homo sapiens* Rho guanine nucleotide exchange factor (GEF) 7 (ARHGEF7), transcript variant 3, mRNA. | 334 |
| ARHGEF7 | intronic | NM_001113512 | *Homo sapiens* Rho guanine nucleotide exchange factor (GEF) 7 (ARHGEF7), transcript variant 4, mRNA. | 335 |
| ARHGEF7 | intronic | NM_145735 | *Homo sapiens* Rho guanine nucleotide exchange factor (GEF) 7 (ARHGEF7), transcript variant 2, mRNA. | 336 |
| RNASE10 | exonic | NM_001012975 | *Homo sapiens* ribonuclease, RNase A family, 10 (non-active) (RNASE10), mRNA. | 337 |
| RNASE3 | exonic | NM_002935 | *Homo sapiens* ribonuclease, RNase A family, 3 (RNASE3), mRNA. | 338 |
| ECRP | exonic | NR_033909 | *Homo sapiens* ribonuclease, RNase A family, 2 (liver, eosinophil-derived neurotoxin) pseudogene (ECRP), non-coding RNA. | 339 |
| PRKCH | intronic | NM_006255 | *Homo sapiens* protein kinase C, eta (PRKCH), mRNA. | 340 |
| MTHFD1 | exonic | NM_005956 | *Homo sapiens* methylenetetrahydrofolate dehydrogenase (NADP+ dependent) 1, methenyltetrahydrofolate cyclohydrolase, formyltetrahydrofolate synthetase (MTHFD1), mRNA. | 341 |
| BDKRB2 | intronic | NM_000623 | *Homo sapiens* bradykinin receptor B2 (BDKRB2), mRNA. | 342 |
| HEXA | exonic | NM_000520 | *Homo sapiens* hexosaminidase A (alpha polypeptide) (HEXA), mRNA. | 343 |
| PSTPIP1 | exonic | NM_003978 | *Homo sapiens* proline-serine-threonine phosphatase interacting protein 1 (PSTPIP1), mRNA. | 344 |
| RBFOX1 | intronic | NM_001142333 | *Homo sapiens* RNA binding protein, fox-1 homolog (*C. elegans*) 1 (RBFOX1), transcript variant 5, mRNA. | 345 |
| RBFOX1 | intronic | NM_018723 | *Homo sapiens* RNA binding protein, fox-1 homolog (*C. elegans*) 1 (RBFOX1), transcript variant 4, mRNA. | 346 |
| RBFOX1 | intronic | NM_001142334 | *Homo sapiens* RNA binding protein, fox-1 homolog (*C. elegans*) 1 (RBFOX1), transcript variant 6, mRNA. | 347 |
| RBFOX1 | intronic | NM_145891 | *Homo sapiens* RNA binding protein, fox-1 homolog (*C. elegans*) 1 (RBFOX1), transcript variant 1, mRNA. | 348 |
| RBFOX1 | intronic | NM_145892 | *Homo sapiens* RNA binding protein, fox-1 homolog (*C. elegans*) 1 (RBFOX1), transcript variant 2, mRNA. | 349 |
| RBFOX1 | intronic | NM_145893 | *Homo sapiens* RNA binding protein, fox-1 homolog (*C. elegans*) 1 (RBFOX1), transcript variant3, mRNA. | 350 |
| PRKCB | both | NM_002738 | *Homo sapiens* protein kinase C, beta (PRKCB), transcript variant 2, mRNA. | 351 |
| PRKCB | both | NM_212535 | *Homo sapiens* protein kinase C, beta (PRKCB), transcript variant 1, mRNA. | 352 |
| FUK | both | NM_145059 | *Homo sapiens* fucokinase (FUK), mRNA. | 353 |
| COG4 | exonic | NM_001195139 | *Homo sapiens* component of oligomeric golgi complex 4 (COG4), transcript variant 2, mRNA. | 354 |
| COG4 | exonic | NM_015386 | *Homo sapiens* component of oligomeric golgi complex 4 (COG4), transcript variant 1, mRNA. | 355 |
| HPR | exonic | NM_020995 | *Homo sapiens* haptoglobin-related protein (HPR), mRNA. | 356 |
| RPL38 | exonic | NM_000999 | *Homo sapiens* ribosomal protein L38 (RPL38), transcript variant 1, mRNA. | 357 |
| RPL38 | exonic | NM_001035258 | *Homo sapiens* ribosomal protein L38 (RPL38), transcript variant 2, mRNA. | 358 |
| MGC16275 | exonic | NR_026914 | *Homo sapiens* uncharacterized protein MGC16275 (MGC16275), non-coding RNA. | 359 |
| TTYH2 | exonic | NM_032646 | *Homo sapiens* tweety family member 2 (TTYH2), transcript variant 1, mRNA. | 360 |
| TTYH2 | exonic | NM_052869 | *Homo sapiens* tweety family member 2 (TTYH2), transcript variant 2, mRNA. | 361 |
| DNAI2 | exonic | NM_001172810 | *Homo sapiens* dynein, axonemal, intermediate chain 2 (DNAI2), transcript variant 2, mRNA. | 362 |
| DNAI2 | exonic | NM_023036 | *Homo sapiens* dynein, axonemal, intermediate chain 2 (DNAI2), transcript variant 1, mRNA. | 363 |
| KIF19 | exonic | NM_153209 | *Homo sapiens* kinesin family member 19 (KIF19), mRNA. | 364 |
| BTBD17 | exonic | NM_001080466 | *Homo sapiens* BTB (POZ) domain containing 17 (BTBD17), mRNA. | 365 |
| GPR142 | exonic | NM_181790 | *Homo sapiens* G protein-coupled receptor 142 (GPR142), mRNA. | 366 |
| GPRC5C | exonic | NM_022036 | *Homo sapiens* G protein-coupled receptor, family C, group 5, member C (GPRC5C), transcript variant 1, mRNA. | 367 |
| GPRC5C | exonic | NM_018653 | *Homo sapiens* G protein-coupled receptor, family C, group 5, member C (GPRC5C), transcript variant 2, mRNA. | 368 |
| CD300A | exonic | NM_001256841 | *Homo sapiens* CD300a molecule (CD300A), transcript variant 2, mRNA. | 369 |
| CD300A | exonic | NM_007261 | *Homo sapiens* CD300a molecule (CD300A), transcript variant 1, mRNA. | 370 |
| CD300LB | exonic | NM_174892 | *Homo sapiens* CD300 molecule-like family member b (CD300LB), mRNA. | 371 |
| CD300C | exonic | NM_006678 | *Homo sapiens* CD300c molecule (CD300C), mRNA. | 372 |
| CD300LD | exonic | NM_001115152 | *Homo sapiens* CD300 molecule-like family member d (CD300LD), mRNA. | 373 |
| C17orf77 | exonic | NM_152460 | *Homo sapiens* chromosome 17 open reading frame 77 (C17orf77), mRNA. | 374 |
| CD300E | exonic | NM_181449 | *Homo sapiens* CD300e molecule (CD300E), mRNA. | 375 |
| RAB37 | exonic | NM_175738 | *Homo sapiens* RAB37, member RAS oncogene family (RAB37), transcript variant 3, mRNA. | 376 |
| CD300LF | exonic | NM_139018 | *Homo sapiens* CD300 molecule-like family member f (CD300LF), mRNA. | 377 |
| RAB37 | intronic | NM_001163989 | *Homo sapiens* RAB37, member RAS oncogene family (RAB37), transcript variant 4, mRNA. | 378 |
| RAB37 | intronic | NM_001006638 | *Homo sapiens* RAB37, member RAS oncogene family (RAB37), transcript variant 2, mRNA. | 379 |
| RAB37 | intronic | NM_001163990 | *Homo sapiens* RAB37, member RAS oncogene family (RAB37), transcript variant 5, mRNA. | 380 |
| TBC1D16 | intronic | NM_019020 | *Homo sapiens* TBC1 domain family, member 16 (TBC1D16), transcript variant 1, mRNA. | 381 |
| TBC1D16 | intronic | NM_001271844 | *Homo sapiens* TBC1 domain family, member 16 (TBC1D16), transcript variant 2, mRNA. | 382 |
| TBC1D16 | intronic | NM_001271845 | *Homo sapiens* TBC1 domain family, member 16 (TBC1D16), transcript variant 3, mRNA. | 383 |
| TBC1D16 | intronic | NM_001271846 | *Homo sapiens* TBC1 domain family, member 16 (TBC1D16), transcript variant 4, mRNA. | 384 |
| RPTOR | intronic | NM_001163034 | *Homo sapiens* regulatory associated protein of MTOR, complex 1 (RPTOR), transcript variant 2, mRNA. | 385 |

TABLE 4-continued

A non-redundant list of transcript variants that correspond to the genes in Table 3

| RefSeq Gene Symbol | Exon overlap | RefSeq Accession Number | mRNA_Description | SEQ ID |
|---|---|---|---|---|
| RPTOR | intronic | NM_020761 | Homo sapiens regulatory associated protein of MTOR, complex 1 (RPTOR), transcript variant 1, mRNA. | 386 |
| PTPN2 | exonic | NM_001207013 | Homo sapiens protein tyrosine phosphatase, non-receptor type 2 (PTPN2), transcript variant 4, mRNA. | 387 |
| PTPN2 | exonic | NM_080422 | Homo sapiens protein tyrosine phosphatase, non-receptor type 2 (PTPN2), transcript variant 2, mRNA. | 388 |
| PTPN2 | exonic | NM_080423 | Homo sapiens protein tyrosine phosphatase, non-receptor type 2 (PTPN2), transcript variant 3, mRNA. | 389 |
| PTPN2 | intronic | NM_002828 | Homo sapiens protein tyrosine phosphatase, non-receptor type 2 (PTPN2), transcript variant 1, mRNA. | 390 |
| ST8SIA5 | exonic | NM_013305 | Homo sapiens ST8 alpha-N-acetyl-neuraminide alpha-2,8-sialyltransferase 5 (ST8SIA5), mRNA. | 391 |
| PIAS2 | exonic | NM_004671 | Homo sapiens protein inhibitor of activated STAT, 2 (PIAS2), transcript variant beta, mRNA. | 392 |
| PIAS2 | exonic | NM_173206 | Homo sapiens protein inhibitor of activated STAT, 2 (PIAS2), transcript variant alpha, mRNA. | 393 |
| SERPINB4 | exonic | NM_002974 | Homo sapiens serpin peptidase inhibitor, clade B (ovalbumin), member 4 (SERPINB4), mRNA. | 394 |
| FLJ26850 | intronic | NR_027257 | Homo sapiens FLJ26850 protein (FLJ26850), non-coding RNA. | 395 |
| FPR2 | exonic | NM_001005738 | Homo sapiens formyl peptide receptor 2 (FPR2), transcript variant 2, mRNA. | 396 |
| FPR2 | exonic | NM_001462 | Homo sapiens formyl peptide receptor 2 (FPR2), transcript variant 1, mRNA. | 397 |
| FPR3 | exonic | NM_002030 | Homo sapiens formyl peptide receptor 3 (FPR3), mRNA. | 398 |
| ZNF577 | exonic | NR_024181 | Homo sapiens zinc finger protein 577 (ZNF577), transcript variant 3, non-coding RNA. | 399 |
| ZNF577 | exonic | NM_001135590 | Homo sapiens zinc finger protein 577 (ZNF577), transcript variant 2, mRNA. | 400 |
| ZNF577 | exonic | NM_032679 | Homo sapiens zinc finger protein 577 (ZNF577), transcript variant 1, mRNA. | 401 |
| ZNF649 | exonic | NM_023074 | Homo sapiens zinc finger protein 649 (ZNF649), mRNA. | 402 |
| ZNF613 | exonic | NM_001031721 | Homo sapiens zinc finger protein 613 (ZNF613), transcript variant 1, mRNA. | 403 |
| ZNF613 | exonic | NM_024840 | Homo sapiens zinc finger protein 613 (ZNF613), transcript variant 2, mRNA. | 404 |
| ZNF350 | exonic | NM_021632 | Homo sapiens zinc finger protein 350 (ZNF350), mRNA. | 405 |
| ZNF615 | exonic | NM_001199324 | Homo sapiens zinc finger protein 615 (ZNF615), transcript variant 1, mRNA. | 406 |
| ZNF615 | exonic | NM_198480 | Homo sapiens zinc finger protein 615 (ZNF615), transcript variant 2, mRNA. | 407 |
| ZNF614 | exonic | NM_025040 | Homo sapiens zinc finger protein 614 (ZNF614), mRNA. | 408 |
| ZN1F432 | exonic | NM_014650 | Homo sapiens zinc finger protein 432 (ZNF432), mRNA. | 409 |
| ZNF841 | exonic | NM_001136499 | Homo sapiens zinc finger protein 841 (ZNF841), mRNA. | 410 |
| NLRP12 | exonic | NM_001277126 | Homo sapiens NLR family, pyrin domain containing 12 (NLRP12), transcript variant 3, mRNA. | 411 |
| NLRP12 | exonic | NM_001277129 | Homo sapiens NLR family, pyrin domain containing 12 (NLRP12), transcript variant 4, mRNA. | 412 |
| NLRP12 | exonic | NM_144687 | Homo sapiens NLR family, pyrin domain containing 12 (NLRP12), transcript variant 2, mRNA. | 413 |
| VSTM1 | intronic | NM_198481 | Homo sapiens V-set and transmembrane domain containing 1 (VSTM1), mRNA. | 414 |
| SNX5 | exonic | NM_014426 | Homo sapiens sorting nexin 5 (SNX5), transcript variant 2, mRNA. | 415 |
| SNX5 | exonic | NM_152227 | Homo sapiens sorting nexin 5 (SNX5), transcript variant 1, mRNA. | 416 |
| SNORD17 | exonic | NR_003045 | Homo sapiens small nucleolar RNA, C/D box 17 (SNORD17), small nucleolar RNA. | 417 |
| MGME1 | exonic | NM_052865 | Homo sapiens mitochondrial genome maintenance exonuclease 1 (MGME1), mRNA. | 418 |
| OVOL2 | exonic | NM_021220 | Homo sapiens ovo-like 2 (Drosophila) (OVOL2), mRNA. | 419 |
| ADA | intronic | NM_000022 | Homo sapiens adenosine deaminase (ADA), mRNA. | 420 |
| NRIP1 | exonic | NM_003489 | Homo sapiens nuclear receptor interacting protein 1 (NRIP1), mRNA. | 421 |
| BACH1 | exonic | NR_027655 | Homo sapiens BTB and CNC homology 1, basic leucine zipper transcription factor 1 (BACH1), transcript variant 3, non-coding RNA. | 422 |
| BACH1 | intronic | NM_001186 | Homo sapiens BTB and CNC homology 1, basic leucine zipper transcription factor 1 (BACH1), transcript variant 2, mRNA. | 423 |
| BACH1 | intronic | NM_206866 | Homo sapiens BTB and CNC homology 1, basic leucine zipper transcription factor 1 (BACH1), transcript variant 1, mRNA. | 424 |
| TRPM2 | exonic | NM_003307 | Homo sapiens transient receptor potential cation channel, subfamily M, member 2 (TRPM2), transcript variant 1, mRNA. | 425 |
| TRPM2 | exonic | NR_038257 | Homo sapiens transient receptor potential cation channel, subfamily M, member 2 (TRPM2), transcript variant 2, non-coding RNA. | 426 |
| ADARB1 | intronic | NM_001112 | Homo sapiens adenosine deaminase, RNA-specific, B1 (ADARB1), transcript variant 1, mRNA. | 427 |
| ADARB1 | intronic | NM_001160230 | Homo sapiens adenosine deaminase, RNA-specific, B1 (ADARB1), transcript variant 7, mRNA. | 428 |
| ADARB1 | intronic | NM_015833 | Homo sapiens adenosine deaminase, RNA-specific, B1 (ADARB1), transcript variant 2, mRNA. | 429 |
| ADARB1 | intronic | NM_015834 | Homo sapiens adenosine deaminase, RNA-specific, B1 (ADARB1), transcript variant 3, mRNA. | 430 |
| ADARB1 | intronic | NR_027672 | Homo sapiens adenosine deaminase, RNA-specific, B1 (ADARB1), transcript variant 5, non-coding RNA. | 431 |
| ADARB1 | intronic | NR_027673 | Homo sapiens adenosine deaminase, RNA-specific, B1 (ADARB1), transcript variant 4, non-coding RNA. | 432 |
| ADARB1 | intronic | NR_027674 | Homo sapiens adenosine deaminase, RNA-specific, B1 (ADARB1), transcript variant 6, non-coding RNA. | 433 |
| ADARB1 | intronic | NR_073200 | Homo sapiens adenosine deaminase, RNA-specific, B1 (ADARB1), transcript variant 8, non-coding RNA. | 434 |

TABLE 4-continued

A non-redundant list of transcript variants that correspond to the genes in Table 3

| RefSeq Gene Symbol | Exon overlap | RefSeq Accession Number | mRNA_Description | SEQ ID |
|---|---|---|---|---|
| APOBEC3A | exonic | NM_001270406 | Homo sapiens apolipoprotein B mRNA editing enzyme, catalytic polypeptide-like 3A (APOBEC3A), transcript variant 3, mRNA. | 435 |
| APOBEC3A | exonic | NM_145699 | Homo sapiens apolipoprotein B mRNA editing enzyme, catalytic polypeptide-like 3A (APOBEC3A), transcript variant 1, mRNA. | 436 |
| APOBEC3A_B | intronic | NM_001193289 | Homo sapiens APOBEC3A and APOBEC3B deletion hybrid (APOBEC3A B), mRNA. | 437 |
| APOBEC3B | exonic | NM_001270411 | Homo sapiens apolipoprotein B mRNA editing enzyme, catalytic polypeptide-like 3B (APOBEC3B), transcript variant 2, mRNA. | 438 |
| APOBEC3B | exonic | NM_004900 | Homo sapiens apolipoprotein B mRNA editing enzyme, catalytic polypeptide-like 3B (APOBEC3B), transcript variant 1, mRNA. | 439 |
| MKL1 | intronic | NM_020831 | Homo sapiens megakaryoblastic leukemia (translocation) 1 (MKL1), mRNA. | 440 |
| TNFRSF13C | exonic | NM_052945 | Homo sapiens tumor necrosis factor receptor superfamily, member 13C (TNFRSF13C), mRNA. | 441 |
| CENPM | exonic | NM_001110215 | Homo sapiens centromere protein M (CENPM), transcript variant 3, mRNA. | 442 |
| CENPM | exonic | NM_001002876 | Homo sapiens centromere protein M (CENPM), transcript variant 2, mRNA. | 443 |
| CENPM | exonic | NM_024053 | Homo sapiens centromere protein M (CENPM), transcript variant 1, mRNA. | 444 |
| PPP2R3B | intronic | NM_013239 | Homo sapiens protein phosphatase 2, regulatory subunit B'', beta (PPP2R3B), mRNA. | 445 |
| VCX | exonic | NM_013452 | Homo sapiens variable charge, X-linked (VCX), mRNA. | 446 |
| PNPLA4 | exonic | NM_004650 | Homo sapiens patatin-like phospholipase domain containing 4 (PNPLA4), transcript variant 1, mRNA. | 447 |
| PNPLA4 | exonic | NM_001142389 | Homo sapiens patatin-like phospholipase domain containing 4 (PNPLA4), transcript variant 2, mRNA. | 448 |
| PNPLA4 | exonic | NM_001172672 | Homo sapiens patatin-like phospholipase domain containing 4 (PNPLA4), transcript variant 3, mRNA. | 449 |
| MIR651 | exonic | NR_030380 | Homo sapiens microRNA 651 (MIR651), microRNA. | 450 |
| JPX | intronic | NR_024582 | Homo sapiens JPX transcript, XIST activator (non-protein coding) (JPX), non-coding RNA. | 451 |
| GRIA3 | intronic | NM_000828 | Homo sapiens glutamate receptor, ionotropic, AMPA 3 (GRIA3), transcript variant 2, mRNA. | 452 |
| GRIA3 | intronic | NM_007325 | Homo sapiens glutamate receptor, ionotropic, AMPA 3 (GRIA3), transcript variant 1, mRNA. | 453 |
| GRIA3 | intronic | NM_001256743 | Homo sapiens glutamate receptor, ionotropic, AMPA 3 (GRIA3), transcript variant 3, mRNA. | 454 |
| HMGB3 | exonic | NM_005342 | Homo sapiens high mobility group box 3 (HMGB3), mRNA. | 455 |

For all genes listed in Table 2 (namely, those relevant to CNV-subregions of interest), Table 4 represents a non-redundant list.

TABLE 5

The set of SNVs reported in Tables 7-10, 14, or 15 that were found in the 70 PML cases in this study for which WES data were generated.

| Chromosome | Position_hg19 | REF | ALT | SEQ_ID |
|---|---|---|---|---|
| 1 | 9777599 | C | G | 1000 |
| 1 | 12172008 | T | C | 1001 |
| 1 | 24486004 | G | T | 1002 |
| 1 | 33476435 | C | A | 1003 |
| 1 | 33478900 | T | A | 1004 |
| 1 | 33487007 | C | T | 1005 |
| 1 | 36932047 | C | T | 1006 |
| 1 | 36933715 | A | G | 1007 |
| 1 | 42047208 | C | G | 1008 |
| 1 | 59248085 | G | C | 1009 |
| 1 | 59248339 | T | C | 1010 |
| 1 | 92941660 | C | T | 1011 |
| 1 | 92946625 | G | C | 1012 |
| 1 | 92946625 | G | C | 1013 |
| 1 | 150053494 | C | T | 1014 |
| 1 | 155317682 | C | T | 1015 |
| 1 | 155449630 | T | G | 1016 |
| 1 | 155450331 | C | T | 1017 |
| 1 | 182554557 | C | T | 1018 |
| 1 | 198717250 | T | G | 1019 |
| 1 | 198717272 | A | T | 1020 |
| 1 | 206945738 | C | T | 1021 |
| 1 | 207641950 | C | T | 1022 |
| 1 | 235840495 | G | T | 1023 |
| 1 | 235897907 | C | T | 1024 |
| 1 | 235909815 | A | T | 1025 |
| 2 | 24431184 | C | T | 1026 |
| 2 | 24432937 | C | T | 1027 |
| 2 | 24435599 | G | A | 1028 |
| 2 | 47205921 | C | T | 1029 |
| 2 | 47273468 | A | G | 1030 |
| 2 | 47277182 | T | C | 1031 |
| 2 | 55910961 | T | C | 1032 |
| 2 | 71337203 | C | T | 1033 |
| 2 | 98351032 | C | G | 1034 |
| 2 | 98351066 | C | T | 1035 |
| 2 | 98351081 | C | T | 1036 |
| 2 | 113589000 | C | T | 1037 |
| 2 | 163124051 | C | T | 1038 |
| 2 | 163133194 | T | C | 1039 |
| 2 | 163134203 | G | T | 1040 |
| 2 | 163136505 | C | G | 1041 |
| 2 | 163139025 | C | T | 1042 |
| 2 | 163139085 | A | T | 1043 |
| 2 | 163144899 | G | A | 1044 |
| 2 | 163174327 | C | A | 1045 |
| 2 | 163174328 | T | G | 1046 |
| 2 | 219942026 | T | A | 1047 |
| 2 | 220023045 | C | T | 1048 |
| 2 | 230231632 | C | T | 1049 |
| 2 | 230450646 | T | A | 1050 |
| 3 | 38181899 | G | T | 1051 |
| 3 | 39323163 | A | C | 1052 |
| 3 | 53213691 | G | C | 1053 |
| 3 | 53221390 | T | C | 1054 |
| 3 | 121415370 | T | C | 1055 |
| 3 | 128204761 | C | T | 1056 |
| 3 | 128205808 | C | T | 1057 |
| 3 | 142272098 | A | G | 1058 |
| 3 | 142274880 | G | C | 1059 |
| 3 | 142281353 | C | G | 1060 |
| 3 | 142286928 | C | T | 1061 |

TABLE 5-continued

The set of SNVs reported in Tables 7-10, 14, or 15 that were found in the 70 PML cases in this study for which WES data were generated.

| Chromosome | Position_hg19 | REF | ALT | SEQ_ID |
|---|---|---|---|---|
| 3 | 196199032 | A | T | 1062 |
| 3 | 196199204 | G | T | 1063 |
| 3 | 196210704 | G | A | 1064 |
| 3 | 196210764 | T | C | 1065 |
| 3 | 196214320 | C | T | 1066 |
| 4 | 27019452 | C | T | 1067 |
| 4 | 27024170 | A | G | 1068 |
| 4 | 103522068 | A | G | 1069 |
| 4 | 103522150 | G | A | 1070 |
| 4 | 103528328 | C | T | 1071 |
| 4 | 151199080 | G | A | 1072 |
| 4 | 151520216 | G | A | 1073 |
| 4 | 187003729 | C | G | 1074 |
| 4 | 187004074 | C | T | 1075 |
| 4 | 187005854 | A | C | 1076 |
| 5 | 67591018 | A | C | 1077 |
| 5 | 77311370 | C | T | 1078 |
| 5 | 77311370 | C | T | 1079 |
| 5 | 77334964 | T | C | 1080 |
| 5 | 77334964 | T | C | 1081 |
| 5 | 77335015 | G | T | 1082 |
| 5 | 77335015 | G | T | 1083 |
| 5 | 77437092 | G | C | 1084 |
| 5 | 77437092 | G | C | 1085 |
| 5 | 78596018 | G | C | 1086 |
| 5 | 138856923 | C | T | 1087 |
| 5 | 156593120 | C | T | 1088 |
| 5 | 169081453 | G | C | 1089 |
| 6 | 3077139 | T | C | 1090 |
| 6 | 12121113 | C | T | 1091 |
| 6 | 12122102 | T | G | 1092 |
| 6 | 12123538 | G | T | 1093 |
| 6 | 12124215 | C | T | 1094 |
| 6 | 12125232 | C | T | 1095 |
| 6 | 12162068 | C | T | 1096 |
| 6 | 12163657 | C | T | 1097 |
| 6 | 31928306 | A | G | 1098 |
| 6 | 31935750 | G | A | 1099 |
| 6 | 31936679 | C | T | 1100 |
| 6 | 32797809 | C | T | 1101 |
| 6 | 32810794 | T | A | 1102 |
| 6 | 32811752 | C | T | 1103 |
| 6 | 51483961 | T | C | 1104 |
| 6 | 51484077 | G | C | 1105 |
| 6 | 51491885 | G | A | 1106 |
| 6 | 51497503 | C | A | 1107 |
| 6 | 51524339 | C | G | 1108 |
| 6 | 51524409 | G | T | 1109 |
| 6 | 51612746 | G | A | 1110 |
| 6 | 51712759 | T | C | 1111 |
| 6 | 51747943 | T | A | 1112 |
| 6 | 51798908 | C | T | 1113 |
| 6 | 52101833 | C | T | 1114 |
| 6 | 83884161 | C | G | 1115 |
| 6 | 143081232 | T | C | 1116 |
| 6 | 143092151 | T | C | 1117 |
| 6 | 143092673 | G | A | 1118 |
| 6 | 144508353 | G | A | 1119 |
| 6 | 144508563 | G | A | 1120 |
| 7 | 2959240 | C | T | 1121 |
| 7 | 2962933 | C | T | 1122 |
| 7 | 2983958 | T | C | 1123 |
| 8 | 39840234 | A | G | 1124 |
| 8 | 39862881 | C | T | 1125 |
| 8 | 39862893 | T | A | 1126 |
| 8 | 42176189 | G | A | 1127 |
| 8 | 48690299 | A | G | 1128 |
| 8 | 48773526 | T | C | 1129 |
| 8 | 48798507 | T | C | 1130 |
| 8 | 48826575 | C | G | 1131 |
| 8 | 61654298 | T | A | 1132 |
| 8 | 61732632 | A | G | 1133 |
| 8 | 61757805 | C | T | 1134 |
| 8 | 61769428 | A | G | 1135 |
| 8 | 61777914 | C | G | 1136 |
| 8 | 61777922 | C | G | 1137 |
| 8 | 90990521 | T | C | 1138 |
| 8 | 100205255 | G | A | 1139 |
| 8 | 100791158 | G | A | 1140 |
| 8 | 100865941 | G | A | 1141 |
| 8 | 145154222 | G | A | 1142 |
| 8 | 145154222 | G | A | 1143 |
| 8 | 145154257 | C | G | 1144 |
| 8 | 145154824 | A | C | 1145 |
| 9 | 286491 | G | A | 1146 |
| 9 | 286593 | C | A | 1147 |
| 9 | 304628 | G | A | 1148 |
| 9 | 312134 | G | A | 1149 |
| 9 | 328047 | T | A | 1150 |
| 9 | 334277 | G | A | 1151 |
| 9 | 368128 | C | T | 1152 |
| 9 | 399233 | A | G | 1153 |
| 9 | 446401 | A | G | 1154 |
| 9 | 711359 | C | T | 1155 |
| 9 | 713132 | G | T | 1156 |
| 9 | 32526077 | C | T | 1157 |
| 9 | 32526077 | C | T | 1158 |
| 9 | 120466814 | A | G | 1159 |
| 9 | 120475302 | A | G | 1160 |
| 9 | 120475602 | C | T | 1161 |
| 9 | 120476568 | A | G | 1162 |
| 9 | 120476816 | C | T | 1163 |
| 10 | 1060218 | G | A | 1164 |
| 10 | 14974905 | T | C | 1165 |
| 10 | 14976727 | G | C | 1166 |
| 10 | 14977469 | C | A, T | 1167 |
| 10 | 72358167 | G | A | 1168 |
| 10 | 76602923 | G | T | 1169 |
| 10 | 76748831 | C | T | 1170 |
| 10 | 89720659 | G | T | 1171 |
| 10 | 90771767 | G | A | 1172 |
| 10 | 116045796 | G | A | 1173 |
| 11 | 4104626 | C | A | 1174 |
| 11 | 4112582 | C | T | 1175 |
| 11 | 9598696 | G | A | 1176 |
| 11 | 9608330 | G | A | 1177 |
| 11 | 36595321 | C | T | 1178 |
| 11 | 36596528 | G | C | 1179 |
| 11 | 36596863 | C | T | 1180 |
| 11 | 36597513 | G | A | 1181 |
| 11 | 36614561 | G | T | 1182 |
| 11 | 36615033 | C | T | 1183 |
| 11 | 67814983 | G | A | 1184 |
| 11 | 67818269 | G | A | 1185 |
| 11 | 76954833 | G | A | 1186 |
| 11 | 76979511 | A | G | 1187 |
| 11 | 108117787 | C | T | 1188 |
| 11 | 108119823 | T | C | 1189 |
| 11 | 108123551 | C | T | 1190 |
| 11 | 108138003 | T | C | 1191 |
| 11 | 108143456 | C | G | 1192 |
| 11 | 108175462 | G | A | 1193 |
| 11 | 108181014 | A | G | 1194 |
| 11 | 108186610 | G | A | 1195 |
| 11 | 108186631 | A | G | 1196 |
| 11 | 108198384 | C | G | 1197 |
| 11 | 108202772 | G | T | 1198 |
| 12 | 12673965 | G | A | 1199 |
| 12 | 12870798 | G | A | 1200 |
| 12 | 44166753 | A | G | 1201 |
| 12 | 44167821 | A | T | 1202 |
| 12 | 64878241 | G | A | 1203 |
| 12 | 64879775 | C | T | 1204 |
| 12 | 88900891 | C | A | 1205 |
| 12 | 93196332 | C | T | 1206 |
| 12 | 93205148 | T | G | 1207 |
| 12 | 112583447 | A | C | 1208 |
| 12 | 122064788 | G | GT | 1209 |

TABLE 5-continued

The set of SNVs reported in Tables 7-10, 14, or 15 that were found in the 70 PML cases in this study for which WES data were generated.

| Chromosome | Position_hg19 | REF | ALT | SEQ_ID |
|---|---|---|---|---|
| 12 | 133201381 | T | A | 1210 |
| 12 | 133202816 | C | T | 1211 |
| 12 | 133209020 | G | C | 1212 |
| 12 | 133220526 | T | C | 1213 |
| 12 | 133220544 | C | T | 1214 |
| 12 | 133237658 | T | G | 1215 |
| 12 | 133245026 | G | A | 1216 |
| 12 | 133252406 | C | A | 1217 |
| 12 | 133253971 | C | T | 1218 |
| 12 | 133253995 | G | A | 1219 |
| 13 | 47466549 | T | C | 1220 |
| 13 | 108861092 | G | T | 1221 |
| 13 | 108863591 | G | A | 1222 |
| 14 | 21992397 | T | C | 1223 |
| 14 | 21993359 | G | A | 1224 |
| 14 | 22004996 | G | T | 1225 |
| 14 | 24805463 | G | T | 1226 |
| 14 | 24806303 | G | A | 1227 |
| 14 | 61924007 | C | G | 1228 |
| 14 | 103369593 | G | A | 1229 |
| 15 | 41011016 | G | A | 1230 |
| 15 | 68378781 | A | C | 1231 |
| 15 | 77329479 | C | T | 1232 |
| 15 | 91306241 | G | A | 1233 |
| 15 | 91310209 | A | G | 1234 |
| 15 | 91326099 | C | T | 1235 |
| 15 | 91328219 | G | T | 1236 |
| 15 | 91328310 | A | G | 1237 |
| 15 | 91341543 | A | C | 1238 |
| 16 | 1498408 | G | A | 1239 |
| 16 | 1510535 | C | T | 1240 |
| 16 | 1524855 | C | G | 1241 |
| 16 | 7568296 | C | T | 1242 |
| 16 | 7703891 | A | G | 1243 |
| 16 | 7714909 | C | T | 1244 |
| 16 | 7759119 | G | A | 1245 |
| 16 | 7759496 | C | T | 1246 |
| 16 | 24124365 | A | G | 1247 |
| 16 | 27460020 | G | A | 1248 |
| 16 | 30133233 | T | C | 1249 |
| 16 | 30134529 | A | C | 1250 |
| 16 | 50733536 | T | C | 1251 |
| 16 | 50741791 | C | T | 1252 |
| 16 | 50741791 | C | T | 1253 |
| 16 | 50744688 | A | G | 1254 |
| 16 | 50745021 | C | T | 1255 |
| 16 | 50753867 | G | T | 1256 |
| 16 | 70503095 | A | G | 1257 |
| 16 | 81819605 | C | T | 1258 |
| 16 | 81902826 | C | T | 1259 |
| 16 | 81904539 | C | T | 1260 |
| 16 | 81939089 | T | C | 1261 |
| 16 | 81942028 | C | G | 1262 |
| 16 | 81942175 | A | G | 1263 |
| 16 | 81946278 | A | G | 1264 |
| 16 | 81960772 | C | A | 1265 |
| 17 | 7577069 | C | T | 1266 |
| 17 | 16852187 | A | G | 1267 |
| 17 | 77926526 | C | T | 1268 |
| 18 | 43445580 | C | T | 1269 |
| 18 | 43445601 | T | G | 1270 |
| 18 | 43456296 | C | T | 1271 |
| 18 | 43458306 | G | A | 1272 |
| 18 | 43460105 | C | A | 1273 |
| 18 | 43464763 | C | T | 1274 |
| 18 | 43479473 | T | C | 1275 |
| 18 | 43488030 | T | C | 1276 |
| 18 | 43496370 | G | A | 1277 |
| 18 | 43496539 | G | A | 1278 |
| 18 | 43497710 | A | G | 1279 |
| 18 | 43523240 | C | T | 1280 |
| 18 | 43529551 | C | T | 1281 |
| 18 | 43531186 | C | T | 1282 |
| 18 | 44392443 | T | C | 1283 |
| 18 | 48584504 | C | T | 1284 |
| 18 | 56401523 | C | T | 1285 |
| 18 | 60036429 | G | A | 1286 |
| 18 | 60052034 | A | C | 1287 |
| 19 | 4817657 | C | T | 1288 |
| 19 | 4817852 | G | A | 1289 |
| 19 | 7705818 | C | T | 1290 |
| 19 | 7712287 | G | C | 1291 |
| 19 | 48631258 | G | A | 1292 |
| 19 | 48639022 | T | C | 1293 |
| 20 | 3843027 | C | A | 1294 |
| 20 | 3846397 | C | T | 1295 |
| 20 | 31383307 | G | A | 1296 |
| 20 | 31384614 | G | T | 1297 |
| 20 | 62305450 | C | T | 1298 |
| 20 | 62309621 | T | C | 1299 |
| 20 | 62326964 | C | G | 1300 |
| 21 | 16338814 | T | C | 1301 |
| 21 | 16339852 | T | C | 1302 |
| 21 | 30698953 | T | G | 1303 |
| 21 | 34809232 | C | T | 1304 |
| 21 | 45786650 | C | T | 1305 |
| 21 | 45795833 | G | T | 1306 |
| 21 | 45795877 | G | T | 1307 |
| 21 | 45811411 | G | T | 1308 |
| 21 | 45811438 | C | T | 1309 |
| 21 | 45815307 | T | C | 1310 |
| 21 | 45815331 | G | A | 1311 |
| 21 | 45815343 | A | G | 1312 |
| 21 | 45815425 | C | G | 1313 |
| 21 | 45820196 | C | T | 1314 |
| 21 | 45826486 | G | A | 1315 |
| 21 | 45826616 | C | T | 1316 |
| 21 | 45838333 | C | T | 1317 |
| 21 | 45844780 | C | T | 1318 |
| 21 | 45845528 | G | A | 1319 |
| 21 | 45845661 | A | G | 1320 |
| 21 | 45845699 | G | A | 1321 |
| 21 | 45855099 | C | T | 1322 |
| 22 | 21235389 | A | G | 1323 |
| 22 | 23915583 | T | C | 1324 |
| 22 | 23915745 | G | A | 1325 |
| 22 | 23917192 | G | T | 1326 |
| 22 | 36661354 | C | T | 1327 |
| X | 24759574 | G | T | 1328 |
| X | 24759574 | G | T | 1329 |

Table 5 lists, in order of genomic coordinates, all single nucleotide variants (SNVs) that are relevant to the present study, whether as case-level solutions (Tables 7, 8) or potential solutions (Tables 9, 10), or at the level of variant burden analysis (Tables 14, 15). All genome coordinates are based on hg19.

TABLE 6

Non-redundant list of 419 genes involved in the immune system and/or linked to PML via a CNV

| RefSeq Gene Symbol | Disease Model | Gene Source | Source Annotation | Gene Number (GN) |
|---|---|---|---|---|
| ACADM | AR | Public_db | MySql | 157 |
| ACKR1 | AD | Public_db | MySql | 158 |
| ACP5 | AR | Public_db | PMID: 26052098, 27260006, 27821552 | 159 |
| ADAR | AD_AR | Public_db | PMID: 26052098, 27260006, 27821552 | 160 |
| ADARB1 | unknown | PBio | PMID: 16227093, 17376196, 19482597, 20220309, 21682836, 21809195, 22001568, 22085847, 22113393, 24586166, 24725957, 24760760, 25826567 | 2 |
| ADK | AR | PBio | PMID: 17205396, 23592612, 25654762, 25720338, 25979489, 26341819, 26642971 | 161 |
| AGBL4 | unknown | PBio | PMID: 17244818, 21074048, 23085998, 25416787, 25332286, 26502776 | 3 |
| AICDA | AD_AR | Public_db | MySql; PMID: 23765059 | 162 |
| AK2 | AR | Public_db | PMID: 19043417, 19782549, 20008220, 23765059, 24135998, 24753205, 26454313 | 163 |
| ALG12 | AR | Public_db | MySql | 164 |
| ALPL | AD_AR | PBio | PMID: 18821074, 20049532, 20977932, 21191615, 21289095, 23091474, 23454488, 23860646, 26219705, 26219711, 26219717 | 165 |
| AP3B1 | AR | Public_db | MySql; PMID: 11590544, 19782549, 24302998, 24753205, 24916509, 25980904, 27889060 | 166 |
| AP3B2 | AR | Public_db | PMID: 26377319, 27889060 | 167 |
| AP3D1 | AR | Public_db | PMID: 26744459, 27889060 | 168 |
| APOBEC3A | unknown | PBio | PMID: 16720547, 17303427, 20062055, 20615867, 22896697, 23344558, 23640892, 25262471, 25576866, 26416327, 26489798, 26678087 | 4 |
| APOBEC3B | unknown | PBio | PMID: 16720547, 17303427, 20062055, 20615867, 22896697, 23344558, 23640892, 25262471, 25576866, 26416327, 26489798, 26678087 | 6 |
| APOL1 | association | Public_db | PMID: 27042682 | 169 |
| ARHGEF7 | unknown | PBio | PMID: 11160719, 16983070, 18378701, 19861492, 25284783, 25500533 | 8 |
| ASH1L | unknown | PBio | PMID: 17923682, 17981149, 22541069, 24012418, 24244179, 25866973, 26002201, 27154821, 27229316, 27434206 | 170 |
| ASTN2 | unknown | PBio | PMID: 2223091, 8602532, 20573900, 24357807, 24381304, 25146927, 25410587, 26514622, 26586575 | 9 |
| ATL2 | unknown | PBio | PMID: 18270207, 19665976, 25773277 | 171 |
| ATM | AR | Public_db | MySql; PMID: 19903823, 20301790, 23765059, 24799566, 25692705, 27042682, 27484032, 27884168, 27895165 | 172 |
| ATR | AD_AR | Public_db | PMID: 17564965, 17151099, 19903823, 20506465, 21615334, 24799566, 25910481 | 173 |
| AUH | AR | PBio | PMID: 12434311, 12655555, 17130438, 20855850, 25280001, 25597510 | 10 |
| BACH1 | unknown | PBio | PMID: 15068237, 18555605, 22024395, 22791292, 23456643, 23562577, 24752012, 25344725, 25391381, 24752012, 26045540, 26894991 | 11 |
| BACH2 | unknown | PBio | PMID: 17262715, 17991429, 18769450, 22791292, 23728300, 24367030, 24608439, 24681888, 24694524, 25123280, 25344725, 25665584, 25686607, 26444573, 26620562, 26731475, 26894991, 26981933 | 174 |
| BCL10 | AR | Public_db | MySql | 176 |
| BDKRB2 | unknown | PBio | PMID: 7787759, 18930543, 22047990, 22095814, 24925394 | 12 |
| BLM | AR | PBio | PMID: 15137905, 15493327, 17210642, 17321898, 19109166, 19709744, 2032252, 23572515, 24606147 | 177 |
| BLNK | AR | Public_db | PMID: 23765059 | 178 |
| BLOC1S6 | AR | Public_db | MySql | 179 |
| BMPR2 | AD | PBio | PMID: 15877825, 19191909, 23733693, 24334027 | 13 |
| C11orf65 | unknown | Public_db | MySql | 181 |
| C1QA | AR | Public_db | PMID: 27821552 | 182 |
| C1QB | AR | Public_db | PMID: 27821552 | 183 |
| C1QC | AR | Public_db | PMID: 27821552 | 184 |
| C5AR1 | unknown | PBio | PMID: 1847994, 22964232, 25041699, 25174320, 25455139, 25539817, 25769922, 26059553, 26283482, 26537334 | 185 |
| CAPZB | unknown | PBio | PMID: 99354614, 19806181, 22493691, 22706086, 22710966, 22918941, 23178720, 26758871 | 186 |
| CARD11 | AD_AR | Public_db | MySql; PMID: 23765059, 25645939, 26525107 | 187 |
| CARD9 | AR | Public_db | PMID: 27222657 | 188 |
| CASP8 | AR | Public_db | PMID: 22365665, 26454313, 27873163, 27999438 | 189 |
| CCL11 | AD | Public_db | MySql | 190 |
| CCL2 | association | Public_db | MySql | 191 |
| CCL5 | association | Public_db | MySql | 192 |
| CCR2 | association | Public_db | MySql | 193 |
| CCR5 | association | Public_db | MySql | 194 |
| CD180 | unknown | PBio | PMID: 9763566, 10880523, 21918197, 21959264, 22484241, 23103284, 23483427, 24019553, 25749095, 26371254, 26384474, 26482097, 26555723, 26371254 | 195 |
| CD19 | AR | Public_db | MySql; PMID: 23765059 | 196 |
| CD209 | association | Public_db | MySql | 197 |
| CD247 | AR | Public_db | PMID: 26454313 | 198 |
| CD27 | AR | Public_db | MySql; PMID: 23765059 | 199 |
| CD27-AS1 | unknown | Public_db | MySql | 200 |
| CD300LF | unknown | PBio | PMID: 15184070, 15549731, 17202342, 18688020, 19592130, 22288587, 23072861, 23293083, 24035150 | 23 |
| CD34 | unknown | Public_db | PMID: 27042682 | 201 |
| CD3D | AR | Public_db | PMID: 23765059, 26454313 | 202 |
| CD3E | AR | Public_db | PMID: 23765059, 26454313 | 203 |
| CD3G | AR | Public_db | PMID: 23765059, 26454313 | 204 |
| CD40 | AR | Public_db | MySql; PMID: 23765059, 26453379 | 205 |

TABLE 6-continued

Non-redundant list of 419 genes involved in the immune system and/or linked to PML via a CNV

| RefSeq Gene Symbol | Disease Model | Gene Source | Source Annotation | Gene Number (GN) |
|---|---|---|---|---|
| CD55 | unknown | PBio | PMID: 12417446, 1385527, 16406700, 16503113, 17678954, 18424707, 19660813, 21143144, 22795896, 24588829, 24639397, 25156074, 25954012, 26423932 | 207 |
| CD59 | AR | Public_db | MySql | 208 |
| CD79A | AR | Public_db | PMID: 23765059 | 209 |
| CD79B | AR | Public_db | PMID: 23765059 | 210 |
| CD81 | AR | Public_db | MySql | 211 |
| CD8A | AR | Public_db | PMID: 26454313 | 212 |
| CDCA7 | AR | Public_db | PMID: 26216346 | 213 |
| CDKN1B | AD | PBio | PMID: 10799578, 10825149, 10916090, 11123298, 11123306, 15557280, 16410832, 17273559, 20854895, 21078910, 22454463, 24317118, 25213837 | 24 |
| CEBPB | unknown | Public_db | PMID: 27042682 | 214 |
| CENPM | unknown | PBio | PMID: 15183305, 16391015, 19711193, 25006165 | 25 |
| CHD7 | AD | Public_db | PMID: 18505430, 18976358, 26454313, 27484032 | 215 |
| CHEK1 | unknown | Public_db | PMID: 19903823, 27042682 | 216 |
| CIITA | AR | Public_db | PMID: 23765059, 26454313, 27484032 | 217 |
| CLCN7 | AD | | PMID: 21107136, 25992615 | 218 |
| COG4 | AR | PBio | PMID: 18086915, 18256213, 20065092, 20143049, 21421995, 23462996, 23865579, 24784932, 26125015 | 26 |
| COG6 | AR | Public_db | MySql | 219 |
| COMMD6 | unknown | PBio | PMID: 14685242, 15799966, 16573520, 20126548, 25355947, 27441653 | 27 |
| CORO1A | AR | Public_db | PMID: 23887241, 26454313 | 220 |
| CR2 | AR | Public_db | MySql | 221 |
| CRADD | AR | PBio | PMID: 11573962, 21242994, 22323537, 24958727, 26190521, 27135977 | 28 |
| CRTC3 | unknown | PBio | PMID: 15466468, 2032252, 21536665, 23033494, 23241891, 25114223, 25316186, 25351958, 26937622 | 222 |
| CSF3R | AR | Public_db | PMID: 24753537, 26324699, 27789332 | 223 |
| CTLA4 | AD | Public_db | PMID: 18219311, 25213377, 25329329 | 224 |
| CTPS1 | AR | Public_db | MySql | 225 |
| CTSC | AR | Public_db | PMID: 27222657 | 226 |
| CX3CR1 | association | Public_db | MySql | 227 |
| CXCL12 | association | Public_db | MySql | 228 |
| CXCL9 | unknown | Public_db | PMID: 27042682 | 229 |
| CXCR1 | association | Public_db | MySql | 230 |
| CXCR4 | AD | Public_db | PMID: 19782549, 19950235, 23765059, 24753205, 25645939, 28009639 | 231 |
| CXorf40A | unknown | PBio | PMID: 15541360, 24916366, 26881174 | 232 |
| CYBB | XLR | Public_db | PMID: 27222657 | 233 |
| CYP2S1 | unknown | PBio | PMID: 15681441, 23933117 | 234 |
| DCLRE1C | AR | Public_db | PMID: 26454313, 26476407, 27484032 | 235 |
| DDX1 | unknown | Public_db | PMID: 27042682 | 236 |
| DDX58 | AD | Public_db | PMID: 23592984, 25692705, 25794939, 26052098, 26748340, 26848516, 26987611, 27260006, 27821552 | 237 |
| DHX58 | association | Public_db | PMID: 25794939, 26748340, 26848516 | 238 |
| DKC1 | XLR | Public_db | MySql; PMID: 23765059 | 239 |
| DNER | unknown | PBio | PMID: 15965470, 16298139, 16997755, 17765022, 18474614, 20058045, 20367751, 22447725, 23041955, 23328254, 24248099, 24935874, 26869529 | 31 |
| DOCK2 | AR | Public_db | MySql | 241 |
| DSC1 | unknown | PBio | PMID: 16048752, 20222919, 22692770, 24460202, 24680560, 25078507, 25244249, 26043694, 26758100 | 243 |
| DUSP16 | unknown | PBio | PMID: 15284860, 21613215, 24311790, 25716993, 26381291, 27162525 | 32 |
| ECRP | unknown | PBio | PMID: 9826755, 12855582, 25271100, 26184157 | 33 |
| EDIL3 | unknown | PBio | PMID: 22601780, 23518061, 24060278, 24504014, 25385367, 26038125 | 34 |
| EEA1 | unknown | PBio | PMID: 16670179, 22591512, 24491918, 24561067, 26478006, 26909655, 27077111 | 35 |
| EGR1 | unknown | PBio | PMID: 15308739, 19050264, 19812322, 20414733, 21368226, 21622185, 22554935, 25613134, 26052046, 26980486, 11910893, 14647476, 18203138, 24627779, 25368162, 27192563 | 244 |
| EHF | unknown | PBio | PMID: 16380452, 17027647, 19801549, 20879862, 21617703, 24219556, 25217163 | 36 |
| ELANE | AD | Public_db | PMID: 20008220, 24145314, 27222657 | 245 |
| EMB | unknown | PBio | PMID: 8432389, 15917240, 18209069, 19164284, 25773908 | 37 |
| EPG5 | AR | Public_db | MySql; PMID: 21965116, 23222957, 23838600, 26917586, 26927810, 27588602 | 246 |
| ETF1 | unknown | PBio | PMID: 20418372, 25606970, 26384426, 26833392, 27387891 | 247 |
| ETV6 | AD | PBio | PMID: 19264918, 20350664, 21714648, 22438058, 25581430, 25807284, 26718572, 27365488 | 38 |
| F9 | XLR | Public_db | MySql | 248 |
| FAS | AD | Public_db | PMID: 27222657 | 249 |
| FASLG | AD | Public_db | PMID: 27222657 | 250 |
| FCGR2A | AD_AR | Public_db | MySql | 251 |
| FCGR3A | AR | Public_db | MySql | 252 |
| FCN3 | AR | Public_db | MySql | 253 |
| FEZ1 | unknown | Public_db | PMID: 27042682 | 254 |
| FHL2 | unknown | PBio | PMID: 16389449, 20592280, 22417706, 22633286, 23212909 | 39 |
| FOS | unknown | Public_db | PMID: 27042682 | 255 |
| FOXH1 | unknown | Public_db | PMID: 27042682 | 256 |
| FOXN1 | AR | Public_db | MySql | 257 |
| FOXP3 | XLR | Public_db | PMID: 26454313 | 258 |

TABLE 6-continued

Non-redundant list of 419 genes involved in the immune system and/or linked to PML via a CNV

| RefSeq Gene Symbol | Disease Model | Gene Source | Source Annotation | Gene Number (GN) |
|---|---|---|---|---|
| FPR1 | unknown | PBio | PMID: 8994115, 10229829, 10611407, 17084101, 22934745, 23230437, 25605714, 25826286, 26101324, 26701131, 27034344, 27100350, 27131862, 27154726 | 259 |
| FPR2 | unknown | PBio | PMID: 8994115, 10229829, 10611407, 17084101, 22934745, 23230437, 25605714, 25826286, 26101324, 26701131, 27034344, 27100350, 27131862, 27154726 | 41 |
| FPR3 | unknown | PBio | PMID: 8994115, 10229829, 10611407, 17084101, 22934745, 23230437, 25605714, 25826286, 26101324, 26701131, 27034344, 27100350, 27131862, 27154726 | 42 |
| FUK | unknown | PBio | PMID: 11753075, 12651883, 15774760, 19394435, 19647987, 20363321, 22134107, 22203233, 22276660, 22461019, 24239607 | 43 |
| G6PC3 | AR | Public_db | PMID: 20008220, 24145314, 25879134, 26479985 | 260 |
| GATA2 | AD | Public_db | PMID: 23765059, 23887241 | 261 |
| GDA | unknown | PBio | PMID: 10595517, 18600524, 20826431, 23838888, 24834013 | 44 |
| GDPD4 | unknown | PBio | PMID: 24373430, 24977479, 24977485, 24977489, 25528375, 25596343 | 45 |
| GFI1 | AD | Public_db | PMID: 20008220, 24145314 | 262 |
| GOLGB1 | unknown | PBio | PMID: 17475246, 21217069, 22034594, 23555793, 24046448 | 263 |
| GPATCH2 | unknown | PBio | PMID: 19432882, 25353171, 25376275 | 46 |
| GPC5 | unknown | PBio | PMID: 24130709, 24943672, 25354479, 26224662, 26349477 | 47 |
| GPRC5A | unknown | PBio | PMID: 19593893, 20959490, 22239913, 25621293, 25714996, 26165721 | 264 |
| GRAP2 | unknown | Public_db | PMID: 25452106, 25636200, 26246585 | 265 |
| GRIA3 | XLR | PBio | PMID: 10441169, 12682273, 17202328, 18590483, 25904555, 26648591 | 51 |
| GTPBP4 | unknown | PBio | PMID: 17785438, 26015807 | 52 |
| HAX1 | AR | Public_db | PMID: 20008220, 24145314 | 266 |
| HCN1 | AD | PBio | PMID: 9405696, 9630217, 9634236, 9921901, 11133998, 23042740, 23077068, 23319474, 24403084, 24747641, 24756635, 25580535, 26578877 | 53 |
| HELLS | AR | Public_db | PMID: 26216346 | 267 |
| HEXA | AR | PBio | PMID: 20301397, 21997228, 23727835, 24445368 | 54 |
| HIVEP1 | association | Public_db | MySql; PMID: 20226436, 26117544 | 268 |
| HIVEP2 | AD | Public_db | MySql; PMID: 21475200, 21936769, 23389689, 24366360, 26153216, 26483320, 27003583 | 269 |
| HIVEP3 | unknown | Public_db | MySql | 270 |
| HK2 | unknown | PBio | PMID: 2749583, 4265132, 19519254, 2496891, 23874603, 25525876, 25602755 | 55 |
| HMGB3 | unknown | PBio | PMID: 12714519, 15259015, 15358624, 16945912, 22014684, 23994280, 26553261 | 56 |
| HNRNPLL | unknown | PBio | PMID: 18669861, 18719244, 19100700, 20505149, 22073166, 23934048, 24476532, 25825742 | 271 |
| HP | unknown | PBio | PMID: 16046400, 19380867, 19795414, 26445729 | 272 |
| HPCAL1 | unknown | PBio | PMID: 12445467, 24699524, 25519916, 26659654, 26729710 | 273 |
| HPR | unknown | PBio | PMID: 16046400, 19380867, 19795414, 26445729 | 57 |
| HTR2A | association | Public_db | PMID: 19204164, 24089568, 25078361, 26056932, 27003757, 27042682 | 274 |
| ICOS | AR | Public_db | MySql; PMID: 19380800, 23765059, 27250108 | 275 |
| IDI1 | unknown | PBio | PMID: 14629038, 17202134, 19454010, 20955688, 22579571, 23585482, 25950736 | 276 |
| IDI2 | unknown | PBio | PMID: 14629038, 17202134, 19454010, 20955688, 22579571, 23585482, 25950736 | 59 |
| IDI2-AS1 | unknown | PBio | See IDI2 | 60 |
| IDO2 | unknown | PBio | PMID: 18219311, 18364004, 19487973, 19799997, 20197554, 20484729, 20693847, 21084489, 21406395, 21990421, 22754762, 24391212, 24402311, 24844751, 25477879, 25478733, 25541686, 25949913, 26308414, 27183624 | 61 |
| IFIH1 | AD | Public_db | PMID: 21156324, 24686847, 24995871, 25794939, 26052098, 26748340, 27260006, 27821552 | 277 |
| IFNAR1 | association | Public_db | PMID: 27821552 | 278 |
| IFNAR2 | AR | Public_db | PMID: 26424569, 27821552 | 279 |
| IFNG | association | Public_db | MySql | 280 |
| IFNGR1 | AD_AR | Public_db | MySql | 281 |
| IFNGR2 | AD_AR | Public_db | MySql; PMID: 15356149, 23161749 | 282 |
| IFNLR1 | unknown | PBio | PMID: 12469119, 12483210, 15166220, 22386267, 22891284, 25634147, 25904743, 25941255 | 62 |
| IGLL1 | AR | Public_db | PMID: 25502423 | 283 |
| IKBKB | AD_AR | Public_db | MySql; PMID: 17047224, 17072332, 25764117, 25930993, 26117626, 26525107 | 284 |
| IKBKG | XLD_XLR | Public_db | MySql; PMID: 17047224, 21455173, 21455181, 23765059, 25764117, 25886387, 25930993, 26117626, 26525107 | 285 |
| IKZF1 | AD | Public_db | PMID: 26454313, 26981933 | 286 |
| IL10 | AR | Public_db | PMID: 23887241 | 287 |
| IL10RA | AR | Public_db | PMID: 23887241 | 288 |
| IL10RB | AR | Public_db | PMID: 23887241 | 289 |
| IL12B | AR | Public_db | MySql | 290 |
| IL12RB1 | AR | Public_db | MySql | 291 |
| IL17F | AD | Public_db | PMID: 22284928, 23887241, 24240291, 24690400, 25890879, 27144517 | 292 |
| IL17RA | AR | Public_db | PMID: 23887241 | 293 |
| IL1B | AD | Public_db | PMID: 15327898, 20543597, 24248593, 26525107, 27730320, 27873163, 27999438 | 294 |
| IL21 | AR | Public_db | MySql | 295 |
| IL21R | AD_AR | Public_db | PMID: 23765059, 23887241 | 296 |
| IL2RA | AR | Public_db | MySql | 297 |
| IL2RG | XLR | Public_db | PMID: 23765059, 26454313, 27484032 | 298 |
| IL4R | association | Public_db | MySql | 299 |
| IL7 | unknown | PBio | PMID: 21508983, 22288682, 24507157, 24979548, 25130296, 25214510, 25411246, 25734144, 26537673, 26675348, 26908786 | 300 |
| IL7R | AR | Public_db | PMID: 26454313, 27484032 | 301 |

TABLE 6-continued

Non-redundant list of 419 genes involved in the immune system and/or linked to PML via a CNV

| RefSeq Gene Symbol | Disease Model | Gene Source | Source Annotation | Gene Number (GN) |
|---|---|---|---|---|
| IRAK4 | AD_AR | Public_db | PMID: 23766853, 25232776, 25344726, 25764117, 25886387, 25930993, 26785681, 27845762 | 302 |
| IRF3 | AD | Public_db | PMID: 23388631, 26513235, 26748340 | 303 |
| IRF7 | AR | Public_db | MySql; PMID: 26748340 | 304 |
| IRF8 | AD_AR | Public_db | PMID: 23887241 | 305 |
| IRGM | association | PBio | PMID: 14707092, 17911638, 22174682, 22722598, 23084913, 23335927 | 306 |
| ISG15 | AR | Public_db | MySql; PMID: 26052098, 27260006, 27821552 | 307 |
| ITSN2 | unknown | PBio | PMID: 11748279, 15020715, 17696400, 17696407, 22558309, 22975684, 23986746, 24097067, 24284073, 25797047, 26479042 | 309 |
| JAGN1 | AR | Public_db | PMID: 25129144 | 310 |
| JAK3 | AR | Public_db | PMID: 23765059, 26454313 | 311 |
| JMY | unknown | PBio | PMID: 19287377, 20573979, 20574148, 20888769, 21965285, 23291261, 25015719, 26223951, 26305109 | 312 |
| JPX | association | PBio | PMID: 21029862, 23791181, 23943155 | 64 |
| JUN | unknown | Public_db | PMID: 16928756, 27042682 | 313 |
| KANK1 | association | PBio | PMID: 18458160, 20164854, 21685469, 24399197, 25961457, 26656975 | 65 |
| KAT6B | AD | PBio | PMID: 17460191, 17694082, 22715153, 25920810 | 66 |
| KCTD7 | AR | PBio | PMID: 17455289, 20301601, 21710140, 22606975, 22638565, 22748208, 25060828, 27629772, 27742667 | 67 |
| KITLG | AD | Public_db | PMID: 27042682 | 314 |
| LAMTOR2 | AR | Public_db | MySql; PMID: 19782549, 20008220, 24753205 | 315 |
| LARP4B | unknown | PBio | PMID: 20573744, 23815932, 25534202, 26001795, 26501340, 26644407 | 69 |
| LCP2 | unknown | Public_db | PMID: 12874226, 18219311, 19056831, 23494777, 26246585 | 317 |
| LIG1 | AR | Public_db | MySql | 318 |
| LIG4 | AR | Public_db | MySql | 319 |
| LOC102724297 | unknown | Public_db | MySql | 320 |
| LOC400710 | unknown | PBio | ncRNA, limited gene information; see SNAR gene family (adjacent locus) | 321 |
| LRBA | AR | Public_db | MySql; PMID: 23765059, 27873163, 27192563 | 322 |
| LYST | AR | Public_db | PMID: 19302049, 19782549, 20008220, 24753205, 24916509, 26454313, 27881733 | 323 |
| MAGEA9 | unknown | PBio | PMID: 15222021, 15900605, 21093980, 21791470, 25315972, 25445503, 25755744 | 324 |
| MAGEA9B | unknown | PBio | PMID: 15222021, 15900605, 21093980, 21791470, 25315972, 25445503, 25755744 | 325 |
| MAGT1 | XLR | Public_db | PMID: 23887241, 27873163, 25504528 | 326 |
| MALL | unknown | PBio | PMID: 11294831, 19064697, 24101378, 24746959, 26109641, 26622604, 26641089, 26772392, 27583248, 27846891 | 72 |
| MALT1 | AR | Public_db | MySql; PMID: 26525107 | 327 |
| MAP3K2 | unknown | PBio | PMID: 11032806, 11278622, 12138187, 14734742, 16430878, 21333552, 2437584, 24847879, 25012295, 26056008 | 328 |
| MAPK1 | unknown | Public_db | PMID: 14671106, 27042682 | 329 |
| MAPK3 | unknown | Public_db | PMID: 14671106, 27042682 | 330 |
| MAPK9 | unknown | PBio | PMID: 15023353, 23685277, 24673683, 25762148, 26141991 | 73 |
| MAVS | association | Public_db | PMID: 23582325, 26513235, 26987611 | 331 |
| MCEE | AR | PBio | PMID: 17846917, 20301409, 21365456, 23726524, 24532006, 25763508, 26725562 | 74 |
| MECP2 | XLD_XLR | Public_db | PMID: 27042682 | 332 |
| MEX3C | unknown | PBio | PMID: 18779327, 22357625, 22658931, 22863774, 22927639, 23140835, 23446422, 23999169, 24706898, 24741071 | 333 |
| MGAT5 | unknown | PBio | PMID: 12417426, 15585841, 18292539, 20089585, 20117844, 25768892, 26972830 | 75 |
| MKL1 | AR | PBio | PMID: 12944485, 22626970, 26098208, 26098211, 26221020, 26241940, 26405212, 26242645, 26554816 | 89 |
| MRE11A | AR | Public_db | PMID: 23388631, 23765059 | 334 |
| MS4A1 | AR | Public_db | MySql; PMID: 23765059 | 335 |
| MSN | unknown | PBio | PMID: 9070665, 10444190, 11777944, 12445265, 14758359, 16368573, 17110458, 18025306, 18725395, 21486194, 23526587, 23613524, 24250818, 24358210, 24760896, 25746045 | 336 |
| MTHFD1 | AR | Both | PMID: 26454313 | 337 |
| MYD88 | AD_AR | Public_db | PMID: 23766853, 25344726, 25764117, 25886387, 25930993, 26371186, 27435819 | 338 |
| NBN | AD_AR | Public_db | MySql; PMID: 23765059 | 339 |
| NFIC | unknown | PBio | PMID: 11559801, 15327898, 16928756, 18474555, 19058033, 22205750 | 340 |
| NFIL3 | unknown | PBio | PMID: 20080759, 20697558, 22075207, 23453631, 24070385, 24277151, 24280221, 24442434, 24909887, 25092873, 25113970, 25310240, 25611557, 25614966, 25801035, 25993115, 26153760, 26379372, 26806130, 26880402 | 92 |
| NFKB1 | AD | Public_db | PMID: 22081022, 26279205 | 341 |
| NFKB2 | AD | Public_db | MySql; PMID: 25764117 | 342 |
| NFKBIA | AD | Public_db | MySql; PMID: 23765059, 25645939, 25764117 | 343 |
| NHEJ1 | AR | Public_db | MySql; PMID: 23765059 | 344 |
| NLRP12 | AD | PBio | PMID: 17947705, 18230725, 20861596, 21978668, 23318142, 23970817, 24282415, 24347638, 25249449, 25620184, 25902475, 26083549, 26343520, 26386126, 26521018 | 93 |
| NLRP3 | AD | Public_db | PMID: 16724804, 19302049, 23592984, 26848516, 27999438 | 345 |
| NOD2 | AD | Public_db | PMID: 16724804, 19302049, 23584365, 26509073, 26848516, 26953272 | 346 |
| NQO2 | unknown | PBio | PMID: 16253205, 16905546, 17720881, 18552348, 26046590 | 94 |
| NRIP1 | unknown | PBio | PMID: 18267075, 23241901, 24969109, 25066731, 25697398, 25879677, 26937622 | 95 |
| ORAI1 | AD_AR | Public_db | PMID: 19075015, 20004786, 21790973, 22144678, 23765059, 26454313, 26469693 | 347 |
| OSTM1 | AR | Public_db | PMID: 16813530, 19507210, 21107136, 23685543 | 348 |
| OVOL2 | AD | PBio | PMID: 16423343, 25267199, 26619963, 26749309 | 98 |
| PDE3B | unknown | PBio | PMID: 17220874, 23276671, 25816736, 26203135, 26297880, 26374610 | 99 |

TABLE 6-continued

Non-redundant list of 419 genes involved in the immune system and/or linked to PML via a CNV

| RefSeq Gene Symbol | Disease Model | Gene Source | Source Annotation | Gene Number (GN) |
|---|---|---|---|---|
| PDGFRA | association | PBio | PMID: 12660384, 18634583, 18701889, 19246520, 19839938, 20032375, 20569695, 21123584, 21975205, 22449623, 22523564, 23771592, 25319708, 25940087 | 100 |
| PDSS2 | AR | PBio | PMID: 17186472, 18437205, 18784258, 21567994, 21871565, 21983691, 23150520 | 101 |
| PGM3 | AR | Public_db | MySql; PMID: 25502423 | 349 |
| PHACTR4 | unknown | PBio | PMID: 15107502, 17609112, 22215804, 22215812, 22766235, 23076051, 23203801, 23319639, 24748504, 26850007 | 102 |
| PIAS1 | unknown | PBio | PMID: 10805787, 10858346, 14644436, 15297606, 15311277, 17065208, 17540171, 18056374, 19857525, 20966256, 22969086, 22982248, 23299081, 24036127 | 103 |
| PIAS2 | unknown | PBio | PMID: 9724754, 11117529, 12077349, 12764129, 14514699, 15582666, 16460827, 19549844, 21156324, 21779164, 22210188, 22982248, 24344134, 25484205, 25434787, 26223632 | 350 |
| PIK3CD | AD | Both | MySql; PMID: 24165795, 25133419, 25645939, 26437962, 26453379, 27379089, 27426521, 27873163, 14647476, 27192563 | 104 |
| PIK3R1 | AD_AR | Public_db | PMID: 23765059, 23887241, 25645939, 26246585, 26453379, 27076228, 14647476, 27192563 | 351 |
| PKHD1 | AR | PBio | PMID: 8178487, 15052665, 17450421, 23423256, 24964219, 24984783, 25186187, 26502924 | 105 |
| PLCG2 | AD | Public_db | PMID: 19056831, 23000145, 23765059, 23887241, 25452106, 25636200, 25645939, 26246585, 27192563 | 352 |
| PMS2 | AR | Public_db | MySql; PMID: 23765059 | 353 |
| PNPLA4 | unknown | PBio | PMID: 22289388, 23741432, 26017929, 26164793, 26713677, 26741492, 26968210 | 107 |
| PNPT1 | AR | PBio | PMID: 14563561, 15492272, 16410805, 16687933, 17983748, 19580345, 23084291, 23221631, 24143183, 24729470, 25457163 | 108 |
| POLA1 | XLR | Public_db | PMID: 27019227, 27821552 | 355 |
| POLE | AR | Public_db | MySql; PMID: 23230001, 23765059, 25948378 | 356 |
| PPP2R3B | unknown | PBio | PMID: 9847399, 10629059, 11593413, 18353419, 20485545, 26683421 | 109 |
| PRF1 | AD_AR | Public_db | PMID: 17311987, 19302049, 21881043, 24916509, 25776844, 26454313, 26864340, 27391055 | 357 |
| PRKCB | unknown | PBio | PMID: 10872892, 15488737, 16935002, 17060474, 17395590, 19907441, 21997316, 22994860, 23959874, 24550541, 25548371, 24550541, 25808972, 26509731, 26510741 | 110 |
| PRKCD | AR | Public_db | MySql; PMID: 23319571, 27250108, 27873163 | 358 |
| PRKCH | unknown | PBio | PMID: 15327898, 16571806, 18353419, 22114277, 22155788, 22892130, 23868949, 24705298, 25617472, 25889880 | 111 |
| PRKDC | AD_AR | Public_db | PMID: 12847277, 23722905, 26454313, 26838362, 27980111 | 359 |
| PROC | AD_AR | PBio | PMID: 2437584, 18751723, 21114396, 22447930, 24162617 | 360 |
| PSMB8 | AR | Public_db | PMID: 26052098, 27260006, 27821552 | 361 |
| PSTP1P1 | AD | PBio | PMID: 9488710, 11313252, 12530983, 14707117, 16724804, 19290936, 19302049, 24421327, 25040622, 25645939, 25814341, 26386126, 26919742 | 112 |
| PTEN | AD | Public_db | PMID: 26246517, 27426521 | 362 |
| PTPN2 | unknown | PBio | PMID: 11909529, 12359225, 11847239, 19290937, 19825843, 19930043, 20473312, 20564182, 20848498, 21220691, 22080861, 22080863, 22671594, 24442435, 24445916, 24608439, 24849651, 24997008, 25548153, 25581833 | 113 |
| PTPRC | AR | Public_db | PMID: 26454313 | 363 |
| PTPRN2 | unknown | PBio | PMID: 9714834, 10426369, 11086001, 11086294, 11793386, 15114673, 19361477, 23595248, 24988487, 26141787, 26609326 | 114 |
| PURA | AD | Public_db | PMID: 27042682 | 364 |
| RAB27A | AR | Public_db | PMID: 19302049, 20008220, 21881043, 23810987 | 365 |
| RAB37 | unknown | PBio | PMID: 21805469, 22899725, 26931073, 27798165 | 115 |
| RAB7A | AD | Public_db | PMID: 25992615, 27588602 | 366 |
| RABGEF1 | unknown | PBio | PMID: 12505986, 15143060, 15235600, 16499958, 16533754, 16605131, 17341663, 20829437, 22846990, 23552075, 24569883, 24957337, 25427001, 26567216, 26588713, 27791468 | 367 |
| RAC2 | AD | Public_db | MySql | 368 |
| RAD51 | AD | Public_db | PMID: 25310191, 27042682 | 369 |
| RAG2 | AR | Public_db | PMID: 23765059, 23887241, 26454313, 27808398 | 371 |
| RBCK1 | AR | Public_db | MySql; PMID: 21455173, 21455181, 23765059, 23969028, 24958845, 25764117, 25930993, 26008899, 26525107, 27810922 | 372 |
| RBFOX1 | unknown | PBio | PMID: 23350840, 24039908, 25043849, 26500751, 26687839 | 116 |
| RCC1 | unknown | PBio | PMID: 1961752, 18442486, 19060893, 20347844, 23536659, 25452301, 26864624 | 117 |
| RFX5 | AR | Public_db | PMID: 23765059, 26454313 | 373 |
| RFXANK | AR | Public_db | PMID: 23765059, 26454313 | 374 |
| RFXAP | AR | Public_db | PMID: 23765059, 26454313 | 375 |
| RGCC | unknown | PBio | PMID: 19158077, 19652095, 23000427, 24973210, 25770350, 26134570 | 118 |
| RHOQ | unknown | PBio | PMID: 10490598, 12456725, 14734537, 16246732, 17016434, 19258391, 22916134, 24223996, 24297911, 24663214, 24667291 | 119 |
| RIPK1 | association | Public_db | PMID: 21455173, 27999438 | 376 |
| RIPK3 | association | Public_db | PMID: 22365665, 27999438 | 377 |
| RMRP | AR | Public_db | MySql; PMID 19782549, 20008220, 24753205 | 378 |
| RNASE3 | unknown | PBio | PMID: 19515815, 26184157 | 120 |
| RNASEH2A | AR | Public_db | PMID: 26052098, 27260006, 27821552 | 379 |
| RNASEH2B | AR | Public_db | PMID: 26052098, 27260006, 27821552 | 380 |
| RNASEH2C | AR | Public_db | PMID: 26052098, 27260006, 27821552 | 381 |
| RNASEL | association | Public_db | PMID: 24995003, 27525044 | 382 |
| RNF168 | AR | Public_db | MySql; PMID: 23765059 | 383 |

TABLE 6-continued

Non-redundant list of 419 genes involved in the immune system and/or linked to PML via a CNV

| RefSeq Gene Symbol | Disease Model | Gene Source | Source Annotation | Gene Number (GN) |
|---|---|---|---|---|
| RNF31 | AR | Public_db | PMID: 21455173, 21455181, 23969028, 24958845, 26008899, 26525107, 27810922 | 384 |
| RNU4ATAC | AR | Public_db | PMID: 27222657 | 385 |
| RPTOR | unknown | PBio | PMID: 16959881, 22810227, 23349361, 23812589, 24287405, 24303063, 24671993, 24948799, 26678875 | 123 |
| RTEL1 | AR | Public_db | MySql; PMID: 23329068, 23765059, 24009516, 25607374, 26810774 | 386 |
| RTEL1-TNFRSF6B | unknown | Public_db | MySql; PMID: 23329068, 23765059, 25607374 | 387 |
| SALL2 | AR | PBio | PMID: 11734654, 15082782, 18818376, 19076363, 19131967, 21362508, 21689070, 21791360, 22074632, 22978642, 23029531, 24040083, 24412933, 24903482, 25360671, 25580951, 25608837, 26181197 | 388 |
| SAMHD1 | AR | Public_db | PMID: 26052098, 27260006, 27821552 | 389 |
| SBDS | AR | Public_db | PMID: 20008220, 21062271, 27418648, 27658964 | 390 |
| SERPINB4 | unknown | PBio | PMID: 15203215, 19070595, 21857942, 22451727, 22808225, 24560885, 24635038, 25111616, 25133778, 25213322 | 124 |
| SERPINB6 | AR | PBio | PMID: 14670919, 20451170, 24172014, 24359430 | 125 |
| SH2D1A | XLR | Public_db | MySql; PMID: 19302049, 23765059, 25744037 | 391 |
| SHARPIN | unknown | Public_db | PMID: 21455181, 22901541, 23969028, 24958845, 26525107, 26848516, 27810922, 27892465 | 392 |
| SKIV2L | AR | Public_db | PMID: 27260006, 27821552 | 393 |
| SLC17A5 | AR | PBio | PMID: 14742248, 15006695, 15172005, 16575519, 18399798, 20007460, 20951965, 21628664, 22778404, 23760462, 23889254, 25494612, 25855729, 25879139 | 127 |
| SLC37A4 | AR | Public_db | PMID: 20008220, 20301489 | 394 |
| SLC3A2 | unknown | PBio | PMID: 22588539, 22624878, 23297381, 24491544, 25002078, 26172215, 26439699, 26444422 | 126 |
| SLC46A1 | AR | Public_db | PMID: 26454313 | 395 |
| SLC8A1 | unknown | PBio | PMID: 23224883, 23224887, 23224890, 23224891, 26045217, 26418956, 26775040, 26859825, 26924806 | 396 |
| SMAD2 | unknown | Public_db | PMID: 27042682 | 397 |
| SMAD3 | AD | Public_db | PMID: 27042682 | 398 |
| SMAD4 | AD | Both | PMID: 12202226, 14987161, 16800882, 19420158, 25637015, 25705527, 26454313, 27042682 | 399 |
| SNAP29 | AR | Public_db | PMID: 15968592, 21073448, 27588602 | 400 |
| SNAR-A1 | unknown | PBio | PMID: 25327818, 25447144 | 401 |
| SNAR-A10 | unknown | PBio | PMID: 25327818, 25447144 | 402 |
| SNAR-A11 | unknown | PBio | PMID: 25327818, 25447144 | 403 |
| SNAR-A12 | unknown | PBio | PMID: 25327818, 25447144 | 404 |
| SNAR-A13 | unknown | PBio | PMID: 25327818, 25447144 | 405 |
| SNAR-A14 | unknown | PBio | PMID: 25327818, 25447144 | 406 |
| SNAR-A2 | unknown | PBio | PMID: 25327818, 25447144 | 407 |
| SNAR-A3 | unknown | PBio | PMID: 25327818, 25447144 | 408 |
| SNAR-A4 | unknown | PBio | PMID: 25327818, 25447144 | 409 |
| SNAR-A5 | unknown | PBio | PMID: 25327818, 25447144 | 410 |
| SNAR-A6 | unknown | PBio | PMID: 25327818, 25447144 | 411 |
| SNAR-A7 | unknown | PBio | PMID: 25327818, 25447144 | 412 |
| SNAR-A8 | unknown | PBio | PMID: 25327818, 25447144 | 413 |
| SNAR-A9 | unknown | PBio | PMID: 25327818, 25447144 | 414 |
| SNAR-B1 | unknown | PBio | PMID: 25327818, 25447144 | 415 |
| SNAR-B2 | unknown | PBio | PMID: 25327818, 25447144 | 416 |
| SNAR-C1 | unknown | PBio | PMID: 25327818, 25447144 | 417 |
| SNAR-C2 | unknown | PBio | PMID: 25327818, 25447144 | 418 |
| SNAR-C3 | unknown | PBio | PMID: 25327818, 25447144 | 419 |
| SNAR-C4 | unknown | PBio | PMID: 25327818, 25447144 | 420 |
| SNAR-C5 | unknown | PBio | PMID: 25327818, 25447144 | 421 |
| SNAR-D | unknown | PBio | PMID: 25327818, 25447144 | 422 |
| SNAR-E | unknown | PBio | PMID: 25327818, 25447144 | 423 |
| SNAR-F | unknown | PBio | PMID: 25327818, 25447144 | 424 |
| SNAR-G1 | unknown | PBio | PMID: 25327818, 25447144 | 425 |
| SNAR-G2 | unknown | PBio | PMID: 25327818, 25447144 | 426 |
| SNAR-H | unknown | PBio | PMID: 25327818, 25447144 | 427 |
| SNAR-I | unknown | PBio | PMID: 25327818, 25447144 | 428 |
| SNCA | AD | PBio | PMID: 12406186, 14648159, 16953112, 19115126, 19432400, 19652146, 22209147, 23378275, 23771222, 24586351, 24593806, 25092570, 25450953, 25522431, 25635231, 25866630, 26087293, 26272943, 26342897, 26646749 | 429 |
| SNHG3 | unknown | PBio | PMID: 22308462, 22843687, 26373735 | 128 |
| SNX10 | AR | Public_db | PMID: 22499339, 23123320 | 430 |
| SNX5 | unknown | PBio | PMID: 10600472, 11128621, 14499622, 15133132, 15561769, 16857196, 18596235, 21725319, 21903422, 21943487, 23213485, 24820351, 26220253 | 130 |
| SOCS2 | unknown | PBio | PMID: 19279332, 21403007, 22693634, 22795647, 23455506, 24400794, 26216515, 26709655, 26765997, 27071013, 27158906, 27330188, 27338192 | 131 |
| SP110 | AR | Public_db | MySql | 431 |
| SP140 | unknown | Public_db | MySql | 432 |
| SPINK5 | AR | Public_db | PMID: 19683336, 26865388, 27222657, 27905021 | 433 |
| SQSTM1 | AD_AR | Public_db | PMID: 19229298, 27715390 | 434 |
| SRSF1 | unknown | Public_db | PMID: 27042682 | 435 |

TABLE 6-continued

Non-redundant list of 419 genes involved in the immune system and/or linked to PML via a CNV

| RefSeq Gene Symbol | Disease Model | Gene Source | Source Annotation | Gene Number (GN) |
|---|---|---|---|---|
| ST8SIA5 | unknown | PBio | PMID: 11089916, 15829700 | 133 |
| STAT2 | AR | Public_db | PMID: 23391734, 26122121, 27821552 | 437 |
| STAT5B | AR | Public_db | MySql | 439 |
| STIM1 | AD_AR | Public_db | PMID: 20004786, 21790973, 23765059, 26454313, 26469693 | 440 |
| STIM2 | unknown | PBio | PMID: 20004786, 21790973, 21880262, 22129055, 22477146, 22914293, 25157823, 26109647, 26469693 | 134 |
| STK4 | AR | Public_db | PMID: 19782549, 23765059, 23887241, 24753205, 26029204 | 441 |
| STX11 | AR | Public_db | PMID: 19302049, 21881043, 24916509, 26454313 | 442 |
| STXBP2 | AD_AR | Public_db | PMID: 21881043, 24916509, 25564401, 26454313 | 443 |
| SYNCRIP | unknown | PBio | PMID: 10734137, 18045242, 19331829, 19232660, 22493061, 22935615, 23679954, 23700384, 24844655, 25100733, 26641092 | 444 |
| T | AD_AR | PBio | PMID: 11897834, 17438107, 23064415, 23662285, 24253444, 24556085, 25186612, 26210634, 26919728 | 445 |
| TAP1 | AR | Public_db | PMID: 26454313 | 446 |
| TAP2 | AR | Public_db | PMID: 26454313 | 447 |
| TAPBP | unknown | Public_db | PMID: 26454313 | 448 |
| TAZ | XLR | Public_db | PMID: 20008220 | 449 |
| TBC1D16 | unknown | PBio | PMID: 16923123, 19077034, 21250943, 23019362, 23485563, 23812537, 24513270, 26030178 | 136 |
| TBK1 | AD | Public_db | PMID: 23887241, 25930993, 26513235, 28049150 | 450 |
| TBX1 | AD | Public_db | PMID: 26454313 | 451 |
| TCIRG1 | AD_AR | Public_db | MySql; PMID 19507210, 19782549, 24753205, 27233968 | 452 |
| TICAM1 | AD_AR | Public_db | PMID: 22105173, 23887241, 25764117, 25930993, 26513235, 28049150 | 453 |
| TLR3 | AD | Public_db | PMID: 23592984, 23887241, 25930993, 26513235, 27810922, 27873163, 27881733 | 454 |
| TLR4 | association | Both | PMID: 12124407, 17893200, 18946062, 19843948, 20521908, 21677132, 22474023, 22962435, 23055527, 23890253, 25365308, 25454804, 25930993, 26189680, 26453379, 27881733 | 455 |
| TMEM173 | AD | Public_db | PMID: 23388631, 25645939, 25692705, 26052098, 27260006, 27801882, 27821552 | 456 |
| TNF | association | Public_db | MySql; PMID: 27042682 | 457 |
| TNFAIP3 | AD | Public_db | PMID: 23969028, 26642243, 27845235 | 458 |
| TNFRSF10A | unknown | PBio | PMID: 10889508, 11602752, 11704827, 11777550, 11844843, 12390973, 12694389, 14975593, 15007095, 16394652, 16554480, 16711142, 19690337, 20921531 | 138 |
| TNFRSF11A | AD_AR | Public_db | PMID: 17088646, 17360404, 18281276, 18606301, 19380800, 19507210, 25102334, 25393853, 27003757, 27016605 | 459 |
| TNFRSF11B | AR | Public_db | PMID: 19507210, 25102334, 25393853, 27003757 | 460 |
| TNFRSF13B | AD_AR | Public_db | MySql; PMID: 17467261, 17492055, 18978466, 18981294, 19629655, 20889194, 21458042, 22697072, 23765059, 25454804, 25930993, 26727773, 27123465 | 461 |
| TNFRSF13C | AR | Both | MySql; PMID: 16769579, 17785824, 18784835, 18813230, 19136305, 19406831, 20547827, 20547828, 20817206, 21897850, 22028296, 22030463, 23684423, 24101550, 24953530, 25454804, 25637018, 25724205, 26419927, 26453379, 26600308, 26888554 | 139 |
| TNFRSF18 | unknown | PBio | PMID: 16439533, 19162554, 19363449, 22017440, 23432692, 24484736, 25738498 | 140 |
| TNFRSF4 | AR | Public_db | MySql | 462 |
| TNFRSF8 | unknown | PBio | PMID: 10921351, 15990453, 16472805, 18852356, 20141444, 20378007, 21933041, 23115213, 23307550, 23654079, 24809535, 25999451 | 463 |
| TNFSF11 | AR | Public_db | PMID: 17088646, 17360404, 18281276, 18606301, 19507210, 25992615, 27003757 | 464 |
| TNFSF12 | association | Public_db | PMID: 23765059 | 465 |
| TP53 | AD_AR | Public_db | MySql; PMID: 11048806, 11079782, 12009037, 19282432, 26870672 | 466 |
| TRAF3 | AD | Public_db | PMID: 20832341, 23887241, 25764117, 25930993, 28049150 | 467 |
| TRAF6 | unknown | Public_db | PMID: 10215628, 10421844, 25200954, 27808398, 27999438 | 468 |
| TRAFD1 | unknown | PBio | PMID: 16221674, 18849341, 23913580, 25909814, 25992615, 26283173 | 141 |
| TREX1 | AD_AR | Public_db | PMID: 26052098, 27260006, 27821552 | 469 |
| TRNT1 | AR | Public_db | MySql; PMID: 25193871 | 470 |
| TRPM2 | unknown | PBio | PMID: 9806837, 16585058, 18569867, 19411837, 20107186, 25012489, 25049394, 25088676, 26300888, 26558786, 26679996, 26942016, 26969190, 27405665, 27872485 | 142 |
| TTC7A | AR | Public_db | MySql; PMID: 27873163 | 471 |
| UBE2N | unknown | PBio | PMID: 21512573, 23159053, 24906799, 25343992, 25503582, 25548215, 26085214, 26150489, 26212332, 26518362 | 145 |
| UNC119 | AD | Public_db | MySql | 472 |
| UNC13D | AR | Public_db | PMID: 19302049, 21881043, 24916509, 25564401, 25980904, 26454313 | 473 |
| UNC93B1 | association | Public_db | PMID: 23810987, 23887241, 25930993, 27873163 | 474 |
| UNG | AR | Public_db | MySql; PMID: 23765059 | 475 |
| USP18 | AR | Public_db | PMID: 27016605, 27325888, 27801882, 27821552 | 476 |
| USP20 | unknown | Public_db | PMID: 27801882 | 477 |
| VAPA | unknown | PBio | PMID: 9657962, 10523508, 10655491, 11511104, 12931207, 18713837, 23536298, 24076421, 24569996, 25015719 | 478 |
| VCP | AD | Public_db | PMID: 24248593, 27730320 | 479 |
| VDAC1 | unknown | PBio | PMID: 10620603, 25874870, 26322231, 26542804, 26616244, 26758954, 26878172 | 480 |
| VPS13B | AR | Public_db | PMID: 20008220, 20301655 | 481 |
| VPS45 | AR | Public_db | MySql; PMID: 23738510, 24145314, 24164830, 26358756 | 482 |
| VSTM1 | unknown | PBio | PMID: 22960280, 23436183, 24205237, 25351446, 25887911, 26760041 | 147 |
| VWA2 | unknown | PBio | PMID: 14506275, 18434322, 21385852, 23443151, 23960233, 26121272 | 148 |
| WEE1 | unknown | Public_db | PMID: 19903823, 25088202, 26598692, 26881506, 27042682 | 484 |
| WIPF1 | AR | Public_db | PMID: 23765059, 26029204, 26453379 | 485 |

TABLE 6-continued

Non-redundant list of 419 genes involved in the immune system and/or linked to PML via a CNV

| RefSeq Gene Symbol | Disease Model | Gene Source | Source Annotation | Gene Number (GN) |
|---|---|---|---|---|
| XIAP | XLD_XLR | Public_db | MySql; PMID: 22365665, 25744037, 26953272 | 486 |
| YBX1 | unknown | Public_db | PMID: 27042682 | 487 |
| YWHAZ | unknown | Both | PMID: 25894827, 27042682 | 488 |
| ZAP70 | AD_AR | Public_db | PMID: 18219311, 23494777, 23765059, 24164480, 26454313 | 489 |
| ZBTB24 | AR | Public_db | MySqL; PMID: 23486536, 23765059, 26851945, 27098601 | 490 |

Table 6 is a comprehensive list of 419 exemplary genes (referred to herein as 'PML-419 genes' or 'PML-419 gene list') interrogated in the present study, along with information related to the inheritance pattern assumed for analysis and the reason for inclusion of the gene. Gene sources for Table 6 (column heading 'Gene_Source'): 1) nominated on the basis of being linked to immune deficiency, as curated from public databases (indicated by 'Public_db') such as PubMed and ClinVar, 2) PBio CNV-identified genes ('PBio', see Table 6 column heading 'Gene_Source') from a genome-wide array CGH gene discovery study of 71 PML cases, or 3) curated from public databases and identified in PBio's PML gene discovery study (indicated by 'Both'). A genetic predisposition to PML on the basis of the host's genome was proposed; that is, germline genetic variant(s) in the PML patient's genome, rather than genetic variants that are present in the JC virus, are the cause of the patient's PML (Hatchwell, Front Immunol., 6:216 (2015). Details on the source of the genes in the PML-419 gene list can be found in the following immunodeficiency and immune-related gene sources: Durandy et al., Nat Rev Immunol., 13(7):519-33 (2013); Milner et al., Nat Rev Immunol., 13(9):635-48 (2013); Paciolla et al., Genes Immun., 16(4): 239-46 (2015); Hatchwell, Front Immunol., 6:216 (2015); Thijssen et al., Nat Commun., 6:7870 (2015); Chinn et al., Immunol Allergy Clin North Am., 35(4):671-94 (2015); Zhou et al., Nat Genet., 48(1):67-73 (2015); Navabi et al., Allergy Asthma Clin Immunol., 12:27 (2016); and Tsujita et al., J Allergy Clin Immunol. (2016). MySql' genes are derived from the ClinVar database. ClinVar was searched using the terms "immune deficiency" and "immunodeficiency." Entries that described large genomic rearrangements, containing multiple genes, were excluded. A non-redundant list of 125 genes was compiled by combining the output of the two searches and deposited into a MySQL database. NOTE: A subset of these genes are not flagged as 'MySql' if they appeared in one or more of the immune gene review papers noted above. van der Kolk et al., Ann Clin Transl Neurol.; 3(3):226-32 (2016) was the source of known BAG3 PML gene (see below) and 28 candidate PML genes on the basis of connection to JCV. Van der Kolk et al., cite a method as follows: "the latter was performed by searching for JCV in NCBI, and selecting for genes in humans." This yielded 30 human genes, 5 of which overlapped with the PML gene list and 2 genes (HLA-DQB1, HLA-DRB1) were excluded because HLA loci are difficult to interpret. The genes ADA, BAG3, BTK, CD40LG, DOCK8, STAT1, WAS, and WIPF1 were derived from Hatchwell, Front Immunol., 6:216 (2015) (see Table 1 for primary references); van der Kolk et al., Ann Clin Transl Neurol., 3(3):226-32 (2016); and Zerbe et al., Clin Infect Dis., 62(8):986-94 (2016). PBio genes are based on CNV studies and a subset overlap the immune review gene lists (annotated as 'Both' in column heading 'Gene Source'). Tier 1 genes were used as potential solutions for PML cases. Determination of Autosomal Dominant (AD), Autosomal Recessive (AR), X-linked dominant (XLD), or X-linked (XLR) disease model for each gene was derived from the immunodeficiency review papers and/or OMIM annotations. Entries marked 'association' denotes variants were found to be associated with an immune-related condition; 'unknown' denotes no evidence reported in the literature for an AD or AR model.

TABLE 7

Potential cause of PML in each patient in the study

| Sample_ID | Ethnicity | Gender | Primary Disease | RefSeq Gene Symbol | Variant_Type | Varian Frequency Details (Ethnic specific) | Frequency (Reciprocal) (Ethnic specific) | SEQ_ID |
|---|---|---|---|---|---|---|---|---|
| MVGS1116-8a | EUR | F | MS (NZ Rx) | DOCK8 | SNV hom:SNV het | 0.499:0.00447 | 1 in 1,792 | 1147:1148 |
| MVGS1359 | EUR | F | MS (NZ Rx) | IL17F | SNV het | 0.00024 | 1 in 4,170 | 1114 |
| MVGS1368 | EUR | F | MS (NZ Rx) | IDO2 | SNV hom:SNV het | 0.508:0.065 | 1 in 121 | 1125:1126 |
| MVGS540-374b | EUR | M | MS (NZ Rx) | SHARPIN | SNV hom | 0.00217 | 1 in 461 | 1142 |
| MVGS540-393b | EUR | F | MS (NZ Rx) | DOCK8 | SNV hom:SNV het:SNV het | 0.499:0.00153:0.194 | 1 in 5,246 | 1147:1154:1152 |
| MVGS694-6a | EUR | F | Other | CHD7 | SNV het | 0.00028 | 1 in 3,528 | 1135 |
| MVGS811-13a | EUR | M | HIV | PIK3CD_PIK3CD-AS1 | CNV hom | novel | 0 | 2 |
| MVGS995-4a | EUR | M | MS (NZ Rx) | EPG5 | SNV hom:SNV het | 0.495:0.000251 | 1 in 32,224 | 1279:1273 |

TABLE 7-continued

Potential cause of PML in each patient in the study

| Sample_ID | Ethnicity | Gender | Primary Disease | RefSeq Gene Symbol | Variant_Type | Varian Frequency Details (Ethnic specific) | Frequency (Reciprocol) (Ethnic specific) | SEQ_ID |
|---|---|---|---|---|---|---|---|---|
| PML01 | EUR | F | HIV | ITSN2 | SNV hom | 0.00183 | 1 in 547 | 1028 |
| PML02 | EUR | M | Other | IKBKB | SNV het | novel | 0 | 1127 |
| PML03 | EUR | F | MS (NZ Rx) | FPR2 | CNV hom | 2.23E−06 | 1 in 448,833 | 140 |
| PML04 | EUR | M | HIV | unsolved | n/a | n/a | n/a | n/a |
| PML05 | LAT | M | HIV | TBK1 | SNV het | novel | 0 | 1203 |
| PML06 | AFR | M | HIV | TICAM1 | SNV het | 0.000777 | 1 in 1,287 | 1289 |
| PML09 | EUR | M | HIV | LIG4 | SNV:SNV comp het | 0.00399:0.287 | 1 in 3497 | 1221:1222 |
| PML10 | EUR | F | HIV | TNFRSF11A | SNV het | novel | 0 | 1287 |
| PML12 | LAT | F | HIV | BLM | SNV hom | 0.000874 | 1 in 1,144 | 1235 |
| PML13 | AFR | M | HIV | PLCG2 | SNV:SNV comp het | 0.00167:0.0187 | 1 in 128,105 | 1261:1263 |
| PML14 | EUR | M | HIV | PLCG2 | SNV:SNV comp het | 0.00998:0.0159 | 1 in 25,259 | 1261:1263 |
| PML15 | LAT | M | HIV | NOD2 | SNV het | novel | 0 | 1255 |
| PML16 | AFR | F | HIV | TNFRSF11A | SNV het | novel | 0 | 1287 |
| PML17 | EUR | M | HIV | ZAP70 | SNV het | 0.00009 | 1 in 11,110 | 1035 |
| PML18 | EUR | M | HIV | unsolved | n/a | n/a | n/a | n/a |
| PML19 | AFR | M | HIV | ATM | SNV:SNV comp het | 0.0479:novel | 0 | 1193:1194 |
| PML20 | AFR | M | HIV | NFKB1 | SNV het | 0.00173 | 1 in 577 | 1069 |
| PML21 | EUR | M | HIV | ZAP70 | SNV het | 0.0000602 | 1 in 16,623 | 1034 |
| PML22 | EUR | M | HIV | unsolved | n/a | n/a | n/a | n/a |
| PML23 | EUR | F | HIV | DCLRE1C | SNV hom | novel | 0 | 1167 |
| PML25 | EUR | F | HIV | PLCG2 | SNV het | 0.000150 | 1 in 6,672 | 1259 |
| PML26 | EUR | M | HIV | TRAFD1 | SNV hom | 0.000689 | 1 in 1,451 | 1208 |
| PML27 | EUR | M | HIV | TAP2 | SNV hom | 0.00837 | 1 in 120 | 1101 |
| PML28 | EUR | F | MS (NZ Rx) | TRPM2 | SNV hom | novel | 0 | 1311 |
| PML29 | AFR | M | HIV | KCTD7_RABGEF1 | CNV hom | 0.000387 | 1 in 2,584 | 65 |
| PML30 | EUR | M | HIV | TNFRSF11A | SNV het | novel | 0 | 1287 |
| PML31 | AFR | F | HIV | DDX58 | SNV het | 0.000779 | 1 in 1,283 | 1157 |
| PML32 | EUR | M | HIV | unsolved | n/a | n/a | n/a | n/a |
| PML33 | EUR | M | HIV | TNFRSF11A | SNV het | novel | 0 | 1287 |
| PML35 | EUR | F | HIV | TNFRSF11A | SNV het | novel | 0 | 1287 |
| PML36 | AFR | F | HIV | TCIRG1 | SNV het | 0.002134 | 1 in 469 | 1184 |
| PML37 | AFR | M | HIV | GATA2 | SNV het | novel | 0 | 1056 |
| PML38 | EUR | M | HIV | MALL | CNV hom | 3.95E−06 | 1 in 253,036 | 26 |
| PML39 | AFR | M | HIV | unsolved | n/a | n/a | n/a | n/a |
| PML40 | LAT | F | HIV | PNPT1 | SNV hom | novel | 0 | 1032 |
| PML41 | AFR | M | HIV | ZAP70 | SNV het | novel | 0 | 1036 |
| PML43 | EUR | M | HIV | PTPRC | SNV hom | novel | 0 | 1020 |
| PML44 | EUR | M | HIV | TNFRSF11A | SNV het | novel | 0 | 1287 |
| PML45 | EUR | F | Other | CARD11 | SNV het | 0.0024 | 1 in 417 | 1123 |
| PML46 | LAT | M | HIV | EPG5 | SNV:SNV comp het | 0.0123:0.436 | 1 in 745 | 1278:1279 |
| PML48 | EUR | M | HIV | SMAD4 | SNV het | 0.000901 | 1 in 11,100 | 1284 |
| PML49 | EUR | M | HIV | STIM1 | SNV het | novel | 0 | 1174 |
| PML50 | AFR | M | HIV | NOD2 | SNV het | novel | 0 | 1256 |
| PML51 | EUR | M | HIV | TICAM1 | SNV het | 0.00265 | 1 in 377 | 1289 |
| PML52 | EUR | F | Other | unsolved | n/a | n/a | n/a | n/a |
| PML53 | EUR | M | Other | GFI1 | SNV het | 0.00003 | 1 in 32,635 | 1011 |
| PML54 | EUR | F | HIV | TNFRSF11A | SNV het | novel | 0 | 1287 |
| PML55 | EUR | F | HIV | RTEL1 | SNV het | 0.00326 | 1 in 307 | 1299 |
| PML56 | EUR | M | HIV | TNFRSF11A | SNV het | novel | 0 | 1287 |
| PML57 | EUR | F | Other | TRAF3 | SNV het | 0.00093 | 1 in 1,075 | 1229 |
| PML58 | AFR | M | HIV | DOCK8 | SNV:SNV comp het | 0.0575:0.478 | 1 in 146 | 1146:1147 |
| PML59 | AFR | M | HIV | IFIH1 | SNV het | 0.00281 | 1 in 356 | 1040 |
| PML60 | EUR | M | HIV | unsolved | n/a | n/a | n/a | n/a |
| PML61 | AFR | F | HIV | TNFRSF11A | SNV het | novel | 0 | 1287 |
| PML62 | AFR | F | HIV | unsolved | n/a | n/a | n/a | n/a |
| PML63 | AFR | M | HIV | PLCG2 | SNV het | 0.00195 | 1 in 514 | 1260 |
| PML64 | AFR | M | HIV | PIK3R1 | SNV het | novel | 0 | 1077 |
| PML65 | AFR | M | HIV | ITSN2 | CNV hom | 0.00313 | 1 in 319 | 14 |
| PML66 | AFR | M | HIV | unsolved | n/a | n/a | n/a | n/a |
| PML67 | EUR | F | MS (NZ Rx) | unsolved (CNV data, no WES data) | n/a | n/a | n/a | n/a |
| PML68 | EUR | F | MS (NZ Rx) | LRBA | SNV hom | 0.00162 | 1 in 618 | 1073 |

TABLE 7-continued

Potential cause of PML in each patient in the study

| Sample_ID | Ethnicity | Gender | Primary Disease | RefSeq Gene Symbol | Variant_Type | Varian Frequency Details (Ethnic specific) | Frequency (Reciprocal) (Ethnic specific) | SEQ_ID |
|---|---|---|---|---|---|---|---|---|
| PML69 | EUR | M | Other | EGR1_ETF1 | CNV hom | 0.001 | 1 in 1,005 | 45 |
| PML72 | AFR | F | HIV | NOD2 | SNV het | 0.004036 | 1 in 248 | 1252 |

Table 7 contains a single genetic solution/explanation that is the potential cause of PML in each patient in the study (71 cases were assessed with genome-wide array CGH and 71 were also assessed by whole exome sequencing), with the exception of 19 'unsolved' cases. Solutions are based on a combination of CNV and SNV variants, connected by SEQ IDs to tables 1, 4 and 5. For homozygous or compound heterozygous variant solutions, expected population frequencies were calculated as follows:

Expected population frequency for variant a (freq p) and variant b (freq q)=pq/4.

For example, PML09 has 2 variants, SEQ ID 1221 and 1222, with individual frequencies in the normal population of 0.00399, 0.287. The expected frequency in an ethnically-matched normal population for this combination is (0.00399*0.287)*0.25=0.000286283=1/3,497.

The Primary_Disease identifiers in Table 7 are: HIV, infection with human immunodeficiency virus; MS (NZ Rx), multiple sclerosis treated with natalizumab; Other, which includes a variety of disorders/conditions (MVGS694-6a had aplastic anemia, PML02 and PML52 had lymphoma, PML45 and PML 57 had chronic lymphocytic leukemia, PML53 had sarcoidosis, and PML69 is a kidney transplant patient who was on belatacept).

Solutions were considered on the basis of presence of rare variants (CNVs and/or SNVs) in or near genes that are listed in Table 6. Both autosomal recessive (AR) and autosomal dominant (AD) disease models comprise this set of solutions, based on finding homozygous SNVs, homozygous CNVs, compound heterozygous SNVs, or heterozygous SNVs. Nine PML cases in Table 7 were considered 'unsolved' on the basis of analyzing both CNV and SNV data, and one case (PML67) was assessed for CNVs only since WES data were unavailable. In some instances, a case was considered unsolved for a best solution (Table 7) but alternate solutions were reported in Table 8 (see below).

For PML cases that had more than one potential solution. In these instances, the 'best' solution (Table 7) was determined on the basis of rarity of the genetic variant(s) and the relative strength of the biology for the PML-419 genes (Table 6). Alternate solutions are reported in Table 8. For example, for PML case MVGS1116-8a, three solutions were found, which impacted genes DOCK8, HIVEP2, and RNF168. In this example, DOCK8 compound heterozygous SNVs (Table 7, SNV hom:SNV het) were selected as the best solution because DOCK8 is a known PML gene. In another example, PML case MVGS1359 has IL17F (het SNV) listed as the best solution in Table 7 because it is rarer than alternate solutions for the ATR and STXBP2 genes.

While some PML patients may have multiple genes/variants causing and/or contributing to their PML, in many PML patients only a single gene will be the primary cause analogous to patients diagnosed with primary immunodeficiency disorders. In addition to the alternate solutions reported in Table 8, which are based on SNV genetic findings only, additional alternate solutions based on CNV genetic findings are reported in Table 1.

TABLE 8

Alternate genetic solutions/explanations as the potential cause of PML in the study

| Sample ID | RefSeq Gene Symbol | Variant_Type | Variant Frequency Details (Ethnic specific) | Frequency (Reciprocal) (Ethnic specific) | SEQ ID |
|---|---|---|---|---|---|
| MVGS1116-8a | HIVEP2 | SNV het | novel | 0 | 1118 |
| MVGS1116-8a | RNF168 | SNV hom:SNV het | 0.469:0.00818 | 1 in 1,041 | 1063:1066 |
| MVGS1359 | ATR | SNV het | 0.00393 | 1 in 254 | 1058 |
| MVGS1359 | STXBP2 | SNV het | 0.00501 | 1 in 199 | 1291 |
| MVGS540-374b | MKL1 | CNV hom | 3.99E−08 | 1 in 25,081,515 | 157 |
| MVGS540-393b | PRKDC | SNV het | 0.00097 | 1 in 1,031 | 1130 |
| MVGS811-13a | CLCN7 | SNV het | 0.00028 | 1 in 3,571 | 1239 |
| MVGS995-4a | KAT6B | SNV het | 0.00003 | 1 in 33,357 | 1169 |
| MVGS995-4a | PRF1 | SNV het | 0.00243 | 1 in 412 | 1168 |
| PML03 | CDKN1B | SNV het | 0.00003 | 1 in 32,209 | 1200 |
| PML05 | ATR | SNV het | novel | 0 | 1061 |
| PML05 | NFKB1 | SNV het | 0.00501 | 1 in 200 | 1070 |
| PML06 | CHD7 | SNV het | 0.00797 | 1 in 125 | 1136 |
| PML06 | DOCK8 | SNV hom:SNV het | 0.478:0.0313 | 1 in 267 | 1147:1152 |
| PML09 | RIPK3 | SNV het | 0.00398 | 1 in 251 | 1227 |
| PML10 | JUN | SNV het | 0.00103 | 1 in 968 | 1009 |
| PML10 | RAG1 | SNV het | 0.00039 | 1 in 2,566 | 1179 |
| PML12 | CARD11 | SNV het | novel | 0 | 1122 |
| PML12 | PRKDC | SNV het | novel | 0 | 1128 |
| PML13 | DOCK8 | SNV hom:SNV het | 0.478:0.0313 | 1 in 267 | 1147:1152 |
| PML13 | IRAK4 | SNV het | novel | 0 | 1202 |
| PML13 | PIK3CD | SNV het | 0.00679 | 1 in 147 | 1000 |

TABLE 8-continued

Alternate genetic solutions/explanations as the potential cause of PML in the study

| Sample ID | RefSeq Gene Symbol | Variant_Type | Variant Frequency Details (Ethnic specific) | Frequency (Reciprocol) (Ethnic specific) | SEQ ID |
|---|---|---|---|---|---|
| PML14 | NBN | SNV het | 0.0039 | 1 in 256 | 1138 |
| PML14 | NFKB1 | SNV het | novel | 0 | 1071 |
| PML15 | ASH1L | SNV:SNV comp het | novel:0.0019 | 0 | 1016:1017 |
| PML15 | CHD7 | SNV het | 0.00176 | 1 in 568 | 1133 |
| PML15 | HIVEP2 | SNV het | novel | 0 | 1116 |
| PML15 | STIM1 | SNV het | 0.00587 | 1 in 170 | 1175 |
| PML16 | TBK1 | SNV het | novel | 0 | 1204 |
| PML16 | TLR3 | SNV het | 0.00136 | 1 in 738 | 1076 |
| PML17 | APOL1 | SNV het | 0.0021 | 1 in 475 | 1327 |
| PML18 | PKHD1 | SNV hom:SNV het | 0.498:0.0471 | 1 in 171 | 1104:1107 |
| PML19 | DOCK8 | SNV:SNV comp het | 0.0575:0.478 | 1 in 146 | 1146:1147 |
| PML19 | IFIH1 | SNV het | 0.00444 | 1 in 225 | 1041 |
| PML20 | JUN | SNV het | 0.00535 | 1 in 187 | 1010 |
| PML21 | PRKCH | SNV het | novel | 0 | 1228 |
| PML21 | PSTPIP1 | SNV het | 0.00093 | 1 in 1,074 | 1232 |
| PML21 | RAG2 | SNV het | novel | 0 | 1182 |
| PML22 | RIPK3 | SNV hom | 0.00309 | 1 in 324 | 1226 |
| PML22 | VPS45 | SNV het | 0.00114 | 1 in 878 | 1014 |
| PML23 | NOD2 | SNV het | novel | 0 | 1251 |
| PML23 | RAG1 | SNV het | 0.00003 | 1 in 33,317 | 1180 |
| PML28 | PKHD1 | SNV hom:SNV het | 0.498:0.0471 | 1 in 171 | 1104:1107 |
| PML28 | TNFRSF13B | SNV het | 0.00929 | 1 in 108 | 1267 |
| PML30 | RTEL1 | SNV het | 0.000124 | 1 in 8,068 | 1300 |
| PML31 | AP3B1 | SNV het | novel | 0 | 1084 |
| PML31 | PRKDC | SNV het | novel | 0 | 1129 |
| PML33 | STIM2 | SNV het | 0.00003 | 1 in 32,688 | 1068 |
| PML33 | TLR3 | SNV hom:SNV het | 0.413:0.00435 | 1 in 2,227 | 1075:1074 |
| PML33 | TLR4 | SNV hom:SNV hom | 0.00283:0.00285 | 1 in 354 | 1161:1160 |
| PML35 | PRKCB | SNV het | 0.00276 | 1 in 362 | 1247 |
| PML36 | NOD2 | SNV het | 0.00871 | 1 in 115 | 1254 |
| PML36 | PIK3CD | SNV het | 0.00679 | 1 in 147 | 1000 |
| PML37 | AP3B1 | SNV het | novel | 0 | 1080 |
| PML37 | ATR | SNV het | 0.00038 | 1 in 2,601 | 1059 |
| PML37 | WEE1 | SNV het | 0.00825 | 1 in 121 | 1177 |
| PML38 | MYD88 | SNV het | novel | 0 | 1051 |
| PML40 | MCEE | SNV hom | 0.01 | 1 in 100 | 1033 |
| PML41 | AP3B1 | SNV het | 0.00173 | 1 in 577 | 1082 |
| PML41 | CHD7 | SNV het | novel | 0 | 1137 |
| PML41 | DOCK8 | SNV:SNV comp het | 0.0575:0.478 | 1 in 146 | 1146:1147 |
| PML41 | POLE | SNV hom | 0.00019 | 1 in 5,203 | 1219 |
| PML41 | RNF168 | SNV:SNV comp het | 0.412:novel | 0 | 1063:1062 |
| PML43 | DOCK8 | SNV hom:SNV het | 0.499:novel | 0 | 1147:1150 |
| PML44 | DCLRE1C | SNV hom:SNV hom | 0.0287:0.00575 | 1 in 174 | 1166:1165 |
| PML44 | GFI1 | SNV het | 0.00708 | 1 in 141 | 1012 |
| PML45 | POLA1 | SNV het | novel | 0 | 1328 |
| PML46 | AP3B1 | SNV het | 0.00587 | 1 in 170 | 1082 |
| PML46 | IL21R | SNV het | 0.00573 | 1 in 175 | 1248 |
| PML46 | PRKDC | SNV het | 0.00017 | 1 in 5,781 | 1131 |
| PML48 | TNFRSF11A | SNV het | 0.00233 | 1 in 429 | 1286 |
| PML49 | DCLRE1C | SNV hom:SNV hom | 0.00575:0.0287 | 1 in 174 | 1166:1165 |
| PML49 | PTEN | SNV het | novel | 0 | 1171 |
| PML49 | RIPK1 | SNV het | 0.00090 | 1 in 1,112 | 1090 |
| PML50 | AP3B1 | SNV het | 0.00387 | 1 in 259 | 1078 |
| PML50 | PIAS2 | SNV het | 0.00357 | 1 in 280 | 1283 |
| PML50 | STXBP2 | SNV het | 0.00038 | 1 in 2,598 | 1290 |
| PML52 | GFI1 | SNV het | 0.00708 | 1 in 141 | 1012 |
| PML53 | IL1B | SNV het | novel | 0 | 1037 |
| PML53 | STXBP2 | SNV het | 0.00501 | 1 in 199 | 1291 |
| PML54 | EPG5 | SNV:SNV comp het | 0.0638:0.495 | 1 in 127 | 1278:1279 |
| PML54 | IFNGR2 | SNV het | 0.00009 | 1 in 11,096 | 1304 |
| PML54 | RAG1 | SNV het | 0.00003 | 1 in 33,352 | 1178 |
| PML54 | RAG2 | SNV het | novel | 0 | 1183 |
| PML57 | PIAS1 | SNV het | novel | 0 | 1231 |
| PML57 | PKHD1 | SNV hom:SNV het | 0.498:0.0471 | 1 in 171 | 1104:1107 |
| PML57 | SKIV2L | SNV hom:SNV hom:SNV het | 0.157:0.214:0.0471 | 1 in 538 | 1098:1100:1099 |
| PML58 | GFI1 | SNV het | 0.00144 | 1 in 693 | 1012 |
| PML59 | IFNLR1 | SNV het | novel | 0 | 1002 |
| PML59 | NOD2 | SNV het | 0.00404 | 1 in 248 | 1252 |
| PML59 | NRIP1 | SNV hom | 0.00711 | 1 in 141 | 1301 |
| PML59 | RAD51 | SNV het | 0.00865 | 1 in 116 | 1230 |
| PML60 | MAPK3 | SNV het | novel | 0 | 1250 |
| PML60 | TP53 | SNV het | 0.00048 | 1 in 2,085 | 1266 |
| PML61 | GATA2 | SNV het | 0.00024 | 1 in 4,139 | 1057 |
| PML61 | PTPRC | SNV hom | novel | 0 | 1019 |

TABLE 8-continued

Alternate genetic solutions/explanations as the potential cause of PML in the study

| Sample ID | RefSeq Gene Symbol | Variant_Type | Variant Frequency Details (Ethnic specific) | Frequency (Reciprocol) (Ethnic specific) | SEQ ID |
|---|---|---|---|---|---|
| PML61 | TNFRSF8 | SNV het | novel | 0 | 1001 |
| PML62 | PRKCD | SNV het | novel | 0 | 1054 |
| PML63 | HTR2A | SNV hom | 0.00519 | 1 in 193 | 1220 |
| PML63 | MAPK3 | SNV het | 0.00193 | 1 in 518 | 1249 |
| PML64 | PLCG2 | SNV het | 0.00044 | 1 in 2,276 | 1264 |
| PML64 | WEE1 | SNV het | novel | 0 | 1176 |
| PML65 | IRAK4 | SNV het | 0.00118 | 1 in 850 | 1201 |
| PML66 | PIK3CD | SNV het | 0.00679 | 1 in 147 | 1000 |
| PML68 | RAG1 | SNV het | 0.00586 | 1 in 171 | 1181 |
| PML72 | CARD11 | SNV het | 0.00242 | 1 in 413 | 1121 |
| PML72 | HIVEP1 | SNV hom | 0.00164 | 1 in 610 | 1092 |
| PML72 | IFIH1 | SNV het | 0.00843 | 1 in 119 | 1043 |

Table 8 contains analogous information to Table 7, with the exception that Ethnicity, Gender and Primary_Disease are not repeated. Table 8 contains alternate genetic solutions/explanations as the potential cause of PML for the patients in the study (71 cases were assessed with genome-wide array CGH and 70 were also assessed by whole exome sequencing). Solutions in Table 8 are also case-level and represent secondary, alternative solutions for the cases listed (using the same criteria used to identify potential solutions reported in Table 7). In other words, for some individuals, more than one reasonable solution was identified and, while those in Table 7 are considered the most likely, those in Table 8 are also potential solutions. It can be appreciated by those skilled in the art that further data on new PML cases, patients with genetic-based immunodeficiency disorders, or functional studies on a given gene may support selection of a Table 8 solution as the 'best' single solution (i.e., a current Table 7 solution could be considered instead as a Table 8 solution, and vice versa).

TABLE 9

Pairs of SNVs impacting the same gene

| Sample ID | RefSeq Gene Symbol | Variant Type | Chromosome | Position | Ref Allele | Alt Allele | Amino Acid Change | Variant Frequency Details (Ethnic specific) | SEQ ID NO |
|---|---|---|---|---|---|---|---|---|---|
| MVGS1359 | TTC7A | SNV het | 2 | 47273468 | A | G | K252R | 0.00684 | 1030 |
| MVGS1359 | TTC7A | SNV het | 2 | 47277182 | T | C | S318P | 0.00683 | 1031 |
| MVGS1368 | RNF168 | SNV het | 3 | 196199204 | G | T | P401Q | 0.46947 | 1063 |
| MVGS1368 | RNF168 | SNV het | 3 | 196210764 | T | C | n/a | 0.00003 | 1065 |
| MVGS1368 | TLR4 | SNV het | 9 | 120475302 | A | G | D259G | 0.10251 | 1160 |
| MVGS1368 | TLR4 | SNV het | 9 | 120475602 | C | T | T359I | 0.10560 | 1161 |
| MVGS811-13a | HIVEP1 | SNV het | 6 | 12121113 | C | T | P362L | 0.00024 | 1091 |
| MVGS811-13a | HIVEP1 | SNV het | 6 | 12123538 | G | T | K1170N | 0.08730 | 1093 |
| MVGS995-4a | EEA1 | SNV het | 12 | 93196332 | C | T | E840K | 0.01949 | 1206 |
| MVGS995-4a | EEA1 | SNV het | 12 | 93205148 | T | G | E702D | 0.00003 | 1207 |
| PML02 | RBFOX1 | SNV het | 16 | 7759119 | G | A | G326S | 0.00504 | 1245 |
| PML02 | RBFOX1 | SNV het | 16 | 7759496 | C | T | P401S | novel | 1246 |
| PML04 | POLE | SNV het | 12 | 133220526 | T | C | N1369S | 0.22363 | 1213 |
| PML04 | POLE | SNV het | 12 | 133237658 | T | G | Q766P | novel | 1215 |
| PML05 | TLR4 | SNV het | 9 | 120475302 | A | G | D259G | 0.04628 | 1160 |
| PML05 | TLR4 | SNV het | 9 | 120475602 | C | T | T359I | 0.04180 | 1161 |
| PML05 | POLE | SNV het | 12 | 133220526 | T | C | N1369S | 0.12669 | 1213 |
| PML05 | POLE | SNV het | 12 | 133252406 | C | A | A121S | novel | 1217 |
| PML10 | TLR4 | SNV het | 9 | 120475302 | A | G | D259G | 0.10251 | 1160 |
| PML10 | TLR4 | SNV het | 9 | 120475602 | C | T | T359I | 0.10560 | 1161 |
| PML12 | IDO2 | SNV het | 8 | 39840234 | A | G | I127V | 0.38971 | 1124 |
| PML12 | IDO2 | SNV het | 8 | 39862881 | C | T | R235W | 0.50282 | 1125 |
| PML12 | IDO2 | SNV het | 8 | 39862893 | T | A | S239T | 0.02384 | 1126 |
| PML13 | STX11 | SNV het | 6 | 144508353 | G | A | V197M | novel | 1119 |
| PML13 | STX11 | SNV het | 6 | 144508563 | G | A | V267M | 0.00202 | 1120 |
| PML13 | DCLRE1C | SNV het | 10 | 14974905 | T | C | H123R | 0.16298 | 1165 |
| PML13 | DCLRE1C | SNV het | 10 | 14976727 | T | C | P171R | 0.22295 | 1166 |
| PML13 | EPG5 | SNV het | 18 | 43497710 | A | G | V1058A | 0.42740 | 1279 |
| PML13 | EPG5 | SNV het | 18 | 43531186 | C | T | S424N | 0.00600 | 1282 |
| PML14 | ATM | SNV het | 11 | 108117787 | C | T | S333F | 0.00280 | 1188 |
| PML14 | ATM | SNV het | 11 | 108175462 | G | A | D1853N | 0.24654 | 1193 |
| PML14 | TRPM2 | SNV het | 21 | 45815425 | C | G | I621M | novel | 1313 |
| PML14 | TRPM2 | SNV het | 21 | 45845699 | G | A | V1242M | 0.00537 | 1321 |
| PML16 | TLR3 | SNV het | 4 | 187004074 | C | T | L135F | 0.12378 | 1075 |
| PML16 | TLR3 | SNV het | 4 | 187005854 | A | C | I571L | 0.00136 | 1076 |
| PML16 | HIVEP1 | SNV het | 6 | 12121113 | C | T | P362L | 0.07856 | 1091 |

TABLE 9-continued

Pairs of SNVs impacting the same gene

| Sample ID | RefSeq Gene Symbol | Variant Type | Chromosome | Position | Ref Allele | Alt Allele | Amino Acid Change | Variant Frequency Details (Ethnic specific) | SEQ ID NO |
|---|---|---|---|---|---|---|---|---|---|
| PML16 | HIVEP1 | SNV het | 6 | 12162068 | C | T | S160F | 0.01979 | 1096 |
| PML16 | PKHD1 | SNV het | 6 | 51483961 | T | C | Q4048R | 0.50029 | 1104 |
| PML16 | PKHD1 | SNV het | 6 | 51747943 | T | A | D2433V | 0.07153 | 1112 |
| PML16 | POLE | SNV het | 12 | 133209020 | G | C | Q2044E | novel | 1212 |
| PML16 | POLE | SNV het | 12 | 133220526 | T | C | N1369S | 0.24889 | 1213 |
| PML17 | RNF168 | SNV het | 3 | 196199204 | G | T | P401Q | 0.46947 | 1063 |
| PML17 | RNF168 | SNV het | 3 | 196210704 | G | A | P206L | 0.00003 | 1064 |
| PML17 | HIVEP1 | SNV het | 6 | 12123538 | G | T | K1170N | 0.08730 | 1093 |
| PML17 | HIVEP1 | SNV het | 6 | 12125232 | C | T | S1735F | 0.00027 | 1095 |
| PML17 | PKHD1 | SNV het | 6 | 51483961 | T | C | Q4048R | 0.49837 | 1104 |
| PML17 | PKHD1 | SNV het | 6 | 51497503 | C | A | R3842L | 0.04707 | 1107 |
| PML17 | DCLRE1C | SNV het | 10 | 14974905 | T | C | H123R | 0.27332 | 1165 |
| PML17 | DCLRE1C | SNV het | 10 | 14976727 | G | C | P171R | 0.13896 | 1166 |
| PML17 | ATM | SNV het | 11 | 108119823 | T | C | V410A | 0.00643 | 1189 |
| PML17 | ATM | SNV het | 11 | 108175462 | G | A | D1853N | 0.24654 | 1193 |
| PML17 | EPG5 | SNV het | 18 | 43464763 | C | T | G1708D | 0.00013 | 1274 |
| PML17 | EPG5 | SNV het | 18 | 43497710 | A | G | V1058A | 0.49513 | 1279 |
| PML18 | TLR4 | SNV het | 9 | 120475302 | A | G | D259G | 0.10251 | 1160 |
| PML18 | TLR4 | SNV het | 9 | 120475602 | C | T | T359I | 0.10560 | 1161 |
| PML20 | AK2 | SNV het | 1 | 33476435 | C | A | n/a | novel | 1003 |
| PML20 | AK2 | SNV het | 1 | 33478900 | T | A | Y159F | 0.04954 | 1004 |
| PML20 | HIVEP1 | SNV het | 6 | 12124215 | C | T | P1396L | 0.06774 | 1094 |
| PML20 | HIVEP1 | SNV het | 6 | 12163657 | C | T | P2374S | 0.06733 | 1097 |
| PML20 | KANK1 | SNV het | 9 | 711359 | C | T | S198F | 0.11985 | 1155 |
| PML20 | KANK1 | SNV het | 9 | 713132 | G | T | G631V | 0.00136 | 1156 |
| PML21 | DOCK8 | SNV het | 9 | 286593 | C | A | P29T | 0.49889 | 1147 |
| PML21 | DOCK8 | SNV het | 9 | 286593 | C | A | P29T | 0.49889 | 1147 |
| PML21 | DOCK8 | SNV het | 9 | 312134 | G | A | E169K | 0.06358 | 1149 |
| PML21 | DOCK8 | SNV het | 9 | 312134 | G | A | E169K | 0.06358 | 1149 |
| PML21 | TLR4 | SNV het | 9 | 120475302 | A | G | D259G | 0.10251 | 1160 |
| PML21 | TLR4 | SNV het | 9 | 120475302 | A | G | D259G | 0.10251 | 1160 |
| PML21 | TLR4 | SNV het | 9 | 120475602 | C | T | T359I | 0.10560 | 1161 |
| PML21 | TLR4 | SNV het | 9 | 120475602 | C | T | T359I | 0.10560 | 1161 |
| PML21 | ATM | SNV het | 11 | 108138003 | T | C | F858L | 0.02864 | 1191 |
| PML21 | ATM | SNV het | 11 | 108138003 | T | C | F858L | 0.02864 | 1191 |
| PML21 | ATM | SNV het | 11 | 108143456 | C | G | P1054R | 0.05069 | 1192 |
| PML21 | ATM | SNV het | 11 | 108143456 | C | G | P1054R | 0.05069 | 1192 |
| PML21 | TRPM2 | SNV het | 21 | 45786650 | C | T | S146F | 0.00072 | 1305 |
| PML21 | TRPM2 | SNV het | 21 | 45786650 | C | T | S146F | 0.00072 | 1305 |
| PML21 | TRPM2 | SNV het | 21 | 45820196 | C | T | R735C | 0.10374 | 1314 |
| PML21 | TRPM2 | SNV het | 21 | 45820196 | C | T | R735C | 0.10374 | 1314 |
| PML22 | SKIV2L | SNV het | 6 | 31928306 | A | G | Q151R | 0.15759 | 1098 |
| PML22 | SKIV2L | SNV het | 6 | 31935750 | G | A | V724M | 0.04718 | 1099 |
| PML22 | SKIV2L | SNV het | 6 | 31936679 | C | T | A1071V | 0.21419 | 1100 |
| PML22 | DOCK8 | SNV het | 9 | 286593 | C | A | P29T | 0.49889 | 1147 |
| PML22 | DOCK8 | SNV het | 9 | 304628 | G | A | R151Q | 0.00447 | 1148 |
| PML22 | GDPD4 | SNV het | 11 | 76954833 | G | A | H383Y | 0.44867 | 1186 |
| PML22 | GDPD4 | SNV het | 11 | 76979511 | A | G | I233T | 0.00504 | 1187 |
| PML22 | ATM | SNV het | 11 | 108117787 | C | T | S333F | 0.00280 | 1188 |
| PML22 | ATM | SNV het | 11 | 108175462 | G | A | D1853N | 0.24654 | 1193 |
| PML22 | BLM | SNV het | 15 | 91306241 | G | A | R643H | 0.00799 | 1233 |
| PML22 | BLM | SNV het | 15 | 91341543 | A | C | N1112H | novel | 1238 |
| PML23 | PKHD1 | SNV het | 6 | 51483961 | T | C | Q4048R | 0.49837 | 1104 |
| PML23 | PKHD1 | SNV het | 6 | 51497503 | C | A | R3842L | 0.04707 | 1107 |
| PML23 | SHARPIN | SNV het | 8 | 145154222 | G | A | P294S | 0.08789 | 1142 |
| PML23 | SHARPIN | SNV het | 8 | 145154257 | C | G | S282T | 0.14880 | 1144 |
| PML23 | DOCK8 | SNV het | 9 | 286491 | G | A | D63N | 0.27362 | 1146 |
| PML23 | DOCK8 | SNV het | 9 | 334277 | G | A | R325H | 0.00015 | 1151 |
| PML25 | SKIV2L | SNV het | 6 | 31928306 | A | G | Q151R | 0.15759 | 1098 |
| PML25 | SKIV2L | SNV het | 6 | 31935750 | G | A | V724M | 0.04718 | 1099 |
| PML25 | SKIV2L | SNV het | 6 | 31936679 | C | T | A1071V | 0.21419 | 1100 |
| PML25 | PKHD1 | SNV het | 6 | 51483961 | T | C | Q4048R | 0.49837 | 1104 |
| PML25 | PKHD1 | SNV het | 6 | 51524409 | G | T | S3505R | 0.02049 | 1109 |
| PML25 | EPG5 | SNV het | 18 | 43445601 | T | G | I174L | novel | 1270 |
| PML25 | EPG5 | SNV het | 18 | 43531186 | C | T | S424N | 0.02391 | 1282 |
| PML27 | LYST | SNV het | 1 | 235897907 | C | T | G2804D | 0.00114 | 1024 |
| PML27 | LYST | SNV het | 1 | 235909815 | A | T | F165Y | 0.00102 | 1025 |
| PML27 | EPG5 | SNV het | 18 | 43445601 | T | G | I174L | novel | 1270 |
| PML27 | EPG5 | SNV het | 18 | 43497710 | A | G | V1058A | 0.49513 | 1279 |
| PML29 | LIG1 | SNV het | 19 | 48631258 | G | A | T546I | 0.07515 | 1292 |
| PML29 | LIG1 | SNV het | 19 | 48639022 | T | C | M412V | 0.05385 | 1293 |
| PML30 | DCLRE1C | SNV het | 10 | 14974905 | T | C | H123R | 0.27332 | 1165 |

TABLE 9-continued

Pairs of SNVs impacting the same gene

| Sample ID | RefSeq Gene Symbol | Variant Type | Chromosome | Position | Ref Allele | Alt Allele | Amino Acid Change | Variant Frequency Details (Ethnic specific) | SEQ ID NO |
|---|---|---|---|---|---|---|---|---|---|
| PML30 | DCLRE1C | SNV het | 10 | 14976727 | G | C | P171R | 0.13896 | 1166 |
| PML30 | ATM | SNV het | 11 | 108138003 | T | C | F858L | 0.02864 | 1191 |
| PML30 | ATM | SNV het | 11 | 108143456 | C | G | P1054R | 0.05069 | 1192 |
| PML30 | ATM | SNV het | 11 | 108186610 | G | A | G2023R | 0.00465 | 1195 |
| PML31 | LYST | SNV het | 1 | 235897907 | C | T | G2804D | 0.23000 | 1024 |
| PML31 | LYST | SNV het | 1 | 235909815 | A | T | F165Y | 0.15155 | 1025 |
| PML31 | PKHD1 | SNV het | 6 | 51483961 | T | C | Q4048R | 0.50029 | 1104 |
| PML31 | PKHD1 | SNV het | 6 | 51524339 | C | G | E3529Q | 0.07244 | 1108 |
| PML31 | PKHD1 | SNV het | 6 | 51747943 | T | A | D2433V | 0.07153 | 1112 |
| PML31 | PKHD1 | SNV het | 6 | 51798908 | C | T | G2041S | 0.00173 | 1113 |
| PML32 | PKHD1 | SNV het | 6 | 51483961 | T | C | Q4048R | 0.49837 | 1104 |
| PML32 | PKHD1 | SNV het | 6 | 51491885 | G | A | Q3899* | novel | 1106 |
| PML32 | EPG5 | SNV het | 18 | 43496539 | G | A | S1083L | 0.06375 | 1278 |
| PML32 | EPG5 | SNV het | 18 | 43497710 | A | G | V1058A | 0.49513 | 1279 |
| PML32 | EPG5 | SNV het | 18 | 43529551 | C | T | V466M | 0.00006 | 1281 |
| PML33 | AK2 | SNV het | 1 | 33476435 | C | A | n/a | novel | 1003 |
| PML33 | AK2 | SNV het | 1 | 33487007 | C | T | S129N | 0.01100 | 1005 |
| PML33 | EPG5 | SNV het | 18 | 43497710 | A | G | V1058A | 0.49513 | 1279 |
| PML33 | EPG5 | SNV het | 18 | 43523240 | C | T | M610I | 0.00066 | 1280 |
| PML35 | RNF168 | SNV het | 3 | 196199204 | G | T | P401Q | 0.46947 | 1063 |
| PML35 | RNF168 | SNV het | 3 | 196214320 | C | T | E170K | 0.00818 | 1066 |
| PML36 | IDO2 | SNV het | 8 | 39862881 | C | T | R235W | 0.46108 | 1125 |
| PML36 | IDO2 | SNV het | 8 | 39862893 | T | A | S239T | 0.01135 | 1126 |
| PML39 | LYST | SNV het | 1 | 235897907 | C | T | G2804D | 0.23000 | 1024 |
| PML39 | LYST | SNV het | 1 | 235909815 | A | T | F165Y | 0.15155 | 1025 |
| PML39 | NHEJ1 | SNV het | 2 | 219942026 | T | A | Q181L | 0.06324 | 1047 |
| PML39 | NHEJ1 | SNV het | 2 | 220023045 | C | T | A14T | 0.23543 | 1048 |
| PML40 | ATM | SNV het | 11 | 108186631 | A | G | I2030V | 0.00173 | 1196 |
| PML40 | ATM | SNV het | 11 | 108186631 | A | G | I2030V | 0.03446 | 1196 |
| PML40 | ATM | SNV het | 11 | 108198384 | C | G | L2330V | 0.00035 | 1197 |
| PML40 | ATM | SNV het | 11 | 108198384 | C | G | L2330V | 0.00491 | 1197 |
| PML41 | PKHD1 | SNV het | 6 | 51483961 | T | C | Q4048R | 0.50029 | 1104 |
| PML41 | PKHD1 | SNV het | 6 | 51497503 | C | A | R3842L | 0.00654 | 1107 |
| PML41 | IDO2 | SNV het | 8 | 39840234 | A | G | I127V | 0.06350 | 1124 |
| PML41 | IDO2 | SNV het | 8 | 39862881 | C | T | R235W | 0.46108 | 1125 |
| PML45 | VPS13B | SNV het | 8 | 100791158 | G | A | E2560K | 0.00964 | 1140 |
| PML45 | VPS13B | SNV het | 8 | 100865941 | G | A | A3442T | novel | 1141 |
| PML48 | EPG5 | SNV het | 18 | 43497710 | A | G | V1058A | 0.49513 | 1279 |
| PML48 | EPG5 | SNV het | 18 | 43531186 | C | T | S424N | 0.02391 | 1282 |
| PML51 | TRPM2 | SNV het | 21 | 45826486 | G | A | V914I | novel | 1315 |
| PML51 | TRPM2 | SNV het | 21 | 45855099 | C | T | R1300W | 0.00021 | 1322 |
| PML53 | EPG5 | SNV het | 18 | 43445580 | C | T | D181N | novel | 1269 |
| PML53 | EPG5 | SNV het | 18 | 43497710 | A | G | V1058A | 0.49513 | 1279 |
| PML56 | TLR4 | SNV het | 9 | 120475302 | A | G | D259G | 0.10251 | 1160 |
| PML56 | TLR4 | SNV het | 9 | 120475602 | C | T | T359I | 0.10560 | 1161 |
| PML56 | DCLRE1C | SNV het | 10 | 14974905 | T | C | H123R | 0.27332 | 1165 |
| PML56 | DCLRE1C | SNV het | 10 | 14976727 | G | C | P171R | 0.13896 | 1166 |
| PML57 | CSF3R | SNV het | 1 | 36932047 | C | T | E359K | 0.01706 | 1006 |
| PML57 | CSF3R | SNV het | 1 | 36933715 | A | G | Y113H | 0.00087 | 1007 |
| PML57 | TLR4 | SNV het | 9 | 120475302 | A | G | D259G | 0.10251 | 1160 |
| PML57 | TLR4 | SNV het | 9 | 120475602 | C | T | T359I | 0.10560 | 1161 |
| PML57 | ATM | SNV het | 11 | 108138003 | T | C | F858L | 0.02864 | 1191 |
| PML57 | ATM | SNV het | 11 | 108143456 | C | G | P1054R | 0.05069 | 1192 |
| PML57 | ATM | SNV het | 11 | 108175462 | G | A | D1853N | 0.24654 | 1193 |
| PML58 | DOCK8 | SNV het | 9 | 399233 | A | G | N1002D | 0.19737 | 1153 |
| PML58 | DCLRE1C | SNV het | 10 | 14974905 | T | C | H123R | 0.16298 | 1165 |
| PML58 | DCLRE1C | SNV het | 10 | 14976727 | G | C | P171R | 0.22295 | 1166 |
| PML58 | DNMT3B | SNV het | 20 | 31383307 | G | A | G311S | 0.00192 | 1296 |
| PML58 | DNMT3B | SNV het | 20 | 31384614 | G | T | G343V | novel | 1297 |
| PML59 | LYST | SNV het | 1 | 235897907 | C | T | G2804D | 0.23000 | 1024 |
| PML59 | LYST | SNV het | 1 | 235897907 | C | T | G2804D | 0.23000 | 1024 |
| PML59 | LYST | SNV het | 1 | 235909815 | A | T | F165Y | 0.15155 | 1025 |
| PML59 | LYST | SNV het | 1 | 235909815 | A | T | F165Y | 0.15155 | 1025 |
| PML59 | LIG1 | SNV het | 19 | 48631258 | G | A | T546I | 0.07515 | 1292 |
| PML59 | LIG1 | SNV het | 19 | 48631258 | G | A | T546I | 0.07515 | 1292 |
| PML59 | LIG1 | SNV het | 19 | 48639022 | T | C | M412V | 0.05385 | 1293 |
| PML59 | LIG1 | SNV het | 19 | 48639022 | T | C | M412V | 0.05385 | 1293 |
| PML60 | DCLRE1C | SNV het | 10 | 14974905 | T | C | H123R | 0.27332 | 1165 |
| PML60 | DCLRE1C | SNV het | 10 | 14976727 | G | C | P171R | 0.13896 | 1166 |
| PML60 | POLE | SNV het | 12 | 133202816 | C | T | E2113K | 0.04686 | 1211 |
| PML60 | POLE | SNV het | 12 | 133220526 | T | C | N1369S | 0.22363 | 1213 |
| PML62 | TLR4 | SNV het | 9 | 120475302 | A | G | D259G | 0.13066 | 1160 |

TABLE 9-continued

Pairs of SNVs impacting the same gene

| Sample ID | RefSeq Gene Symbol | Variant Type | Chromosome | Position | Ref Allele | Alt Allele | Amino Acid Change | Variant Frequency Details (Ethnic specific) | SEQ ID NO |
|---|---|---|---|---|---|---|---|---|---|
| PML62 | TLR4 | SNV het | 9 | 120475602 | C | T | T359I | 0.02672 | 1161 |
| PML63 | HIVEP1 | SNV het | 6 | 12124215 | C | T | P1396L | 0.06774 | 1094 |
| PML63 | HIVEP1 | SNV het | 6 | 12163657 | C | T | P2374S | 0.06733 | 1097 |
| PML63 | PLCG2 | SNV het | 16 | 81942175 | A | G | N571S | 0.01870 | 1263 |
| PML63 | TRPM2 | SNV het | 21 | 45795833 | G | T | V297L | 0.00097 | 1306 |
| PML63 | TRPM2 | SNV het | 21 | 45815307 | T | C | V582A | 0.00724 | 1310 |
| PML64 | DNER | SNV het | 2 | 230231632 | C | T | D687N | 0.00058 | 1049 |
| PML64 | DNER | SNV het | 2 | 230450646 | T | A | T259S | 0.00692 | 1050 |
| PML64 | IDO2 | SNV het | 8 | 39862881 | C | T | R235W | 0.46108 | 1125 |
| PML64 | IDO2 | SNV het | 8 | 39862893 | T | A | S239T | 0.01135 | 1126 |
| PML65 | POLE | SNV het | 12 | 133201381 | T | A | I2228F | 0.00232 | 1210 |
| PML65 | POLE | SNV het | 12 | 133253971 | C | T | R233Q | 0.02037 | 1218 |
| PML66 | PKHD1 | SNV het | 6 | 51483961 | T | C | Q4048R | 0.50029 | 1104 |
| PML66 | PKHD1 | SNV het | 6 | 51612746 | G | A | S3223L | 0.00000 | 1110 |
| PML66 | PKHD1 | SNV het | 6 | 51712759 | T | C | T2641A | 0.04812 | 1111 |
| PML66 | EPG5 | SNV het | 18 | 43456296 | C | T | R1985Q | 0.07733 | 1271 |
| PML66 | EPG5 | SNV het | 18 | 43497710 | A | G | V1058A | 0.42740 | 1279 |
| PML68 | DCLRE1C | SNV het | 10 | 14974905 | T | C | H123R | 0.27332 | 1165 |
| PML68 | DCLRE1C | SNV het | 10 | 14976727 | G | C | P171R | 0.13896 | 1166 |
| PML72 | PSMB8 | SNV het | 6 | 32810794 | T | A | T70S | 0.04224 | 1102 |
| PML72 | PSMB8 | SNV het | 6 | 32811752 | C | T | G8R | 0.04845 | 1103 |
| PML72 | POLE | SNV het | 12 | 133220526 | T | C | N1369S | 0.24889 | 1213 |
| PML72 | POLE | SNV het | 12 | 133245026 | G | A | P477S | 0.02332 | 1216 |
| PML72 | RBFOX1 | SNV het | 16 | 7568296 | C | T | P102S | 0.00692 | 1242 |
| PML72 | RBFOX1 | SNV het | 16 | 7703891 | A | G | T235A | novel | 1243 |

Table 9 lists, for each case (in multiple rows), variants for which it was not possible, using the whole exome sequencing (WES) data available, to determine phase (i.e., whether two variants are in cis—on the same chromosome—or trans—on opposite chromosomes). Determining phase is an important consideration when dealing with disorders that are being evaluated on an autosomal recessive (AR) basis. If two variants are known to be present but it is impossible to determine whether they are in cis or trans, then it is impossible to conclude that both gene copies are affected, as opposed to only one (albeit with 2 variants). This problem does not arise in the case of homozygous variants, for which it is obvious that the variants must be in trans (i.e., it is only an issue for non-identical variants). All genome coordinates are based on hg19 build.

In summary, Table 9 lists all unphased case-level compound heterozygous SNV solutions, which might represent further case-level solutions, were phasing to have been possible. Furthermore, it can be appreciated by those skilled in the art that unphased solutions reported in Table 9 (2 het SNVs per gene) or Table 10 (see below, which reports het SNVs in patients that also have a CNV reported in Table 1) can potentially cause or contribute to the patient's PML if follow up genetic analysis reveals the pair of variants are on different alleles (i.e., each gene copy impacted by a variant). Variants reported in Tables 1, 9, or 10 may also be found to be significantly deleterious on their own (e.g., in functional studies on patient-derived cells, animal models, etc.) and thus constitute an AD model solution (i.e., genes presently listed as 'AR' model in Table 6) may be causal or contributing to disease via an AD or AR model, like several genes already known to be AD or AR (Table 6, 'AD_AR' disease model).

TABLE 10

SNVs found in genes suspected of being impacted by acquired CNVs

| Sample_ID | RefSeq Gene Symbol | Variant Type | Chr | Position | Ref Allele | Alt Allele | Amino Acid Change | Variant Frequency Details (Ethnic specific) | SEQ ID NO |
|---|---|---|---|---|---|---|---|---|---|
| MVGS811-13a | NRIP1 | SNV het | 21 | 16338814 | T | C | N567S | 0.00060 | 1301 |
| MVGS995-4a | VWA2 | SNV het | 10 | 116045796 | G | A | V366M | 0.02392 | 1173 |
| PML01 | PKHD1 | SNV het | 6 | 51497503 | C | A | R3842L | 0.04707 | 1107 |
| PML01 | PKHD1 | SNV het | 6 | 51483961 | T | C | Q4048R | 0.49837 | 1104 |
| PML02 | DUSP16 | SNV het | 12 | 12673965 | G | A | T23M | 0.00015 | 1199 |
| PML39 | SALL2 | SNV het | 14 | 22004996 | G | T | S13R | 0.00231 | 1225 |
| PML51 | JMY | SNV het | 5 | 78596018 | G | C | D524H | novel | 1086 |
| PML65 | SALL2 | SNV het | 14 | 21992397 | T | C | S347G | 0.07709 | 1223 |

NOTE:
These are het SNVs that are potentially compound heterozygotes with a CNV on the allele. See text for description.
The DUSP16 SNV (chr12: 12673965) was in trans with a chr12 deletion of DUSP16 in this patient (PML02), whose primary diagnosis was lymphoma.

Table 10 is a list of all heterozygous SNVs that are potentially compound heterozygotes with a CNV on the allele. See text for a fuller explanation. All genome coordinates are based on hg19 build.

TABLE 11

Key that maps Sample_ID for the PML cases to the PML_Case_ID numbers

| Sample_ID | PML_Case_ID |
|---|---|
| MVGS1116-8a | 3006 |
| MVGS1359 | 3117 |
| MVGS1368 | 3118 |
| MVGS540-374b | 3005 |
| MVGS540-393b | 3004 |
| MVGS694-6a | 3007 |
| MVGS811-13a | 3009 |
| MVGS995-4a | 3010 |
| PML01 | 3127 |
| PML02 | 3126 |
| PML03 | 3155 |
| PML04 | 3156 |
| PML05 | 3125 |
| PML06 | 3124 |
| PML09 | 3132 |
| PML10 | 3157 |
| PML12 | 3159 |
| PML13 | 3160 |
| PML14 | 3161 |
| PML15 | 3194 |
| PML16 | 3163 |
| PML17 | 3140 |
| PML18 | 3141 |
| PML19 | 3164 |
| PML20 | 3143 |
| PML21 | 3144 |
| PML22 | 3145 |
| PML23 | 3165 |
| PML25 | 3166 |
| PML26 | 3167 |
| PML27 | 3168 |
| PML28 | 3151 |
| PML29 | 3152 |
| PML30 | 3153 |
| PML31 | 3154 |
| PML32 | 3169 |
| PML33 | 3170 |
| PML35 | 3171 |
| PML36 | 3172 |
| PML37 | 3173 |
| PML38 | 3174 |
| PML39 | 3175 |
| PML40 | 3273 |
| PML41 | 3177 |
| PML43 | 3178 |
| PML44 | 3179 |
| PML45 | 3180 |
| PML46 | 3196 |
| PML48 | 3197 |
| PML49 | 3183 |
| PML50 | 3198 |
| PML51 | 3185 |
| PML52 | 3186 |
| PML53 | 3187 |
| PML54 | 3188 |
| PML55 | 3189 |
| PML56 | 3190 |
| PML57 | 3191 |
| PML58 | 3192 |
| PML59 | 3193 |
| PML60 | 3199 |
| PML61 | 3200 |
| PML62 | 3201 |
| PML63 | 3202 |
| PML64 | 3203 |
| PML65 | 3204 |
| PML66 | 3205 |
| PML67 | 3277 |
| PML68 | 3278 |
| PML69 | 3279 |
| PML72 | 3282 |
| PML70_control | 3280 |
| PML71_control | 3281 |
| PML73_control | 3283 |
| PML74_control | 3284 |
| PML75_control | 3285 |
| PML76_control | 3286 |

Table 11 provides the Sample_ID and PML_Case_ID (experimental ID for CGH data) for 77 'PML cases' (includes 6 non-PML HIV cases listed as controls).

TABLE 12

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| ACADM | NM_000016 | Homo sapiens acyl-CoA dehydrogenase, C-4 to C-12 straight chain (ACADM), transcript variant 1, mRNA. | 1500 |
| ACADM | NM_001127328 | Homo sapiens atypical chemokine receptor 1 (Duffy blood group) (ACKR1), transcript variant 1, mRNA. | 1501 |
| ACKR1 | NM_002036 | Homo sapiens atypical chemokine receptor 1 (Duffy blood group) (ACKR1), transcript variant 2, mRNA. | 1502 |
| ACKR1 | NM_001122951 | Homo sapiens atypical chemokine receptor 1 isoform a | 1503 |
| ACP5 | NM_001611 | Homo sapiens acid phosphatase 5, tartrate resistant (ACP5), transcript variant 4, mRNA. | 1504 |
| ACP5 | NM_001111034 | Homo sapiens acid phosphatase 5, tartrate resistant (ACP5), transcript variant 2, mRNA. | 1505 |
| ACP5 | NM_001111035 | Homo sapiens acid phosphatase 5, tartrate resistant (ACP5), transcript variant 1, mRNA. | 1506 |
| ACP5 | NM_001111036 | Homo sapiens acid phosphatase 5, tartrate resistant (ACP5), transcript variant 3, mRNA. | 1507 |
| ADAR | NM_001111 | Homo sapiens adenosine deaminase, RNA-specific (ADAR), transcript variant 1, mRNA. | 1508 |
| ADAR | NM_015840 | Homo sapiens adenosine deaminase, RNA-specific (ADAR), transcript variant 2, mRNA. | 1509 |
| ADAR | NM_015841 | Homo sapiens adenosine deaminase, RNA-specific (ADAR), transcript variant 3, mRNA. | 1510 |
| ADAR | NM_001025107 | Homo sapiens adenosine deaminase, RNA-specific (ADAR), transcript variant 4, mRNA. | 1511 |
| ADAR | NM_001193495 | Homo sapiens adenosine deaminase, RNA-specific (ADAR), transcript variant 5, mRNA. | 1512 |
| ADK | NM_001202450 | Homo sapiens adenosine kinase (ADK), transcript variant 4, mRNA. | 1513 |
| ADK | NM_006721 | Homo sapiens adenosine kinase (ADK), transcript variant 2, mRNA. | 1514 |
| ADK | NM_001123 | Homo sapiens adenosine kinase (ADK), transcript variant 1, mRNA. | 1515 |
| ADK | NM_001202449 | Homo sapiens adenosine kinase (ADK), transcript variant 3, mRNA. | 1516 |

TABLE 12-continued

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| AICDA | NM_020661 | *Homo sapiens* activation-induced cytidine deaminase (AICDA), mRNA. | 1517 |
| AK2 | NM_001199199 | *Homo sapiens* adenylate kinase 2 (AK2), transcript variant 3, mRNA. | 1518 |
| AK2 | NM_013411 | *Homo sapiens* adenylate kinase 2 (AK2), transcript variant 2, mRNA. | 1519 |
| AK2 | NM_001625 | *Homo sapiens* adenylate kinase 2 (AK2), transcript variant 1, mRNA. | 1520 |
| ALG12 | NM_024105 | *Homo sapiens* ALG12, alpha-1,6-mannosyltransferase (ALG12), mRNA. | 1521 |
| ALPL | NM_000478 | *Homo sapiens* alkaline phosphatase, liver/bone/kidney (ALPL), transcript variant 1, mRNA. | 1522 |
| ALPL | NM_001127501 | *Homo sapiens* alkaline phosphatase, liver/bone/kidney (ALPL), transcript variant 2, mRNA. | 1523 |
| ALPL | NM_001177520 | *Homo sapiens* alkaline phosphatase, liver/bone/kidney (ALPL), transcript variant 3, mRNA. | 1524 |
| AP3B1 | NM_001271769 | *Homo sapiens* adaptor related protein complex 3 beta 1 subunit (AP3B1), transcript variant 2, mRNA. | 1525 |
| AP3B1 | NM_003664 | *Homo sapiens* adaptor related protein complex 3 beta 1 subunit (AP3B1), transcript variant 1, mRNA. | 1526 |
| AP3B2 | NM_004644 | *Homo sapiens* adaptor-related protein complex 3, beta 2 subunit (AP3B2), transcript variant 2, mRNA. | 1527 |
| AP3D1 | NM_003938 | *Homo sapiens* adaptor-related protein complex 3, delta 1 subunit (AP3D1), transcript variant 2, mRNA. | 1528 |
| AP3D1 | NM_001261826 | *Homo sapiens* adaptor-related protein complex 3, delta 1 subunit (AP3D1), transcript variant 3, mRNA. | 1529 |
| APOL1 | NM_001136540 | *Homo sapiens* apolipoprotein L1 (APOL1), transcript variant 3, mRNA. | 1530 |
| APOL1 | NM_001136541 | *Homo sapiens* apolipoprotein L1 (APOL1), transcript variant 4, mRNA. | 1531 |
| APOL1 | NM_003661 | *Homo sapiens* apolipoprotein L1 (APOL1), transcript variant 1, mRNA. | 1532 |
| APOL1 | NM_145343 | *Homo sapiens* apolipoprotein L1 (APOL1), transcript variant 2, mRNA. | 1533 |
| ASH1L | NM_018489 | *Homo sapiens* ASH1 like histone lysine methyltransferase (ASH1L), mRNA. | 1534 |
| ATL2 | NM_001135673 | *Homo sapiens* atlastin GTPase 2 (ATL2), transcript variant 2, mRNA. | 1535 |
| ATL2 | NM_022374 | *Homo sapiens* atlastin GTPase 2 (ATL2), transcript variant 1, mRNA. | 1536 |
| ATL2 | NR_024191 | *Homo sapiens* atlastin GTPase 2 (ATL2), transcript variant 3, non-coding RNA. | 1537 |
| ATM | NM_000051 | *Homo sapiens* ATM serine/threonine kinase (ATM), mRNA. | 1538 |
| ATR | NM_001184 | *Homo sapiens* ATR serine/threonine kinase (ATR), mRNA. | 1539 |
| BACH2 | NM_001170794 | *Homo sapiens* BTB domain and CNC homolog 2 (BACH2), transcript variant 2, mRNA. | 1540 |
| BACH2 | NM_021813 | *Homo sapiens* BTB domain and CNC homolog 2 (BACH2), transcript variant 1, mRNA. | 1541 |
| BAG3 | NM_004281 | *Homo sapiens* BCL2 associated athanogene 3 (BAG3), mRNA. | 1542 |
| BCL10 | NM_003921 | *Homo sapiens* B-cell CLL/lymphoma 10 (BCL10), transcript variant 1, mRNA. | 1543 |
| BLM | NM_000057 | *Homo sapiens* Bloom syndrome RecQ like helicase (BLM), transcript variant 1, mRNA. | 1544 |
| BLNK | NM_001114094 | *Homo sapiens* B-cell linker (BLNK), transcript variant 2, mRNA. | 1545 |
| BLNK | NM_001258440 | *Homo sapiens* B-cell linker (BLNK), transcript variant 3, mRNA. | 1546 |
| BLNK | NM_001258441 | *Homo sapiens* B-cell linker (BLNK), transcript variant 4, mRNA. | 1547 |
| BLNK | NM_001258442 | *Homo sapiens* B-cell linker (BLNK), transcript variant 5, mRNA. | 1548 |
| BLNK | NM_013314 | *Homo sapiens* B-cell linker (BLNK), transcript variant 1, mRNA. | 1549 |
| BLNK | NR_047680 | *Homo sapiens* B-cell linker (BLNK), transcript variant 6, non-coding RNA. | 1550 |
| BLNK | NR_047681 | *Homo sapiens* B-cell linker (BLNK), transcript variant 7, non-coding RNA. | 1551 |
| BLNK | NR_047682 | *Homo sapiens* B-cell linker (BLNK), transcript variant 8, non-coding RNA. | 1552 |
| BLNK | NR_047683 | *Homo sapiens* B-cell linker (BLNK), transcript variant 9, non-coding RNA. | 1553 |
| BLOC1S6 | NM_012388 | *Homo sapiens* biogenesis of lysosomal organelles complex 1 subunit 6 (BLOC1S6), transcript variant 2, mRNA. | 1554 |
| BTK | NM_000061 | *Homo sapiens* Bruton tyrosine kinase (BTK), transcript variant 1, mRNA. | 1555 |
| C11orf65 | NM_152587 | *Homo sapiens* chromosome 11 open reading frame 65 (C11orf65), mRNA. | 1556 |
| C1QA | NM_015991 | *Homo sapiens* complement component 1, q subcomponent, A chain (C1QA), mRNA. | 1557 |
| C1QB | NM_000491 | *Homo sapiens* complement component 1, q subcomponent, B chain (C1QB), mRNA. | 1558 |
| C1QC | NM_001114101 | *Homo sapiens* complement component 1, q subcomponent, C chain (C1QC), transcript variant 1, mRNA. | 1559 |
| C1QC | NM_172369 | *Homo sapiens* complement component 1, q subcomponent, C chain (C1QC), transcript variant 2, mRNA. | 1560 |
| C5AR1 | NM_001736 | *Homo sapiens* complement component 5a receptor 1 (C5AR1), mRNA. | 1561 |
| CARD11 | NM_032415 | *Homo sapiens* caspase recruitment domain family member 11 (CARD11), transcript variant 2, mRNA. | 1562 |
| CARD9 | NM_052813 | *Homo sapiens* caspase recruitment domain family, member 9 (CARD9), transcript variant 1, mRNA. | 1563 |
| CARD9 | NM_052814 | *Homo sapiens* caspase recruitment domain family, member 9 (CARD9), transcript variant 2, mRNA. | 1564 |
| CASP8 | NM_001080124 | *Homo sapiens* caspase 8 (CASP8), transcript variant F, mRNA. | 1565 |
| CASP8 | NM_001228 | *Homo sapiens* caspase 8 (CASP8), transcript variant A, mRNA. | 1566 |
| CASP8 | NM_033355 | *Homo sapiens* caspase 8 (CASP8), transcript variant B, mRNA. | 1567 |
| CASP8 | NM_033358 | *Homo sapiens* caspase 8 (CASP8), transcript variant E, mRNA. | 1568 |
| CASP8 | NM_001080125 | *Homo sapiens* caspase 8 (CASP8), transcript variant G, mRNA. | 1569 |
| CASP8 | NM_033356 | *Homo sapiens* caspase 8 (CASP8), transcript variant C, mRNA. | 1570 |
| CCL11 | NM_002986 | *Homo sapiens* C-C motif chemokine ligand 11 (CCL11), mRNA. | 1571 |
| CCL2 | NM_002982 | *Homo sapiens* C-C motif chemokine ligand 2 (CCL2), mRNA. | 1572 |
| CCL5 | NM_002985 | *Homo sapiens* C-C motif chemokine ligand 5 (CCL5), transcript variant 1, mRNA. | 1573 |
| CCR2 | NM_001123041 | *Homo sapiens* C-C motif chemokine receptor 2 (CCR2), transcript variant A, mRNA. | 1574 |
| CCR2 | NM_001123396 | *Homo sapiens* C-C motif chemokine receptor 2 (CCR2), transcript variant B, mRNA. | 1575 |
| CCR5 | NM_000579 | *Homo sapiens* C-C motif chemokine receptor 5 (gene/pseudogene) (CCR5), transcript variant A, mRNA. | 1576 |
| CCR5 | NM_001100168 | *Homo sapiens* C-C motif chemokine receptor 5 (gene/pseudogene) (CCR5), transcript variant B, mRNA. | 1577 |

TABLE 12-continued

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| CD180 | NM_005582 | *Homo sapiens* CD180 molecule (CD180), mRNA. | 1578 |
| CD19 | NM_001178098 | *Homo sapiens* CD19 molecule (CD19), transcript variant 1, mRNA. | 1579 |
| CD19 | NM_001770 | *Homo sapiens* CD19 molecule (CD19), transcript variant 2, mRNA. | 1580 |
| CD209 | NM_001144893 | *Homo sapiens* CD209 molecule (CD209), transcript variant 5, mRNA. | 1581 |
| CD209 | NM_001144894 | *Homo sapiens* CD209 molecule (CD209), transcript variant 6, mRNA. | 1582 |
| CD209 | NM_001144895 | *Homo sapiens* CD209 molecule (CD209), transcript variant 7, mRNA. | 1583 |
| CD209 | NM_001144896 | *Homo sapiens* CD209 molecule (CD209), transcript variant 3, mRNA. | 1584 |
| CD209 | NM_001144897 | *Homo sapiens* CD209 molecule (CD209), transcript variant 4, mRNA. | 1585 |
| CD209 | NM_001144899 | *Homo sapiens* CD209 molecule (CD209), transcript variant 8, mRNA. | 1586 |
| CD209 | NM_021155 | *Homo sapiens* CD209 molecule (CD209), transcript variant 1, mRNA. | 1587 |
| CD209 | NR_026692 | *Homo sapiens* CD209 molecule (CD209), transcript variant 2, non-coding RNA. | 1588 |
| CD247 | NM_000734 | *Homo sapiens* CD247 molecule (CD247), transcript variant 2, mRNA. | 1589 |
| CD247 | NM_198053 | *Homo sapiens* CD247 molecule (CD247), transcript variant 1, mRNA. | 1590 |
| CD27 | NM_001242 | *Homo sapiens* CD27 molecule (CD27), mRNA. | 1591 |
| CD27-AS1 | NR_015382 | *Homo sapiens* CD27 antisense RNA 1 (CD27-AS1), long non-coding RNA. | 1592 |
| CD34 | NM_001025109 | *Homo sapiens* CD34 molecule (CD34), transcript variant 1, mRNA. | 1593 |
| CD34 | NM_001773 | *Homo sapiens* CD34 molecule (CD34), transcript variant 2, mRNA. | 1594 |
| CD3D | NM_000732 | *Homo sapiens* CD3d molecule (CD3D), transcript variant 1, mRNA. | 1595 |
| CD3D | NM_001040651 | *Homo sapiens* CD3d molecule (CD3D), transcript variant 2, mRNA. | 1596 |
| CD3E | NM_000733 | *Homo sapiens* CD3e molecule (CD3E), mRNA. | 1597 |
| CD3G | NM_000073 | *Homo sapiens* CD3g molecule (CD3G), mRNA. | 1598 |
| CD40 | NM_001250 | *Homo sapiens* CD40 molecule (CD40), transcript variant 1, mRNA. | 1599 |
| CD40 | NM_152854 | *Homo sapiens* CD40 molecule (CD40), transcript variant 2, mRNA. | 1600 |
| CD40LG | NM_000074 | *Homo sapiens* CD40 ligand (CD40LG), mRNA. | 1601 |
| CD55 | NM_000574 | *Homo sapiens* CD55 molecule (Cromer blood group) (CD55), transcript variant 1, mRNA. | 1602 |
| CD55 | NM_001114752 | *Homo sapiens* CD55 molecule (Cromer blood group) (CD55), transcript variant 2, mRNA. | 1603 |
| CD59 | NM_000611 | *Homo sapiens* CD59 molecule (CD59), transcript variant 2, mRNA. | 1604 |
| CD59 | NM_001127223 | *Homo sapiens* CD59 molecule (CD59), transcript variant 5, mRNA. | 1605 |
| CD59 | NM_001127225 | *Homo sapiens* CD59 molecule (CD59), transcript variant 6, mRNA. | 1606 |
| CD59 | NM_001127226 | *Homo sapiens* CD59 molecule (CD59), transcript variant 7, mRNA. | 1607 |
| CD59 | NM_001127227 | *Homo sapiens* CD59 molecule (CD59), transcript variant 8, mRNA. | 1608 |
| CD59 | NM_203329 | *Homo sapiens* CD59 molecule (CD59), transcript variant 3, mRNA. | 1609 |
| CD59 | NM_203330 | *Homo sapiens* CD59 molecule (CD59), transcript variant 1, mRNA. | 1610 |
| CD59 | NM_203331 | *Homo sapiens* CD59 molecule (CD59), transcript variant 4, mRNA. | 1611 |
| CD79A | NM_001783 | *Homo sapiens* CD79a molecule (CD79A), transcript variant 1, mRNA. | 1612 |
| CD79A | NM_021601 | *Homo sapiens* CD79a molecule (CD79A), transcript variant 2, mRNA. | 1613 |
| CD79B | NM_000626 | *Homo sapiens* CD79b molecule (CD79B), transcript variant 1, mRNA. | 1614 |
| CD79B | NM_001039933 | *Homo sapiens* CD79b molecule (CD79B), transcript variant 3, mRNA. | 1615 |
| CD79B | NM_021602 | *Homo sapiens* CD79b molecule (CD79B), transcript variant 2, mRNA. | 1616 |
| CD81 | NM_004356 | *Homo sapiens* CD81 molecule (CD81), transcript variant 1, mRNA. | 1617 |
| CD8A | NM_001145873 | *Homo sapiens* CD8a molecule (CD8A), transcript variant 3, mRNA. | 1618 |
| CD8A | NM_001768 | *Homo sapiens* CD8a molecule (CD8A), transcript variant 1, mRNA. | 1619 |
| CD8A | NM_171827 | *Homo sapiens* CD8a molecule (CD8A), transcript variant 2, mRNA. | 1620 |
| CD8A | NR_027353 | *Homo sapiens* CD8a molecule (CD8A), transcript variant 4, non-coding RNA. | 1621 |
| CDCA7 | NM_031942 | *Homo sapiens* cell division cycle associated 7 (CDCA7), transcript variant 1, mRNA. | 1622 |
| CDCA7 | NM_145810 | *Homo sapiens* cell division cycle associated 7 (CDCA7), transcript variant 2, mRNA. | 1623 |
| CEBPB | NM_005194 | *Homo sapiens* CCAAT/enhancer binding protein beta (CEBPB), transcript variant 1, mRNA. | 1624 |
| CHD7 | NM_017780 | *Homo sapiens* chromodomain helicase DNA binding protein 7 (CHD7), transcript variant 1, mRNA. | 1625 |
| CHEK1 | NM_001114121 | *Homo sapiens* checkpoint kinase 1 (CHEK1), transcript variant 2, mRNA. | 1626 |
| CHEK1 | NM_001114122 | *Homo sapiens* checkpoint kinase 1 (CHEK1), transcript variant 1, mRNA. | 1627 |
| CHEK1 | NM_001244846 | *Homo sapiens* checkpoint kinase 1 (CHEK1), transcript variant 4, mRNA. | 1628 |
| CHEK1 | NR_045204 | *Homo sapiens* checkpoint kinase 1 (CHEK1), transcript variant 5, non-coding RNA. | 1629 |
| CHEK1 | NR_045205 | *Homo sapiens* checkpoint kinase 1 (CHEK1), transcript variant 6, non-coding RNA. | 1630 |
| CHEK1 | NM_001274 | *Homo sapiens* checkpoint kinase 1 (CHEK1), transcript variant 3, mRNA. | 1631 |
| CIITA | NM_000246 | *Homo sapiens* class II major histocompatibility complex transactivator (CIITA), transcript variant 2, mRNA. | 1632 |
| CLCN7 | NM_001114331 | *Homo sapiens* chloride channel, voltage-sensitive 7 (CLCN7), transcript variant 2, mRNA. | 1633 |
| CLCN7 | NM_001287 | *Homo sapiens* chloride channel, voltage-sensitive 7 (CLCN7), transcript variant 1, mRNA. | 1634 |
| COG6 | NM_001145079 | *Homo sapiens* component of oligomeric golgi complex 6 (COG6), transcript variant 2, mRNA. | 1635 |
| COG6 | NM_020751 | *Homo sapiens* component of oligomeric golgi complex 6 (COG6), transcript variant 1, mRNA. | 1636 |
| COG6 | NR_026745 | *Homo sapiens* component of oligomeric golgi complex 6 (COG6), transcript variant 3, non-coding RNA. | 1637 |
| CORO1A | NM_001193333 | *Homo sapiens* coronin 1A (CORO1A), transcript variant 1, mRNA. | 1638 |
| CORO1A | NM_007074 | *Homo sapiens* coronin 1A (CORO1A), transcript variant 2, mRNA. | 1639 |
| CR2 | NM_001006658 | *Homo sapiens* complement component 3d receptor 2 (CR2), transcript variant 1, mRNA. | 1640 |
| CR2 | NM_001877 | *Homo sapiens* complement component 3d receptor 2 (CR2), transcript variant 2, mRNA. | 1641 |
| CRTC3 | NM_001042574 | *Homo sapiens* CREB regulated transcription coactivator 3 (CRTC3), transcript variant 2, mRNA. | 1642 |
| CRTC3 | NM_022769 | *Homo sapiens* CREB regulated transcription coactivator 3 (CRTC3), transcript variant 1, mRNA. | 1643 |

TABLE 12-continued

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| CSF3R | NM_000760 | *Homo sapiens* colony stimulating factor 3 receptor (granulocyte) (CSF3R), transcript variant 1, mRNA. | 1644 |
| CSF3R | NM_156039 | *Homo sapiens* colony stimulating factor 3 receptor (granulocyte) (CSF3R), transcript variant 3, mRNA. | 1645 |
| CSF3R | NM_172313 | *Homo sapiens* colony stimulating factor 3 receptor (granulocyte) (CSF3R), transcript variant 4, mRNA. | 1646 |
| CTLA4 | NM_005214 | *Homo sapiens* cytotoxic T-lymphocyte-associated protein 4 (CTLA4), transcript variant 1, mRNA. | 1647 |
| CTLA4 | NM_001037631 | *Homo sapiens* cytotoxic T-lymphocyte-associated protein 4 (CTLA4), transcript variant 2, mRNA. | 1648 |
| CTPS1 | NM_001905 | *Homo sapiens* CTP synthase 1 (CTPS1), transcript variant 1, mRNA. | 1649 |
| CTSC | NM_148170 | *Homo sapiens* cathepsin C (CTSC), transcript variant 2, mRNA. | 1650 |
| CTSC | NM_001114173 | *Homo sapiens* cathepsin C (CTSC), transcript variant 3, mRNA. | 1651 |
| CTSC | NM_001814 | *Homo sapiens* cathepsin C (CTSC), transcript variant 1, mRNA. | 1652 |
| CX3CR1 | NM_001171171 | *Homo sapiens* C—X3—C motif chemokine receptor 1 (CX3CR1), transcript variant 2, mRNA. | 1653 |
| CX3CR1 | NM_001171172 | *Homo sapiens* C—X3—C motif chemokine receptor 1 (CX3CR1), transcript variant 3, mRNA. | 1654 |
| CX3CR1 | NM_001171174 | *Homo sapiens* C—X3—C motif chemokine receptor 1 (CX3CR1), transcript variant 1, mRNA. | 1655 |
| CX3CR1 | NM_001337 | *Homo sapiens* C—X3—C motif chemokine receptor 1 (CX3CR1), transcript variant 4, mRNA. | 1656 |
| CXCL12 | NM_000609 | *Homo sapiens* C—X—C motif chemokine ligand 12 (CXCL12), transcript variant 2, mRNA. | 1657 |
| CXCL12 | NM_001033886 | *Homo sapiens* C—X—C motif chemokine ligand 12 (CXCL12), transcript variant 3, mRNA. | 1658 |
| CXCL12 | NM_001178134 | *Homo sapiens* C—X—C motif chemokine ligand 12 (CXCL12), transcript variant 4, mRNA. | 1659 |
| CXCL12 | NM_199168 | *Homo sapiens* C—X—C motif chemokine ligand 12 (CXCL12), transcript variant 1, mRNA. | 1660 |
| CXCL9 | NM_002416 | *Homo sapiens* C—X—C motif chemokine ligand 9 (CXCL9), mRNA. | 1661 |
| CXCR1 | NM_000634 | *Homo sapiens* C—X—C motif chemokine receptor 1 (CXCR1), mRNA. | 1662 |
| CXCR4 | NM_001008540 | *Homo sapiens* C—X—C motif chemokine receptor 4 (CXCR4), transcript variant 1, mRNA. | 1663 |
| CXCR4 | NM_003467 | *Homo sapiens* C—X—C motif chemokine receptor 4 (CXCR4), transcript variant 2, mRNA. | 1664 |
| CXorf40A | NM_001171907 | *Homo sapiens* chromosome X open reading frame 40A (CXorf40A), transcript variant 2, mRNA. | 1665 |
| CXorf40A | NM_001171908 | *Homo sapiens* chromosome X open reading frame 40A (CXorf40A), transcript variant 3, mRNA. | 1666 |
| CXorf40A | NM_178124 | *Homo sapiens* chromosome X open reading frame 40A (CXorf40A), transcript variant 1, mRNA. | 1667 |
| CXorf40A | NM_001171909 | *Homo sapiens* chromosome X open reading frame 40A (CXorf40A), transcript variant 4, mRNA. | 1668 |
| CYBB | NM_000397 | *Homo sapiens* cytochrome b-245, beta polypeptide (CYBB), mRNA. | 1669 |
| CYP2S1 | NM_030622 | *Homo sapiens* cytochrome P450 family 2 subfamily S member 1 (CYP2S1), mRNA. | 1670 |
| DCLRE1C | NM_001033855 | *Homo sapiens* DNA cross-link repair 1C (DCLRE1C), transcript variant a, mRNA. | 1671 |
| DCLRE1C | NM_001033857 | *Homo sapiens* DNA cross-link repair 1C (DCLRE1C), transcript variant d, mRNA. | 1672 |
| DCLRE1C | NM_001033858 | *Homo sapiens* DNA cross-link repair 1C (DCLRE1C), transcript variant c, mRNA. | 1673 |
| DCLRE1C | NM_022487 | *Homo sapiens* DNA cross-link repair 1C (DCLRE1C), transcript variant b, mRNA. | 1674 |
| DDX1 | NM_004939 | *Homo sapiens* DEAD/H-box helicase 1 (DDX1), mRNA. | 1675 |
| DDX58 | NM_014314 | *Homo sapiens* DEAD (Asp-Glu-Ala-Asp) box polypeptide 58 (DDX58), mRNA. | 1676 |
| DHX58 | NM_024119 | *Homo sapiens* DEXH (Asp-Glu-X-His) box polypeptide 58 (DHX58), mRNA. | 1677 |
| DKC1 | NM_001142463 | *Homo sapiens* dyskerin pseudouridine synthase 1 (DKC1), transcript variant 2, mRNA. | 1678 |
| DKC1 | NM_001363 | *Homo sapiens* dyskerin pseudouridine synthase 1 (DKC1), transcript variant 1, mRNA. | 1679 |
| DNMT3B | NM_001207055 | *Homo sapiens* DNA methyltransferase 3 beta (DNMT3B), transcript variant 7, mRNA. | 1680 |
| DNMT3B | NM_001207056 | *Homo sapiens* DNA methyltransferase 3 beta (DNMT3B), transcript variant 8, mRNA. | 1681 |
| DNMT3B | NM_006892 | *Homo sapiens* DNA methyltransferase 3 beta (DNMT3B), transcript variant 1, mRNA. | 1682 |
| DNMT3B | NM_175848 | *Homo sapiens* DNA methyltransferase 3 beta (DNMT3B), transcript variant 2, mRNA. | 1683 |
| DNMT3B | NM_175849 | *Homo sapiens* DNA methyltransferase 3 beta (DNMT3B), transcript variant 3, mRNA. | 1684 |
| DNMT3B | NM_175850 | *Homo sapiens* DNA methyltransferase 3 beta (DNMT3B), transcript variant 6, mRNA. | 1685 |
| DOCK2 | NM_004946 | *Homo sapiens* dedicator of cytokinesis 2 (DOCK2), mRNA. | 1686 |
| DOCK8 | NM_203447 | *Homo sapiens* dedicator of cytokinesis 8 (DOCK8), transcript variant 1, mRNA. | 1687 |
| DOCK8 | NM_001190458 | *Homo sapiens* dedicator of cytokinesis 8 (DOCK8), transcript variant 2, mRNA. | 1688 |
| DOCK8 | NM_001193536 | *Homo sapiens* dedicator of cytokinesis 8 (DOCK8), transcript variant 3, mRNA. | 1689 |
| DSC1 | NM_004948 | *Homo sapiens* desmocollin 1 (DSC1), transcript variant Dsc1b, mRNA. | 1690 |
| DSC1 | NM_024421 | *Homo sapiens* desmocollin 1 (DSC1), transcript variant Dsc1a, mRNA. | 1691 |
| EGR1 | NM_001964 | *Homo sapiens* early growth response 1 (EGR1), mRNA. | 1692 |
| ELANE | NM_001972 | *Homo sapiens* elastase, neutrophil expressed (ELANE), mRNA. | 1693 |
| EPG5 | NM_020964 | *Homo sapiens* ectopic P-granules autophagy protein 5 homolog (EPG5), mRNA. | 1694 |
| ETF1 | NM_004730 | *Homo sapiens* eukaryotic translation termination factor 1 (ETF1), transcript variant 1, mRNA. | 1695 |
| F9 | NM_000133 | *Homo sapiens* coagulation factor IX (F9), transcript variant 1, mRNA. | 1696 |
| FAS | NM_000043 | *Homo sapiens* Fas cell surface death receptor (FAS), transcript variant 1, mRNA. | 1697 |
| FAS | NM_152871 | *Homo sapiens* Fas cell surface death receptor (FAS), transcript variant 2, mRNA. | 1698 |
| FAS | NM_152872 | *Homo sapiens* Fas cell surface death receptor (FAS), transcript variant 3, mRNA. | 1699 |
| FAS | NR_028033 | *Homo sapiens* Fas cell surface death receptor (FAS), transcript variant 4, non-coding RNA. | 1700 |
| FAS | NR_028034 | *Homo sapiens* Fas cell surface death receptor (FAS), transcript variant 5, non-coding RNA. | 1701 |
| FAS | NR_028035 | *Homo sapiens* Fas cell surface death receptor (FAS), transcript variant 6, non-coding RNA. | 1702 |
| FAS | NR_028036 | *Homo sapiens* Fas cell surface death receptor (FAS), transcript variant 7, non-coding RNA. | 1703 |

TABLE 12-continued

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| FASLG | NM_000639 | *Homo sapiens* Fas ligand (TNF superfamily, member 6) (FASLG), mRNA. | 1704 |
| FCGR2A | NM_001136219 | *Homo sapiens* Fc fragment of IgG receptor IIa (FCGR2A), transcript variant 1, mRNA. | 1705 |
| FCGR2A | NM_021642 | *Homo sapiens* Fc fragment of IgG receptor IIa (FCGR2A), transcript variant 2, mRNA. | 1706 |
| FCGR3A | NM_000569 | *Homo sapiens* Fc fragment of IgG receptor IIIa (FCGR3A), transcript variant 1, mRNA. | 1707 |
| FCGR3A | NM_001127592 | *Homo sapiens* Fc fragment of IgG receptor IIIa (FCGR3A), transcript variant 2, mRNA. | 1708 |
| FCGR3A | NM_001127593 | *Homo sapiens* Fc fragment of IgG receptor IIIa (FCGR3A), transcript variant 3, mRNA. | 1709 |
| FCGR3A | NM_001127595 | *Homo sapiens* Fc fragment of IgG receptor IIIa (FCGR3A), transcript variant 4, mRNA. | 1710 |
| FCGR3A | NM_001127596 | *Homo sapiens* Fc fragment of IgG receptor IIIa (FCGR3A), transcript variant 5, mRNA. | 1711 |
| FCN3 | NM_003665 | *Homo sapiens* ficolin 3 (FCN3), transcript variant 1, mRNA. | 1712 |
| FCN3 | NM_173452 | *Homo sapiens* ficolin 3 (FCN3), transcript variant 2, mRNA. | 1713 |
| FEZ1 | NM_005103 | *Homo sapiens* fasciculation and elongation protein zeta 1 (FEZ1), transcript variant 1, mRNA. | 1714 |
| FEZ1 | NM_022549 | *Homo sapiens* fasciculation and elongation protein zeta 1 (FEZ1), transcript variant 2, mRNA. | 1715 |
| FOS | NM_005252 | *Homo sapiens* Fos proto-oncogene, AP-1 transcription factor subunit (FOS), mRNA. | 1716 |
| FOXH1 | NM_003923 | *Homo sapiens* forkhead box H1 (FOXH1), mRNA. | 1717 |
| FOXN1 | NM_003593 | *Homo sapiens* forkhead box N1 (FOXN1), mRNA. | 1718 |
| FOXP3 | NM_001114377 | *Homo sapiens* forkhead box P3 (FOXP3), transcript variant 2, mRNA. | 1719 |
| FOXP3 | NM_014009 | *Homo sapiens* forkhead box P3 (FOXP3), transcript variant 1, mRNA. | 1720 |
| FPR1 | NM_001193306 | *Homo sapiens* formyl peptide receptor 1 (FPR1), transcript variant 1, mRNA. | 1721 |
| FPR1 | NM_002029 | *Homo sapiens* formyl peptide receptor 1 (FPR1), transcript variant 2, mRNA. | 1722 |
| G6PC3 | NM_138387 | *Homo sapiens* glucose 6 phosphatase, catalytic, 3 (G6PC3), transcript variant 1, mRNA. | 1723 |
| G6PC3 | NR_028582 | *Homo sapiens* glucose 6 phosphatase, catalytic, 3 (G6PC3), transcript variant 2, non-coding RNA. | 1724 |
| G6PC3 | NR_028581 | *Homo sapiens* glucose 6 phosphatase, catalytic, 3 (G6PC3), transcript variant 3, non-coding RNA. | 1725 |
| GATA2 | NM_001145661 | *Homo sapiens* GATA binding protein 2 (GATA2), transcript variant 1, mRNA. | 1726 |
| GATA2 | NM_001145662 | *Homo sapiens* GATA binding protein 2 (GATA2), transcript variant 3, mRNA. | 1727 |
| GATA2 | NM_032638 | *Homo sapiens* GATA binding protein 2 (GATA2), transcript variant 2, mRNA. | 1728 |
| GFI1 | NM_005263 | *Homo sapiens* growth factor independent 1 transcription repressor (GFI1), transcript variant 1, mRNA. | 1729 |
| GFI1 | NM_001127215 | *Homo sapiens* growth factor independent 1 transcription repressor (GFI1), transcript variant 2, mRNA. | 1730 |
| GFI1 | NM_001127216 | *Homo sapiens* growth factor independent 1 transcription repressor (GFI1), transcript variant 3, mRNA. | 1731 |
| GOLGB1 | NM_001256486 | *Homo sapiens* golgin B1 (GOLGB1), transcript variant 1, mRNA. | 1732 |
| GOLGB1 | NM_001256487 | *Homo sapiens* golgin B1 (GOLGB1), transcript variant 3, mRNA. | 1733 |
| GOLGB1 | NM_001256488 | *Homo sapiens* golgin B1 (GOLGB1), transcript variant 4, mRNA. | 1734 |
| GOLGB1 | NM_004487 | *Homo sapiens* golgin B1 (GOLGB1), transcript variant 2, mRNA. | 1735 |
| GPRC5A | NM_003979 | *Homo sapiens* G protein-coupled receptor class C group 5 member A (GPRC5A), mRNA. | 1736 |
| GRAP2 | NM_004810 | *Homo sapiens* GRB2-related adaptor protein 2 (GRAP2), mRNA. | 1737 |
| HAX1 | NM_006118 | *Homo sapiens* HCLS1 associated protein X-1 (HAX1), transcript variant 1, mRNA. | 1738 |
| HAX1 | NM_001018837 | *Homo sapiens* HCLS1 associated protein X-1 (HAX1), transcript variant 2, mRNA. | 1739 |
| HELLS | NM_018063 | *Homo sapiens* helicase, lymphoid-specific (HELLS), transcript variant 1, mRNA. | 1740 |
| HIVEP1 | NM_002114 | *Homo sapiens* human immunodeficiency virus type I enhancer binding protein 1 (HIVEP1), mRNA. | 1741 |
| HIVEP2 | NM_006734 | *Homo sapiens* human immunodeficiency virus type I enhancer binding protein 2 (HIVEP2), mRNA. | 1742 |
| HIVEP3 | NM_001127714 | *Homo sapiens* human immunodeficiency virus type I enhancer binding protein 3 (HIVEP3), transcript variant 2, mRNA. | 1743 |
| HIVEP3 | NM_024503 | *Homo sapiens* human immunodeficiency virus type I enhancer binding protein 3 (HIVEP3), transcript variant 1, mRNA. | 1744 |
| HIVEP3 | NR_038260 | *Homo sapiens* human immunodeficiency virus type I enhancer binding protein 3 (HIVEP3), transcript variant 3, non-coding RNA. | 1745 |
| HIVEP3 | NR_038261 | *Homo sapiens* human immunodeficiency virus type I enhancer binding protein 3 (HIVEP3), transcript variant 4, non-coding RNA. | 1746 |
| HP | NM_001126102 | *Homo sapiens* haptoglobin (HP), transcript variant 2, mRNA. | 1747 |
| HP | NM_005143 | *Homo sapiens* haptoglobin (HP), transcript variant 1, mRNA. | 1748 |
| HPCAL1 | NM_002149 | *Homo sapiens* hippocalcin like 1 (HPCAL1), transcript variant 1, mRNA. | 1749 |
| HPCAL1 | NM_134421 | *Homo sapiens* hippocalcin like 1 (HPCAL1), transcript variant 2, mRNA. | 1750 |
| HPCAL1 | NM_001258357 | *Homo sapiens* hippocalcin like 1 (HPCAL1), transcript variant 3, mRNA. | 1751 |
| HPCAL1 | NM_001258358 | *Homo sapiens* hippocalcin like 1 (HPCAL1), transcript variant 4, mRNA. | 1752 |
| HPCAL1 | NM_001258359 | *Homo sapiens* hippocalcin like 1 (HPCAL1), transcript variant 5, mRNA. | 1753 |
| HTR2A | NM_000621 | *Homo sapiens* 5-hydroxytryptamine receptor 2A (HTR2A), transcript variant 1, mRNA. | 1754 |
| HTR2A | NM_001165947 | *Homo sapiens* 5-hydroxytryptamine (serotonin) receptor 2A, G protein-coupled (HTR2A), transcript variant 2, mRNA. | 1755 |
| ICOS | NM_012092 | *Homo sapiens* inducible T-cell costimulator (ICOS), mRNA. | 1756 |
| IDI1 | NM_004508 | *Homo sapiens* isopentenyl-diphosphate delta isomerase 1 (IDI1), transcript variant 1, mRNA. | 1757 |
| IFIH1 | NM_022168 | *Homo sapiens* interferon induced with helicase C domain 1 (IFIH1), mRNA. | 1758 |
| IFNAR1 | NM_000629 | *Homo sapiens* interferon (alpha, beta and omega) receptor 1 (IFNAR1), mRNA. | 1759 |
| IFNAR2 | NM_207584 | *Homo sapiens* interferon (alpha, beta and omega) receptor 2 (IFNAR2), transcript variant 3, mRNA. | 1760 |
| IFNAR2 | NM_207585 | *Homo sapiens* interferon (alpha, beta and omega) receptor 2 (IFNAR2), transcript variant 1, mRNA. | 1761 |

TABLE 12-continued

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| IFNAR2 | NM_000874 | *Homo sapiens* interferon (alpha, beta and omega) receptor 2 (IFNAR2), transcript variant 2, mRNA. | 1762 |
| IFNG | NM_000619 | *Homo sapiens* interferon gamma (IFNG), mRNA. | 1763 |
| IFNGR1 | NM_000416 | *Homo sapiens* interferon gamma receptor 1 (IFNGR1), mRNA. | 1764 |
| IFNGR2 | NM_005534 | *Homo sapiens* interferon gamma receptor 2 (interferon gamma transducer 1) (IFNGR2), transcript variant 2, mRNA. | 1765 |
| IGLL1 | NM_020070 | *Homo sapiens* immunoglobulin lambda like polypeptide 1 (IGLL1), transcript variant 1, mRNA. | 1766 |
| IGLL1 | NM_152855 | *Homo sapiens* immunoglobulin lambda like polypeptide 1 (IGLL1), transcript variant 2, mRNA. | 1767 |
| IKBKB | NM_001190720 | *Homo sapiens* inhibitor of kappa light polypeptide gene enhancer in B-cells, kinase beta (IKBKB), transcript variant 2, mRNA. | 1768 |
| IKBKB | NM_001242778 | *Homo sapiens* inhibitor of kappa light polypeptide gene enhancer in B-cells, kinase beta (IKBKB), transcript variant 7, mRNA. | 1769 |
| IKBKB | NM_001556 | *Homo sapiens* inhibitor of kappa light polypeptide gene enhancer in B-cells, kinase beta (IKBKB), transcript variant 1, mRNA. | 1770 |
| IKBKB | NR_033818 | *Homo sapiens* inhibitor of kappa light polypeptide gene enhancer in B-cells, kinase beta (IKBKB), transcript variant 5, non-coding RNA. | 1771 |
| IKBKB | NR_033819 | *Homo sapiens* inhibitor of kappa light polypeptide gene enhancer in B-cells, kinase beta (IKBKB), transcript variant 6, non-coding RNA. | 1772 |
| IKBKB | NR_040009 | *Homo sapiens* inhibitor of kappa light polypeptide gene enhancer in B-cells, kinase beta (IKBKB), transcript variant 8, non-coding RNA. | 1773 |
| IKBKG | NM_001099856 | *Homo sapiens* inhibitor of kappa light polypeptide gene enhancer in B-cells, kinase gamma (IKBKG), transcript variant 2, mRNA. | 1774 |
| IKBKG | NM_001099857 | *Homo sapiens* inhibitor of kappa light polypeptide gene enhancer in B-cells, kinase gamma (IKBKG), transcript variant 1, mRNA. | 1775 |
| IKBKG | NM_001145255 | *Homo sapiens* inhibitor of kappa light polypeptide gene enhancer in B-cells, kinase gamma (IKBKG), transcript variant 4, mRNA. | 1776 |
| IKBKG | NM_003639 | *Homo sapiens* inhibitor of kappa light polypeptide gene enhancer in B-cells, kinase gamma (IKBKG), transcript variant 3, mRNA. | 1777 |
| IKZF1 | NM_001220765 | *Homo sapiens* IKAROS family zinc finger 1 (IKZF1), transcript variant 2, mRNA. | 1778 |
| IKZF1 | NM_001220767 | *Homo sapiens* IKAROS family zinc finger 1 (IKZF1), transcript variant 4, mRNA. | 1779 |
| IKZF1 | NM_001220768 | *Homo sapiens* IKAROS family zinc finger 1 (IKZF1), transcript variant 5, mRNA. | 1780 |
| IKZF1 | NM_001220770 | *Homo sapiens* IKAROS family zinc finger 1 (IKZF1), transcript variant 7, mRNA. | 1781 |
| IKZF1 | NM_001220771 | *Homo sapiens* IKAROS family zinc finger 1 (IKZF1), transcript variant 8, mRNA. | 1782 |
| IKZF1 | NM_006060 | *Homo sapiens* IKAROS family zinc finger 1 (IKZF1), transcript variant 1, mRNA. | 1783 |
| IL10 | NM_000572 | *Homo sapiens* interleukin 10 (IL10), mRNA. | 1784 |
| IL10RA | NM_001558 | *Homo sapiens* interleukin 10 receptor subunit alpha (IL10RA), transcript variant 1, mRNA. | 1785 |
| IL10RA | NR_026691 | *Homo sapiens* interleukin 10 receptor subunit alpha (IL10RA), transcript variant 2, non-coding RNA. | 1786 |
| IL10RB | NM_000628 | *Homo sapiens* interleukin 10 receptor subunit beta (1L10RB), mRNA. | 1787 |
| IL12B | NM_002187 | *Homo sapiens* interleukin 12B (IL12B), mRNA. | 1788 |
| IL12RB1 | NM_005535 | *Homo sapiens* interleukin 12 receptor subunit beta 1 (1L12RB1), transcript variant 1, mRNA. | 1789 |
| IL12RB1 | NM_153701 | *Homo sapiens* interleukin 12 receptor subunit beta 1 (1L12RB1), transcript variant 2, mRNA. | 1790 |
| IL17F | NM_052872 | *Homo sapiens* interleukin 17F (IL17F), mRNA. | 1791 |
| IL17RA | NM_014339 | *Homo sapiens* interleukin 17 receptor A (IL17RA), transcript variant 1, mRNA. | 1792 |
| IL1B | NM_000576 | *Homo sapiens* interleukin 1, beta (IL1B), mRNA. | 1793 |
| IL21 | NM_001207006 | *Homo sapiens* interleukin 21 (IL21), transcript variant 2, mRNA. | 1794 |
| IL21 | NM_021803 | *Homo sapiens* interleukin 21 (IL21), transcript variant 1, mRNA. | 1795 |
| IL21R | NM_181078 | *Homo sapiens* interleukin 21 receptor (IL21R), transcript variant 2, mRNA. | 1796 |
| IL21R | NM_181079 | *Homo sapiens* interleukin 21 receptor (IL21R), transcript variant 3, mRNA. | 1797 |
| IL21R | NM_021798 | *Homo sapiens* interleukin 21 receptor (IL21R), transcript variant 1, mRNA. | 1798 |
| IL2RA | NM_000417 | *Homo sapiens* interleukin 2 receptor, alpha (IL2RA), transcript variant 1, mRNA. | 1799 |
| IL2RG | NM_000206 | *Homo sapiens* interleukin 2 receptor subunit gamma (IL2RG), mRNA. | 1800 |
| IL4R | NM_000418 | *Homo sapiens* interleukin 4 receptor (IL4R), transcript variant 1, mRNA. | 1801 |
| IL4R | NM_001257406 | *Homo sapiens* interleukin 4 receptor (IL4R), transcript variant 3, mRNA. | 1802 |
| IL4R | NM_001257407 | *Homo sapiens* interleukin 4 receptor (IL4R), transcript variant 4, mRNA. | 1803 |
| IL4R | NM_001257997 | *Homo sapiens* interleukin 4 receptor (IL4R), transcript variant 5, mRNA. | 1804 |
| IL7 | NM_000880 | *Homo sapiens* interleukin 7 (IL7), transcript variant 1, mRNA. | 1805 |
| IL7 | NM_001199886 | *Homo sapiens* interleukin 7 (IL7), transcript variant 2, mRNA. | 1806 |
| IL7 | NM_001199887 | *Homo sapiens* interleukin 7 (IL7), transcript variant 3, mRNA. | 1807 |
| IL7 | NM_001199888 | *Homo sapiens* interleukin 7 (IL7), transcript variant 4, mRNA. | 1808 |
| IL7R | NM_002185 | *Homo sapiens* interleukin 7 receptor (IL7R), transcript variant 1, mRNA. | 1809 |
| IRAK4 | NM_001114182 | *Homo sapiens* interleukin 1 receptor associated kinase 4 (IRAK4), transcript variant 1, mRNA. | 1810 |
| IRAK4 | NM_001145256 | *Homo sapiens* interleukin 1 receptor associated kinase 4 (IRAK4), transcript variant 3, mRNA. | 1811 |
| IRAK4 | NM_001145257 | *Homo sapiens* interleukin 1 receptor associated kinase 4 (IRAK4), transcript variant 4, mRNA. | 1812 |
| IRAK4 | NM_001145258 | *Homo sapiens* interleukin 1 receptor associated kinase 4 (IRAK4), transcript variant 5, mRNA. | 1813 |
| IRAK4 | NM_016123 | *Homo sapiens* interleukin 1 receptor associated kinase 4 (IRAK4), transcript variant 2, mRNA. | 1814 |
| IRF3 | NM_001197122 | *Homo sapiens* interferon regulatory factor 3 (IRF3), transcript variant 2, mRNA. | 1815 |

TABLE 12-continued

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| IRF3 | NM_001197123 | *Homo sapiens* interferon regulatory factor 3 (IRF3), transcript variant 3, mRNA. | 1816 |
| IRF3 | NM_001197124 | *Homo sapiens* interferon regulatory factor 3 (IRF3), transcript variant 4, mRNA. | 1817 |
| IRF3 | NM_001197125 | *Homo sapiens* interferon regulatory factor 3 (IRF3), transcript variant 5, mRNA. | 1818 |
| IRF3 | NM_001197126 | *Homo sapiens* interferon regulatory factor 3 (IRF3), transcript variant 6, mRNA. | 1819 |
| IRF3 | NM_001197127 | *Homo sapiens* interferon regulatory factor 3 (IRF3), transcript variant 7, mRNA. | 1820 |
| IRF3 | NM_001197128 | *Homo sapiens* interferon regulatory factor 3 (IRF3), transcript variant 8, mRNA. | 1821 |
| IRF3 | NM_001571 | *Homo sapiens* interferon regulatory factor 3 (IRF3), transcript variant 1, mRNA. | 1822 |
| IRF3 | NR_045568 | *Homo sapiens* interferon regulatory factor 3 (IRF3), transcript variant 9, non-coding RNA. | 1823 |
| IRF7 | NM_001572 | *Homo sapiens* interferon regulatory factor 7 (IRF7), transcript variant a, mRNA. | 1824 |
| IRF7 | NM_004029 | *Homo sapiens* interferon regulatory factor 7 (IRF7), transcript variant b, mRNA. | 1825 |
| IRF7 | NM_004031 | *Homo sapiens* interferon regulatory factor 7 (IRF7), transcript variant d, mRNA. | 1826 |
| IRF8 | NM_002163 | *Homo sapiens* interferon regulatoly factor 8 (IRF8), mRNA. | 1827 |
| IRGM | NM_001145805 | *Homo sapiens* immunity related GTPase M (IRGM), mRNA. | 1828 |
| ISG15 | NM_005101 | *Homo sapiens* ISG15 ubiquitin-like modifier (ISG15), mRNA. | 1829 |
| ITK | NM_005546 | *Homo sapiens* IL2 inducible T-cell kinase (ITK), mRNA. | 1830 |
| ITSN2 | NM_006277 | *Homo sapiens* intersectin 2 (ITSN2), transcript variant 1, mRNA. | 1831 |
| ITSN2 | NM_019595 | *Homo sapiens* intersectin 2 (ITSN2), transcript variant 3, mRNA. | 1832 |
| ITSN2 | NM_147152 | *Homo sapiens* intersectin 2 (ITSN2), transcript variant 2, mRNA. | 1833 |
| JAGN1 | NM_032492 | *Homo sapiens* jagunal homolog 1 (*Drosophila*) (JAGN1), mRNA. | 1834 |
| JAK3 | NM_000215 | *Homo sapiens* Janus kinase 3 (JAK3), mRNA. | 1835 |
| JMY | NM_152405 | *Homo sapiens* junction mediating and regulatory protein, p53 cofactor (JMY), mRNA. | 1836 |
| JUN | NM_002228 | *Homo sapiens* Jun proto-oncogene, AP-1 transcription factor subunit (JUN), mRNA. | 1837 |
| KITLG | NM_000899 | *Homo sapiens* KIT ligand (KITLG), transcript variant b, mRNA. | 1838 |
| KITLG | NM_003994 | *Homo sapiens* KIT ligand (KITLG), transcript variant a, mRNA. | 1839 |
| LAMTOR2 | NM_001145264 | *Homo sapiens* late endosomal/lysosomal adaptor, MAPK and MTOR activator 2 (LAMTOR2), transcript variant 2, mRNA. | 1840 |
| LAMTOR2 | NM_014017 | *Homo sapiens* late endosomal/lysosomal adaptor, MAPK and MTOR activator 2 (LAMTOR2), transcript variant 1, mRNA. | 1841 |
| LCK | NM_005356 | *Homo sapiens* LCK proto-oncogene, Src family tyrosine kinase (LCK), transcript variant 2, mRNA. | 1842 |
| LCK | NM_001042771 | *Homo sapiens* LCK proto-oncogene, Src family tyrosine kinase (LCK), transcript variant 1, mRNA. | 1843 |
| LCP2 | NM_005565 | *Homo sapiens* lymphocyte cytosolic protein 2 (SH2 domain containing leukocyte protein of 76 kDa) (LCP2), mRNA. | 1844 |
| LIG1 | NM_000234 | *Homo sapiens* DNA ligase 1 (LIG1), transcript variant 1, mRNA. | 1845 |
| LIG4 | NM_001098268 | *Homo sapiens* DNA ligase 4 (LIG4), transcript variant 3, mRNA. | 1846 |
| LIG4 | NM_002312 | *Homo sapiens* DNA ligase 4 (LIG4), transcript variant 1, mRNA. | 1847 |
| LIG4 | NM_206937 | *Homo sapiens* DNA ligase 4 (LIG4), transcript variant 2, mRNA. | 1848 |
| LRBA | NM_001199282 | *Homo sapiens* LPS responsive beige-like anchor protein (LRBA), transcript variant 1, mRNA. | 1849 |
| LRBA | NM_006726 | *Homo sapiens* LPS responsive beige-like anchor protein (LRBA), transcript variant 2, mRNA. | 1850 |
| LYST | NM_000081 | *Homo sapiens* lysosomal trafficking regulator (LYST), transcript variant 1, mRNA. | 1851 |
| MAGEA9 | NM_005365 | *Homo sapiens* MAGE family member A9 (MAGEA9), mRNA. | 1852 |
| MAGEA9B | NM_001080790 | *Homo sapiens* MAGE family member A9B (MAGEA9B), mRNA. | 1853 |
| MAGT1 | NM_032121 | *Homo sapiens* magnesium transporter 1 (MAGT1), mRNA. | 1854 |
| MALT1 | NM_006785 | *Homo sapiens* MALT1 paracaspase (MALT1), transcript variant 1, mRNA. | 1855 |
| MALT1 | NM_173844 | *Homo sapiens* MALT1 paracaspase (MALT1), transcript variant 2, mRNA. | 1856 |
| MAP3K2 | NM_006609 | *Homo sapiens* mitogen-activated protein kinase kinase kinase 2 (MAP3K2), mRNA. | 1857 |
| MAPK1 | NM_002745 | *Homo sapiens* mitogen-activated protein kinase 1 (MAPK1), transcript variant 1, mRNA. | 1858 |
| MAPK1 | NM_138957 | *Homo sapiens* mitogen-activated protein kinase 1 (MAPK1), transcript variant 2, mRNA. | 1859 |
| MAPK3 | NM_001040056 | *Homo sapiens* mitogen-activated protein kinase 3 (MAPK3), transcript variant 2, mRNA. | 1860 |
| MAPK3 | NM_001109891 | *Homo sapiens* mitogen-activated protein kinase 3 (MAPK3), transcript variant 3, mRNA. | 1861 |
| MAPK3 | NM_002746 | *Homo sapiens* mitogen-activated protein kinase 3 (MAPK3), transcript variant 1, mRNA. | 1862 |
| MAVS | NM_020746 | *Homo sapiens* mitochondrial antiviral signaling protein (MAVS), transcript variant 1, mRNA. | 1863 |
| MAVS | NM_001206491 | *Homo sapiens* mitochondrial antiviral signaling protein (MAVS), transcript variant 3, mRNA. | 1864 |
| MAVS | NR_037921 | *Homo sapiens* mitochondrial antiviral signaling protein (MAVS), transcript variant 2, non-coding RNA. | 1865 |
| MECP2 | NM_004992 | *Homo sapiens* methyl-CpG binding protein 2 (MECP2), transcript variant 1, mRNA. | 1866 |
| MECP2 | NM_001110792 | *Homo sapiens* methyl-CpG binding protein 2 (MECP2), transcript variant 2, mRNA. | 1867 |
| MEX3C | NM_016626 | *Homo sapiens* mex-3 RNA binding family member C (MEX3C), mRNA. | 1868 |
| MRE11A | NM_005590 | *Homo sapiens* MRE11 homolog A, double strand break repair nuclease (MRE11A), transcript variant 2, mRNA. | 1869 |
| MRE11A | NM_005591 | *Homo sapiens* MRE11 homolog A, double strand break repair nuclease (MRE11A), transcript variant 1, mRNA. | 1870 |
| MS4A1 | NM_021950 | *Homo sapiens* membrane spanning 4-domains A1 (MS4A1), transcript variant 3, mRNA. | 1871 |
| MS4A1 | NM_152866 | *Homo sapiens* membrane spanning 4-domains A1 (MS4A1), transcript variant 1, mRNA. | 1872 |
| MSN | NM_002444 | *Homo sapiens* moesin (MSN), mRNA. | 1873 |
| MYD88 | NM_001172566 | *Homo sapiens* myeloid differentiation primary response 88 (MYD88), transcript variant 5, mRNA. | 1874 |
| MYD88 | NM_001172567 | *Homo sapiens* myeloid differentiation primary response 88 (MYD88), transcript variant 1, mRNA. | 1875 |

TABLE 12-continued

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| MYD88 | NM_001172568 | *Homo sapiens* myeloid differentiation primary response 88 (MYD88), transcript variant 3, mRNA. | 1876 |
| MYD88 | NM_001172569 | *Homo sapiens* myeloid differentiation primary response 88 (MYD88), transcript variant 4, mRNA. | 1877 |
| MYD88 | NM_002468 | *Homo sapiens* myeloid differentiation primary response 88 (MYD88), transcript variant 2, mRNA. | 1878 |
| NBN | NM_002485 | *Homo sapiens* nibrin (NBN), mRNA. | 1879 |
| NFIC | NM_001245005 | *Homo sapiens* nuclear factor I C (NFIC), transcript variant 4, mRNA. | 1880 |
| NFIC | NM_205843 | *Homo sapiens* nuclear factor I C (NFIC), transcript variant 2, mRNA. | 1881 |
| NFIC | NM_001245002 | *Homo sapiens* nuclear factor I C (NFIC), transcript variant 1, mRNA. | 1882 |
| NFIC | NM_001245004 | *Homo sapiens* nuclear factor I C (NFIC), transcript variant 3, mRNA. | 1883 |
| NFIC | NM_005597 | *Homo sapiens* nuclear factor I C (NFIC), transcript variant 5, mRNA. | 1884 |
| NFKB1 | NM_003998 | *Homo sapiens* nuclear factor of kappa light polypeptide gene enhancer in B-cells 1 (NFKB1), transcript variant 1, mRNA. | 1885 |
| NFKB1 | NM_001165412 | *Homo sapiens* nuclear factor of kappa light polypeptide gene enhancer in B-cells 1 (NFKB1), transcript variant 2, mRNA. | 1886 |
| NFKB2 | NM_001077494 | *Homo sapiens* nuclear factor of kappa light polypeptide gene enhancer in B-cells 2 (NFKB2), transcript variant 1, mRNA. | 1887 |
| NFKB2 | NM_002502 | *Homo sapiens* nuclear factor of kappa light polypeptide gene enhancer in B-cells 2 (NFKB2), transcript variant 2, mRNA. | 1888 |
| NFKB2 | NM_001261403 | *Homo sapiens* nuclear factor of kappa light polypeptide gene enhancer in B-cells 2 (NFKB2), transcript variant 4, mRNA. | 1889 |
| NFKBIA | NM_020529 | *Homo sapiens* NFKB inhibitor alpha (NFKBIA), mRNA. | 1890 |
| NHEJ1 | NM_024782 | *Homo sapiens* non-homologous end joining factor 1 (NHEJ1), mRNA. | 1891 |
| NLRP3 | NM_183395 | *Homo sapiens* NLR family, pyrin domain containing 3 (NLRP3), transcript variant 2, mRNA. | 1892 |
| NLRP3 | NM_004895 | *Homo sapiens* NLR family, pyrin domain containing 3 (NLRP3), transcript variant 1, mRNA. | 1893 |
| NLRP3 | NM_001127462 | *Homo sapiens* NLR family, pyrin domain containing 3 (NLRP3), transcript variant 5, mRNA. | 1894 |
| NLRP3 | NM_001127461 | *Homo sapiens* NLR family, pyrin domain containing 3 (NLRP3), transcript variant 4, mRNA. | 1895 |
| NLRP3 | NM_001079821 | *Homo sapiens* NLR family, pyrin domain containing 3 (NLRP3), transcript variant 3, mRNA. | 1896 |
| NLRP3 | NM_001243133 | *Homo sapiens* NLR family, pyrin domain containing 3 (NLRP3), transcript variant 6, mRNA. | 1897 |
| NOD2 | NM_022162 | *Homo sapiens* nucleotide-binding oligomerization domain containing 2 (NOD2), mRNA. | 1898 |
| ORAI1 | NM_032790 | *Homo sapiens* ORAI calcium release-activated calcium modulator 1 (ORAI1), mRNA. | 1899 |
| OSTM1 | NM_014028 | *Homo sapiens* osteopetrosis associated transmembrane protein 1 (OSTM1), mRNA. | 1900 |
| PGM3 | NM_001199917 | *Homo sapiens* phosphoglucomutase 3 (PGM3), transcript variant 1, mRNA. | 1901 |
| PGM3 | NM_001199918 | *Homo sapiens* phosphoglucomutase 3 (PGM3), transcript variant 3, mRNA. | 1902 |
| PGM3 | NM_015599 | *Homo sapiens* phosphoglucomutase 3 (PGM3), transcript variant 2, mRNA. | 1903 |
| PGM3 | NM_001199919 | *Homo sapiens* phosphoglucomutase 3 (PGM3), transcript variant 4, mRNA. | 1904 |
| PIAS1 | NM_016166 | *Homo sapiens* protein inhibitor of activated STAT1 (PIAS1), transcript variant 2, mRNA. | 1905 |
| PIK3R1 | NM_181523 | *Homo sapiens* phosphoinositide-3-kinase regulatory subunit 1 (PIK3R1), transcript variant 1, mRNA. | 1906 |
| PIK3R1 | NM_181524 | *Homo sapiens* phosphoinositide-3-kinase regulatory subunit 1 (PIK3R1), transcript variant 3, mRNA. | 1907 |
| PIK3R1 | NM_181504 | *Homo sapiens* phosphoinositide-3-kinase regulatory subunit 1 (PIK3R1), transcript variant 2, mRNA. | 1908 |
| PIK3R1 | NM_001242466 | *Homo sapiens* phosphoinositide-3-kinase regulatory subunit 1 (PIK3R1), transcript variant 4, mRNA. | 1909 |
| PLCG2 | NM_002661 | *Homo sapiens* phospholipase C gamma 2 (PLCG2), mRNA. | 1910 |
| PMS2 | NM_000535 | *Homo sapiens* PMS1 homolog 2, mismatch repair system component (PMS2), transcript variant 1, mRNA. | 1911 |
| PNP | NM_000270 | *Homo sapiens* purine nucleoside phosphorylase (PNP), mRNA. | 1912 |
| POLA1 | NM_016937 | *Homo sapiens* polymerase (DNA directed), alpha 1, catalytic subunit (POLA1), mRNA. | 1913 |
| POLE | NM_006231 | *Homo sapiens* DNA polymerase epsilon, catalytic subunit (POLE), mRNA. | 1914 |
| PRF1 | NM_001083116 | *Homo sapiens* perforin 1 (PRF1), transcript variant 2, mRNA. | 1915 |
| PRF1 | NM_005041 | *Homo sapiens* perforin 1 (PRF1), transcript variant 1, mRNA. | 1916 |
| PRKCD | NM_006254 | *Homo sapiens* protein kinase C delta (PRKCD), transcript variant 1, mRNA. | 1917 |
| PRKCD | NM_212539 | *Homo sapiens* protein kinase C delta (PRKCD), transcript variant 2, mRNA. | 1918 |
| PRKDC | NM_001081640 | *Homo sapiens* protein kinase, DNA-activated, catalytic polypeptide (PRKDC), transcript variant 2, mRNA. | 1919 |
| PRKDC | NM_006904 | *Homo sapiens* protein kinase, DNA-activated, catalytic polypeptide (PRKDC), transcript variant 1, mRNA. | 1920 |
| PROC | NM_000312 | *Homo sapiens* protein C, inactivator of coagulation factors Va and VIIIa (PROC), mRNA. | 1921 |
| PSMB8 | NM_004159 | *Homo sapiens* proteasome (prosome, macropain) subunit, beta type, 8 (PSMB8), transcript variant 1, mRNA. | 1922 |
| PSMB8 | NM_148919 | *Homo sapiens* proteasome (prosome, macropain) subunit, beta type, 8 (PSMB8), transcript variant 2, mRNA. | 1923 |
| PTEN | NM_000314 | *Homo sapiens* phosphatase and tensin homolog (PTEN), transcript variant 1, mRNA. | 1924 |
| PTPRC | NM_001267798 | *Homo sapiens* protein tyrosine phosphatase, receptor type C (PTPRC), transcript variant 5, mRNA. | 1925 |
| PTPRC | NM_002838 | *Homo sapiens* protein tyrosine phosphatase, receptor type C (PTPRC), transcript variant 1, mRNA. | 1926 |
| PTPRC | NM_080921 | *Homo sapiens* protein tyrosine phosphatase, receptor type C (PTPRC), transcript variant 2, mRNA. | 1927 |
| PTPRC | NR_052021 | *Homo sapiens* protein tyrosine phosphatase, receptor type C (PTPRC), transcript variant 4, non-coding RNA. | 1928 |

TABLE 12-continued

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| PURA | NM_005859 | *Homo sapiens* purine rich element binding protein A (PURA), mRNA. | 1929 |
| RAB27A | NM_183235 | *Homo sapiens* RAB27A, member RAS oncogene family (RAB27A), transcript variant 3, mRNA. | 1930 |
| RAB27A | NM_183236 | *Homo sapiens* RAB27A, member RAS oncogene family (RAB27A), transcript variant 4, mRNA. | 1931 |
| RAB27A | NM_004580 | *Homo sapiens* RAB27A, member RAS oncogene family (RAB27A), transcript variant 1, mRNA. | 1932 |
| RAB27A | NM_183234 | *Homo sapiens* RAB27A, member RAS oncogene family (RAB27A), transcript variant 2, mRNA. | 1933 |
| RAB7A | NM_004637 | *Homo sapiens* RAB7A, member RAS oncogene family (RAB7A), mRNA. | 1934 |
| RABGEF1 | NM_014504 | *Homo sapiens* RAB guanine nucleotide exchange factor (GEF) 1 (RABGEF1), transcript variant 4, mRNA. | 1935 |
| RAC2 | NM_002872 | *Homo sapiens* ras-related C3 botulinum toxin substrate 2 (rho family, small GTP binding protein Rac2) (RAC2), mRNA. | 1936 |
| RAD51 | NM_001164270 | *Homo sapiens* RAD51 recombinase (RAD51), transcript variant 3, mRNA. | 1937 |
| RAD51 | NM_002875 | *Homo sapiens* RAD51 recombinase (RAD51), transcript variant 1, mRNA. | 1938 |
| RAD51 | NM_133487 | *Homo sapiens* RAD51 recombinase (RAD51), transcript variant 2, mRNA. | 1939 |
| RAD51 | NM_001164269 | *Homo sapiens* RAD51 recombinase (RAD51), transcript variant 4, mRNA. | 1940 |
| RAG1 | NM_000448 | *Homo sapiens* recombination activating gene 1 (RAG1), mRNA. | 1941 |
| RAG2 | NM_000536 | *Homo sapiens* recombination activating gene 2 (RAG2), transcript variant 1, mRNA. | 1942 |
| RAG2 | NM_001243785 | *Homo sapiens* recombination activating gene 2 (RAG2), transcript variant 3, mRNA. | 1943 |
| RAG2 | NM_001243786 | *Homo sapiens* recombination activating gene 2 (RAG2), transcript variant 4, mRNA. | 1944 |
| RBCK1 | NM_006462 | *Homo sapiens* RANBP2-type and C3HC4-type zinc finger containing 1 (RBCK1), transcript variant 1, mRNA. | 1945 |
| RBCK1 | NM_031229 | *Homo sapiens* RANBP2-type and C3HC4-type zinc finger containing 1 (RBCK1), transcript variant 2, mRNA. | 1946 |
| RFX5 | NM_000449 | *Homo sapiens* regulatory factor X5 (RFX5), transcript variant 1, mRNA. | 1947 |
| RFX5 | NM_001025603 | *Homo sapiens* regulatory factor X5 (RFX5), transcript variant 2, mRNA. | 1948 |
| RFXANK | NM_003721 | *Homo sapiens* regulatory factor X associated ankyrin containing protein (RFXANK), transcript variant 1, mRNA. | 1949 |
| RFXANK | NM_134440 | *Homo sapiens* regulatory factor X associated ankyrin containing protein (RFXANK), transcript variant 2, mRNA. | 1950 |
| RFXAP | NM_000538 | *Homo sapiens* regulatory factor X associated protein (RFXAP), mRNA. | 1951 |
| RIPK1 | NM_003804 | *Homo sapiens* receptor (TNFRSF)-interacting serine-threonine kinase 1 (RIPK1), mRNA. | 1952 |
| RIPK3 | NM_006871 | *Homo sapiens* receptor-interacting serine-threonine kinase 3 (RIPK3), mRNA. | 1953 |
| RMRP | NR_003051 | *Homo sapiens* RNA component of mitochondrial RNA processing endoribonuclease (RMRP), RNase MRP RNA. | 1954 |
| RNASEH2A | NM_006397 | *Homo sapiens* ribonuclease H2, subunit A (RNASEH2A), mRNA. | 1955 |
| RNASEH2B | NM_001142279 | *Homo sapiens* ribonuclease H2, subunit B (RNASEH2B), transcript variant 2, mRNA. | 1956 |
| RNASEH2B | NM_024570 | *Homo sapiens* ribonuclease H2, subunit B (RNASEH2B), transcript variant 1, mRNA. | 1957 |
| RNASEH2C | NM_032193 | *Homo sapiens* ribonuclease H2, subunit C (RNASEH2C), mRNA. | 1958 |
| RNASEL | NM_021133 | *Homo sapiens* ribonuclease L (2',5'-oligoisoadenylate synthetase-dependent) (RNASEL), mRNA. | 1959 |
| RNF168 | NM_152617 | *Homo sapiens* ring finger protein 168 (RNF168), mRNA. | 1960 |
| RNF31 | NM_017999 | *Homo sapiens* ring finger protein 31 (RNF31), mRNA. | 1961 |
| RNU4ATAC | NR_023343 | *Homo sapiens* RNA, U4atac small nuclear (U12-dependent splicing) (RNU4ATAC), small nuclear RNA. | 1962 |
| RTEL1 | NM_016434 | *Homo sapiens* regulator of telomere elongation helicase 1 (RTEL1), transcript variant 1, mRNA. | 1963 |
| RTEL1 | NM_032957 | *Homo sapiens* regulator of telomere elongation helicase 1 (RTEL1), transcript variant 2, mRNA. | 1964 |
| RTEL1-TNFRSF6B | NR_037882 | *Homo sapiens* RTEL1-TNFRSF6B readthrough (NMD candidate) (RTEL1-TNFRSF6B), long non-coding RNA. | 1965 |
| SALL2 | NM_005407 | *Homo sapiens* spalt like transcription factor 2 (SALL2), transcript variant 1, mRNA. | 1966 |
| SAMHD1 | NM_015474 | *Homo sapiens* SAM domain and HD domain 1 (SAMHD1), mRNA. | 1967 |
| SBDS | NM_016038 | *Homo sapiens* Shwachman-Bodian-Diamond syndrome (SBDS), mRNA. | 1968 |
| SH2D1A | NM_001114937 | *Homo sapiens* SH2 domain containing 1A (SH2D1A), transcript variant 2, mRNA. | 1969 |
| SH2D1A | NM_002351 | *Homo sapiens* SH2 domain containing 1A (SH2D1A), transcript variant 1, mRNA. | 1970 |
| SHARPIN | NM_030974 | *Homo sapiens* SHANK-associated RH domain interactor (SHARPIN), transcript variant 1, mRNA. | 1971 |
| SHARPIN | NR_038270 | *Homo sapiens* SHANK-associated RH domain interactor (SHARPIN), transcript variant 2, non-coding RNA. | 1972 |
| SKIV2L | NM_006929 | *Homo sapiens* superkiller viralicidic activity 2-like (S. cerevisiae) (SKIV2L), mRNA. | 1973 |
| SLC37A4 | NM_001164277 | *Homo sapiens* solute carrier family 37 (glucose-6-phosphate transporter), member 4 (SLC37A4), transcript variant 1, mRNA. | 1974 |
| SLC37A4 | NM_001164278 | *Homo sapiens* solute carrier family 37 (glucose-6-phosphate transporter), member 4 (SLC37A4), transcript variant 2, mRNA. | 1975 |
| SLC37A4 | NM_001164279 | *Homo sapiens* solute carrier family 37 (glucose-6-phosphate transporter), member 4 (SLC37A4), transcript variant 3, mRNA. | 1976 |
| SLC37A4 | NM_001467 | *Homo sapiens* solute carrier family 37 (glucose-6-phosphate transporter), member 4 (SLC37A4), transcript variant 4, mRNA. | 1977 |
| SLC37A4 | NM_001164280 | *Homo sapiens* solute carrier family 37 (glucose-6-phosphate transporter), member 4 (SLC37A4), transcript variant 5, mRNA. | 1978 |
| SLC46A1 | NM_001242366 | *Homo sapiens* solute carrier family 46 member 1 (SLC46A1), transcript variant 2, mRNA. | 1979 |

TABLE 12-continued

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| SLC46A1 | NM_080669 | *Homo sapiens* solute carrier family 46 member 1 (SLC46A1), transcript variant 1, mRNA. | 1980 |
| SLC8A1 | NM_001112800 | *Homo sapiens* solute carrier family 8 member A1 (SLC8A1), transcript variant B, mRNA. | 1981 |
| SLC8A1 | NM_001112801 | *Homo sapiens* solute carrier family 8 member A1 (SLC8A1), transcript variant C, mRNA. | 1982 |
| SLC8A1 | NM_001112802 | *Homo sapiens* solute carrier family 8 member A1 (SLC8A1), transcript variant D, mRNA. | 1983 |
| SLC8A1 | NM_001252624 | *Homo sapiens* solute carrier family 8 member A1 (SLC8A1), transcript variant E, mRNA. | 1984 |
| SLC8A1 | NM_021097 | *Homo sapiens* solute carrier family 8 member A1 (SLC8A1), transcript variant A, mRNA. | 1985 |
| SMAD2 | NM_001003652 | *Homo sapiens* SMAD family member 2 (SMAD2), transcript variant 2, mRNA. | 1986 |
| SMAD2 | NM_001135937 | *Homo sapiens* SMAD family member 2 (SMAD2), transcript variant 3, mRNA. | 1987 |
| SMAD2 | NM_005901 | *Homo sapiens* SMAD family member 2 (SMAD2), transcript variant 1, mRNA. | 1988 |
| SMAD3 | NM_005902 | *Homo sapiens* SMAD family member 3 (SMAD3), transcript variant 1, mRNA. | 1989 |
| SMAD3 | NM_001145102 | *Homo sapiens* SMAD family member 3 (SMAD3), transcript variant 2, mRNA. | 1990 |
| SMAD3 | NM_001145103 | *Homo sapiens* SMAD family member 3 (SMAD3), transcript variant 3, mRNA. | 1991 |
| SMAD3 | NM_001145104 | *Homo sapiens* SMAD family member 3 (SMAD3), transcript variant 4, mRNA. | 1992 |
| SMAD4 | NM_005359 | *Homo sapiens* SMAD family member 4 (SMAD4), mRNA. | 1993 |
| SNAP29 | NM_004782 | *Homo sapiens* synaptosomal-associated protein, 29 kDa (SNAP29), mRNA. | 1994 |
| SNAR-A1 | NR_004435 | *Homo sapiens* small ILF3/NF90-associated RNA A1 (SNAR-A1), small nuclear RNA. | 1995 |
| SNAR-A10 | NR_024229 | *Homo sapiens* small ILF3/NF90-associated RNA A10 (SNAR-A10), small nuclear RNA. | 1996 |
| SNAR-A11 | NR_024225 | *Homo sapiens* small ILF3/NF90-associated RNA A11 (SNAR-A11), small nuclear RNA. | 1997 |
| SNAR-A12 | NR_004437 | *Homo sapiens* small ILF3/NF90-associated RNA A12 (SNAR-A12), small nuclear RNA. | 1998 |
| SNAR-A13 | NR_024216 | *Homo sapiens* small ILF3/NF90-associated RNA A13 (SNAR-A13), small nuclear RNA. | 1999 |
| SNAR-A14 | NR_024242 | *Homo sapiens* small ILF3/NF90-associated RNA A14 (SNAR-A14), small nuclear RNA. | 2000 |
| SNAR-A2 | NR_004436 | *Homo sapiens* small ILF3/NF90-associated RNA A2 (SNAR-A2), small nuclear RNA. | 2001 |
| SNAR-A3 | NR_024214 | *Homo sapiens* small ILF3/NF90-associated RNA A3 (SNAR-A3), small nuclear RNA. | 2002 |
| SNAR-A4 | NR_024215 | *Homo sapiens* small ILF3/NF90-associated RNA A4 (SNAR-A4), small nuclear RNA. | 2003 |
| SNAR-A5 | NR_024223 | *Homo sapiens* small ILF3/NF90-associated RNA A5 (SNAR-A5), small nuclear RNA. | 2004 |
| SNAR-A6 | NR_024227 | *Homo sapiens* small ILF3/NF90-associated RNA A6 (SNAR-A6), small nuclear RNA. | 2005 |
| SNAR-A7 | NR_024224 | *Homo sapiens* small ILF3/NF90-associated RNA A7 (SNAR-A7), small nuclear RNA. | 2006 |
| SNAR-A8 | NR_024228 | *Homo sapiens* small ILF3/NF90-associated RNA A8 (SNAR-A8), small nuclear RNA. | 2007 |
| SNAR-A9 | NR_024226 | *Homo sapiens* small ILF3/NF90-associated RNA A9 (SNAR-A9), small nuclear RNA. | 2008 |
| SNAR-B1 | NR_024231 | *Homo sapiens* small ILF3/NF90-associated RNA B1 (SNAR-B1), small nuclear RNA. | 2009 |
| SNAR-B2 | NR_024230 | *Homo sapiens* small ILF3/NF90-associated RNA B2 (SNAR-B2), small nuclear RNA. | 2010 |
| SNAR-C1 | NR_024220 | *Homo sapiens* small ILF3/NF90-associated RNA C1 (SNAR-C1), small nuclear RNA. | 2011 |
| SNAR-C2 | NR_024217 | *Homo sapiens* small ILF3/NF90-associated RNA C2 (SNAR-C2), small nuclear RNA. | 2012 |
| SNAR-C3 | NR_024221 | *Homo sapiens* small ILF3/NF90-associated RNA C3 (SNAR-C3), small nuclear RNA. | 2013 |
| SNAR-C4 | NR_024218 | *Homo sapiens* small ILF3/NF90-associated RNA C4 (SNAR-C4), small nuclear RNA. | 2014 |
| SNAR-C5 | NR_024219 | *Homo sapiens* small ILF3/NF90-associated RNA C5 (SNAR-C5), small nuclear RNA. | 2015 |
| SNAR-D | NR_024243 | *Homo sapiens* small ILF3/NF90-associated RNA D (SNAR-D), small nuclear RNA. | 2016 |
| SNAR-E | NR_024258 | *Homo sapiens* small ILF3/NF90-associated RNA E (SNAR-E), small nuclear RNA. | 2017 |
| SNAR-F | NR_004384 | *Homo sapiens* small ILF3/NF90-associated RNA F (SNAR-F), small nuclear RNA. | 2018 |
| SNAR-G1 | NR_004383 | *Homo sapiens* small ILF3/NF90-associated RNA G1 (SNAR-G1), small nuclear RNA. | 2019 |
| SNAR-G2 | NR_024244 | *Homo sapiens* small ILF3/NF90-associated RNA G2 (SNAR-G2), small nuclear RNA. | 2020 |
| SNAR-H | NR_024342 | *Homo sapiens* small ILF3/NF90-associated RNA H (SNAR-H), small nuclear RNA. | 2021 |
| SNAR-I | NR_024343 | *Homo sapiens* small ILF3/NF90-associated RNA I (SNAR-I), small nuclear RNA. | 2022 |
| SNCA | NM_000345 | *Homo sapiens* synuclein, alpha (non A4 component of amyloid precursor) (SNCA), transcript variant 1, mRNA. | 2023 |
| SNCA | NM_001146054 | *Homo sapiens* synuclein, alpha (non A4 component of amyloid precursor) (SNCA), transcript variant 2, mRNA. | 2024 |
| SNCA | NM_001146055 | *Homo sapiens* synuclein, alpha (non A4 component of amyloid precursor) (SNCA), transcript variant 3, mRNA. | 2025 |
| SNCA | NM_007308 | *Homo sapiens* synuclein, alpha (non A4 component of amyloid precursor) (SNCA), transcript variant 4, mRNA. | 2026 |
| SNX10 | NM_013322 | *Homo sapiens* sorting nexin 10 (SNX10), transcript variant 2, mRNA. | 2027 |
| SNX10 | NM_001199835 | *Homo sapiens* sorting nexin 10 (SNX10), transcript variant 1, mRNA. | 2028 |
| SNX10 | NM_001199837 | *Homo sapiens* sorting nexin 10 (SNX10), transcript variant 3, mRNA. | 2029 |
| SNX10 | NM_001199838 | *Homo sapiens* sorting nexin 10 (SNX10), transcript variant 4, mRNA. | 2030 |
| SNX10 | NR_037670 | *Homo sapiens* sorting nexin 10 (SNX10), transcript variant 5, non-coding RNA. | 2031 |
| SP110 | NM_004509 | *Homo sapiens* SP110 nuclear body protein (SP110), transcript variant a, mRNA. | 2032 |
| SP110 | NM_080424 | *Homo sapiens* SP110 nuclear body protein (SP110), transcript variant c, mRNA. | 2033 |
| SP110 | NM_001185015 | *Homo sapiens* SP110 nuclear body protein (SP110), transcript variant d, mRNA. | 2034 |
| SP110 | NM_004510 | *Homo sapiens* SP110 nuclear body protein (SP110), transcript variant b, mRNA. | 2035 |
| SP140 | NM_001005176 | *Homo sapiens* SP140 nuclear body protein (SP140), transcript variant 2, mRNA. | 2036 |
| SP140 | NM_007237 | *Homo sapiens* SP140 nuclear body protein (SP140), transcript variant 1, mRNA. | 2037 |
| SPINK5 | NM_001127698 | *Homo sapiens* serine peptidase inhibitor, Kazal type 5 (SPINK5), transcript variant 1, mRNA. | 2038 |
| SPINK5 | NM_006846 | *Homo sapiens* serine peptidase inhibitor, Kazal type 5 (SPINK5), transcript variant 2, mRNA. | 2039 |
| SPINK5 | NM_001127699 | *Homo sapiens* serine peptidase inhibitor, Kazal type 5 (SPINK5), transcript variant 3, mRNA. | 2040 |
| SQSTM1 | NM_003900 | *Homo sapiens* sequestosome 1 (SQSTM1), transcript variant 1, mRNA. | 2041 |
| SQSTM1 | NM_001142298 | *Homo sapiens* sequestosome 1 (SQSTM1), transcript valiant 2, mRNA. | 2042 |
| SQSTM1 | NM_001142299 | *Homo sapiens* sequestosome 1 (SQSTM1), transcript variant 3, mRNA. | 2043 |
| SRSF1 | NM_001078166 | *Homo sapiens* serine and arginine rich splicing factor 1 (SRSF1), transcript variant 2, mRNA. | 2044 |
| SRSF1 | NM_006924 | *Homo sapiens* serine and arginine rich splicing factor 1 (SRSF1), transcript variant 1, mRNA. | 2045 |

TABLE 12-continued

Non-redundant list of transcript variants that correspond to the set of genes that no CNV
'solutions' have been reported in the 71 PML cases

| RefSeq_Gene_Symbol | RefSeq_Accession_Number | mRNA_Description | SEQ ID |
|---|---|---|---|
| SRSF1 | NR_034041 | *Homo sapiens* serine and arginine rich splicing factor 1 (SRSF1), transcript variant 3, non-coding RNA. | 2046 |
| STAT1 | NM_007315 | *Homo sapiens* signal transducer and activator of transcription 1 (STAT1), transcript variant alpha, mRNA. | 2047 |
| STAT1 | NM_139266 | *Homo sapiens* signal transducer and activator of transcription 1 (STAT1), transcript variant beta, mRNA. | 2048 |
| STAT2 | NM_005419 | *Homo sapiens* signal transducer and activator of transcription 2, 113 kDa (STAT2), transcript variant 1, mRNA. | 2049 |
| STAT2 | NM_198332 | *Homo sapiens* signal transducer and activator of transcription 2, 113 kDa (STAT2), transcript variant 2, mRNA. | 2050 |
| STAT3 | NM_003150 | *Homo sapiens* signal transducer and activator of transcription 3 (STAT3), transcript variant 2, mRNA. | 2051 |
| STAT3 | NM_139276 | *Homo sapiens* signal transducer and activator of transcription 3 (STAT3), transcript variant 1, mRNA. | 2052 |
| STAT3 | NM_213662 | *Homo sapiens* signal transducer and activator of transcription 3 (STAT3), transcript variant 3, mRNA. | 2053 |
| STAT5B | NM_012448 | *Homo sapiens* signal transducer and activator of transcription 5B (STAT5B), mRNA. | 2054 |
| STIM1 | NM_003156 | *Homo sapiens* stromal interaction molecule 1 (STIM1), transcript variant 2, mRNA. | 2055 |
| STK4 | NM_006282 | *Homo sapiens* serine/threonine kinase 4 (STK4), mRNA. | 2056 |
| STX11 | NM_003764 | *Homo sapiens* syntaxin 11 (STX11), mRNA. | 2057 |
| STXBP2 | NM_001127396 | *Homo sapiens* syntaxin binding protein 2 (STXBP2), transcript variant 2, mRNA. | 2058 |
| STXBP2 | NM_001272034 | *Homo sapiens* syntaxin binding protein 2 (STXBP2), transcript variant 3, mRNA. | 2059 |
| STXBP2 | NM_006949 | *Homo sapiens* syntaxin binding protein 2 (STXBP2), transcript variant 1, mRNA. | 2060 |
| STXBP2 | NR_073560 | *Homo sapiens* syntaxin binding protein 2 (STXBP2), transcript variant 4, non-coding RNA. | 2061 |
| SYNCRIP | NM_001159673 | *Homo sapiens* synaptotagmin binding cytoplasmic RNA interacting protein (SYNCRIP), transcript variant 2, mRNA. | 2062 |
| SYNCRIP | NM_001159674 | *Homo sapiens* synaptotagmin binding cytoplasmic RNA interacting protein (SYNCRIP), transcript variant 3, mRNA. | 2063 |
| SYNCRIP | NM_001159676 | *Homo sapiens* synaptotagmin binding cytoplasmic RNA interacting protein (SYNCRIP), transcript variant 5, mRNA. | 2064 |
| SYNCRIP | NM_001159677 | *Homo sapiens* synaptotagmin binding cytoplasmic RNA interacting protein (SYNCRIP), transcript variant 6, mRNA. | 2065 |
| SYNCRIP | NM_001253771 | *Homo sapiens* synaptotagmin binding cytoplasmic RNA interacting protein (SYNCRIP), transcript variant 7, mRNA. | 2066 |
| SYNCRIP | NM_001159675 | *Homo sapiens* synaptotagmin binding cytoplasmic RNA interacting protein (SYNCRIP), transcript variant 4, mRNA. | 2067 |
| SYNCRIP | NM_006372 | *Homo sapiens* synaptotagmin binding cytoplasmic RNA interacting protein (SYNCRIP), transcript variant 1, mRNA. | 2068 |
| T | NM_001270484 | *Homo sapiens* T brachyury transcription factor (T), transcript variant 2, mRNA. | 2069 |
| T | NM_003181 | *Homo sapiens* T brachyury transcription factor (T), transcript variant 1, mRNA. | 2070 |
| TAP1 | NM_000593 | *Homo sapiens* transporter 1, ATP binding cassette subfamily B member (TAP1), transcript variant 1, mRNA. | 2071 |
| TAP2 | NM_018833 | *Homo sapiens* transporter 2, ATP binding cassette subfamily B member (TAP2), transcript variant 2, mRNA. | 2072 |
| TAP2 | NM_000544 | *Homo sapiens* transporter 2, ATP binding cassette subfamily B member (TAP2), transcript variant 1, B allele, mRNA. | 2073 |
| TAPBP | NM_003190 | *Homo sapiens* TAP binding protein (tapasin) (TAPBP), transcript variant 1, mRNA. | 2074 |
| TAPBP | NM_172209 | *Homo sapiens* TAP binding protein (tapasin) (TAPBP), transcript variant 3, mRNA. | 2075 |
| TAPBP | NM_172208 | *Homo sapiens* TAP binding protein (tapasin) (TAPBP), transcript variant 2, mRNA. | 2076 |
| TAZ | NM_000116 | *Homo sapiens* tafazzin (TAZ), transcript variant 1, mRNA. | 2077 |
| TAZ | NM_181312 | *Homo sapiens* tafazzin (TAZ), transcript variant 3, mRNA. | 2078 |
| TAZ | NM_181311 | *Homo sapiens* tafazzin (TAZ), transcript variant 2, mRNA. | 2079 |
| TAZ | NM_181313 | *Homo sapiens* tafazzin (TAZ), transcript variant 4, mRNA. | 2080 |
| TAZ | NR_024048 | *Homo sapiens* tafazzin (TAZ), transcript variant 5, non-coding RNA. | 2081 |
| TBK1 | NM_013254 | *Homo sapiens* TANK binding kinase 1 (TBK1), mRNA. | 2082 |
| TBX1 | NM_005992 | *Homo sapiens* T-box 1 (TBX1), transcript variant B, mRNA. | 2083 |
| TBX1 | NM_080646 | *Homo sapiens* T-box 1 (TBX1), transcript variant A, mRNA. | 2084 |
| TBX1 | NM_080647 | *Homo sapiens* T-box 1 (TBX1), transcript variant C, mRNA. | 2085 |
| TCIRG1 | NM_006019 | *Homo sapiens* T-cell immune regulator 1, ATPase H+ transporting V0 subunit a3 (TCIRG1), transcript variant 1, mRNA. | 2086 |
| TCIRG1 | NM_006053 | *Homo sapiens* T-cell immune regulator 1, ATPase H+ transporting V0 subunit a3 (TCIRG1), transcript variant 2, mRNA. | 2087 |
| TICAM1 | NM_182919 | *Homo sapiens* toll like receptor adaptor molecule 1 (TICAM1), mRNA. | 2088 |
| TLR3 | NM_003265 | *Homo sapiens* toll like receptor 3 (TLR3), mRNA. | 2089 |
| TLR4 | NM_003266 | *Homo sapiens* toll like receptor 4 (TLR4), transcript variant 3, mRNA. | 2090 |
| TLR4 | NM_138554 | *Homo sapiens* toll like receptor 4 (TLR4), transcript variant 1, mRNA. | 2091 |
| TLR4 | NM_138557 | *Homo sapiens* toll like receptor 4 (TLR4), transcript variant 4, mRNA. | 2092 |
| TMEM173 | NM_198282 | *Homo sapiens* transmembrane protein 173 (TMEM173), mRNA. | 2093 |
| TNF | NM_000594 | *Homo sapiens* tumor necrosis factor (TNF), mRNA. | 2094 |
| TNFAIP3 | NM_001270507 | *Homo sapiens* TNF alpha induced protein 3 (TNFAIP3), transcript variant 2, mRNA. | 2095 |
| TNFAIP3 | NM_001270508 | *Homo sapiens* TNF alpha induced protein 3 (TNFAIP3), transcript variant 1, mRNA. | 2096 |
| TNFAIP3 | NM_006290 | *Homo sapiens* TNF alpha induced protein 3 (TNFAIP3), transcript variant 3, mRNA. | 2097 |
| TNFRSF11A | NM_003839 | *Homo sapiens* tumor necrosis factor receptor superfamily, member 11a, NFKB activator (TNFRSF11A), transcript variant 1, mRNA. | 2098 |

TABLE 12-continued

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| TNFRSF11A | NM_001270949 | *Homo sapiens* tumor necrosis factor receptor superfamily, member 11a, NFKB activator (TNFRSF11A), transcript variant 2, mRNA. | 2099 |
| TNFRSF11A | NM_001270950 | *Homo sapiens* tumor necrosis factor receptor superfamily, member 11a, NFKB activator (TNFRSF11A), transcript variant 3, mRNA. | 2100 |
| TNFRSF11A | NM_001270951 | *Homo sapiens* tumor necrosis factor receptor superfamily, member 11a, NFKB activator (TNFRSF11A), transcript variant 4, mRNA. | 2101 |
| TNFRSF11B | NM_002546 | *Homo sapiens* tumor necrosis factor receptor superfamily, member 11b (TNFRSF11B), mRNA. | 2102 |
| TNFRSF13B | NM_012452 | *Homo sapiens* TNF receptor superfamily member 13B (TNFRSF13B), mRNA. | 2103 |
| TNFRSF4 | NM_003327 | *Homo sapiens* TNF receptor superfamily member 4 (TNFRSF4), mRNA. | 2104 |
| TNFRSF8 | NM_001243 | *Homo sapiens* TNF receptor superfamily member 8 (TNFRSF8), transcript variant 1, mRNA. | 2105 |
| TNFSF11 | NM_003701 | *Homo sapiens* tumor necrosis factor (ligand) superfamily, member 11 (TNFSF11), transcript variant 1, mRNA. | 2106 |
| TNFSF11 | NM_033012 | *Homo sapiens* tumor necrosis factor (ligand) superfamily, member 11 (TNFSF11), transcript variant 2, mRNA. | 2107 |
| TNFSF12 | NM_003809 | *Homo sapiens* tumor necrosis factor superfamily member 12 (TNFSF12), transcript variant 1, mRNA. | 2108 |
| TNFSF12 | NR_037146 | *Homo sapiens* tumor necrosis factor superfamily member 12 (TNFSF12), transcript variant 2, non-coding RNA. | 2109 |
| TP53 | NM_000546 | *Homo sapiens* tumor protein p53 (TP53), transcript variant 1, mRNA. | 2110 |
| TP53 | NM_001126112 | *Homo sapiens* tumor protein p53 (TP53), transcript variant 2, mRNA. | 2111 |
| TP53 | NM_001126113 | *Homo sapiens* tumor protein p53 (TP53), transcript variant 4, mRNA. | 2112 |
| TP53 | NM_001126114 | *Homo sapiens* tumor protein p53 (TP53), transcript variant 3, mRNA. | 2113 |
| TP53 | NM_001126115 | *Homo sapiens* tumor protein p53 (TP53), transcript variant 5, mRNA. | 2114 |
| TP53 | NM_001126116 | *Homo sapiens* tumor protein p53 (TP53), transcript variant 6, mRNA. | 2115 |
| TP53 | NM_001126117 | *Homo sapiens* tumor protein p53 (TP53), transcript variant 7, mRNA. | 2116 |
| TP53 | NM_001126118 | *Homo sapiens* tumor protein p53 (TP53), transcript variant 8, mRNA. | 2117 |
| TP53 | NM_001276695 | *Homo sapiens* tumor protein p53 (TP53), transcript variant 4, mRNA. | 2118 |
| TP53 | NM_001276696 | *Homo sapiens* tumor protein p53 (TP53), transcript variant 3, mRNA. | 2119 |
| TP53 | NM_001276697 | *Homo sapiens* tumor protein p53 (TP53), transcript variant 5, mRNA. | 2120 |
| TP53 | NM_001276698 | *Homo sapiens* tumor protein p53 (TP53), transcript variant 6, mRNA. | 2121 |
| TP53 | NM_001276699 | *Homo sapiens* tumor protein p53 (TP53), transcript variant 7, mRNA. | 2122 |
| TP53 | NM_001276760 | *Homo sapiens* tumor protein p53 (TP53), transcript variant 1, mRNA. | 2123 |
| TP53 | NM_001276761 | *Homo sapiens* tumor protein p53 (TP53), transcript variant 2, mRNA. | 2124 |
| TRAF3 | NM_001199427 | *Homo sapiens* TNF receptor associated factor 3 (TRAF3), transcript variant 4, mRNA. | 2125 |
| TRAF3 | NM_003300 | *Homo sapiens* TNF receptor associated factor 3 (TRAF3), transcript variant 3, mRNA. | 2126 |
| TRAF3 | NM_145725 | *Homo sapiens* TNF receptor associated factor 3 (TRAF3), transcript variant 1, mRNA. | 2127 |
| TRAF3 | NM_145726 | *Homo sapiens* TNF receptor associated factor 3 (TRAF3), transcript variant 2, mRNA. | 2128 |
| TRAF6 | NM_004620 | *Homo sapiens* TNF receptor-associated factor 6, E3 ubiquitin protein ligase (TRAF6), transcript variant 2, mRNA. | 2129 |
| TRAF6 | NM_145803 | *Homo sapiens* TNF receptor-associated factor 6, E3 ubiquitin protein ligase (TRAF6), transcript variant 1, mRNA. | 2130 |
| TREX1 | NM_007248 | *Homo sapiens* three prime repair exonuclease 1 (TREX1), transcript variant 5, mRNA. | 2131 |
| TREX1 | NM_033629 | *Homo sapiens* three prime repair exonuclease 1 (TREX1), transcript variant 4, mRNA. | 2132 |
| TREX1 | NM_016381 | *Homo sapiens* three prime repair exonuclease 1 (TREX1), transcript variant 1, mRNA. | 2133 |
| TRNT1 | NM_182916 | *Homo sapiens* tRNA nucleotidyl transferase 1 (TRNT1), transcript variant 1, mRNA. | 2134 |
| TTC7A | NM_020458 | *Homo sapiens* tetratricopeptide repeat domain 7A (TTC7A), transcript variant 2, mRNA. | 2135 |
| TYK2 | NM_003331 | *Homo sapiens* tyrosine kinase 2 (TYK2), mRNA. | 2136 |
| UNC119 | NM_005148 | *Homo sapiens* unc-119 lipid binding chaperone (UNC119), transcript variant 1, mRNA. | 2137 |
| UNC119 | NM_054035 | *Homo sapiens* unc-119 lipid binding chaperone (UNC119), transcript variant 2, mRNA. | 2138 |
| UNC13D | NM_199242 | *Homo sapiens* unc-13 homolog D (UNC13D), mRNA. | 2139 |
| UNC93B1 | NM_030930 | *Homo sapiens* unc-93 homolog B1 (C. elegans) (UNC93B1), mRNA. | 2140 |
| UNG | NM_080911 | *Homo sapiens* uracil DNA glycosylase (UNG), transcript variant 2, mRNA. | 2141 |
| UNG | NM_003362 | *Homo sapiens* uracil DNA glycosylase (UNG), transcript variant 1, mRNA. | 2142 |
| USP18 | NM_017414 | *Homo sapiens* ubiquitin specific peptidase 18 (USP18), mRNA. | 2143 |
| USP20 | NM_006676 | *Homo sapiens* ubiquitin specific peptidase 20 (USP20), transcript variant 1, mRNA. | 2144 |
| USP20 | NM_001008563 | *Homo sapiens* ubiquitin specific peptidase 20 (USP20), transcript variant 2, mRNA. | 2145 |
| USP20 | NM_001110303 | *Homo sapiens* ubiquitin specific peptidase 20 (USP20), transcript variant 3, mRNA. | 2146 |
| VAPA | NM_003574 | *Homo sapiens* VAMP associated protein A (VAPA), transcript variant 1, mRNA. | 2147 |
| VAPA | NM_194434 | *Homo sapiens* VAMP associated protein A (VAPA), transcript variant 2, mRNA. | 2148 |
| VCP | NM_007126 | *Homo sapiens* valosin containing protein (VCP), mRNA. | 2149 |
| VDAC1 | NM_003374 | *Homo sapiens* voltage dependent anion channel 1 (VDAC1), transcript variant 1, mRNA. | 2150 |
| VDAC1 | NR_036624 | *Homo sapiens* voltage dependent anion channel 1 (VDAC1), transcript variant 3, non-coding RNA. | 2151 |
| VDAC1 | NR_036625 | *Homo sapiens* voltage dependent anion channel 1 (VDAC1), transcript variant 2, non-coding RNA. | 2152 |
| VPS13B | NM_017890 | *Homo sapiens* vacuolar protein sorting 13 homolog B (yeast) (VPS13B), transcript variant 5, mRNA. | 2153 |
| VPS13B | NM_181661 | *Homo sapiens* vacuolar protein sorting 13 homolog B (yeast) (VPS13B), transcript variant 4, mRNA. | 2154 |
| VPS13B | NM_015243 | *Homo sapiens* vacuolar protein sorting 13 homolog B (yeast) (VPS13B), transcript variant 3, mRNA. | 2155 |
| VPS13B | NR_047582 | *Homo sapiens* vacuolar protein sorting 13 homolog B (yeast) (VPS13B), transcript variant 6, non-coding RNA. | 2156 |

TABLE 12-continued

Non-redundant list of transcript variants that correspond to the set of genes that no CNV 'solutions' have been reported in the 71 PML cases

| RefSeq_Gene_Symbol | RefSeq_Accession_Number | mRNA_Description | SEQ ID |
|---|---|---|---|
| VPS13B | NM_152564 | *Homo sapiens* vacuolar protein sorting 13 homolog B (yeast) (VPS13B), transcript variant 1, mRNA. | 2157 |
| VPS45 | NM_007259 | *Homo sapiens* vacuolar protein sorting 45 homolog (VPS45), transcript variant 1, mRNA. | 2158 |
| WAS | NM_000377 | *Homo sapiens* Wiskott-Aldrich syndrome (WAS), mRNA. | 2159 |
| WEE1 | NM_003390 | *Homo sapiens* WEE1 G2 checkpoint kinase (WEE1), transcript variant 1, mRNA. | 2160 |
| WEE1 | NM_001143976 | *Homo sapiens* WEE1 G2 checkpoint kinase (WEE1), transcript variant 2, mRNA. | 2161 |
| WIPF1 | NM_001077269 | *Homo sapiens* WAS/WASL interacting protein family member 1 (WIPF1), transcript variant 2, mRNA. | 2162 |
| WIPF1 | NM_003387 | *Homo sapiens* WAS/WASL interacting protein family member 1 (WIPF1), transcript variant 1, mRNA. | 2163 |
| XIAP | NM_001204401 | *Homo sapiens* X-linked inhibitor of apoptosis, E3 ubiquitin protein ligase (XIAP), transcript variant 2, mRNA. | 2164 |
| XIAP | NM_001167 | *Homo sapiens* X-linked inhibitor of apoptosis, E3 ubiquitin protein ligase (XIAP), transcript variant 1, mRNA. | 2165 |
| XIAP | NR_037916 | *Homo sapiens* X-linked inhibitor of apoptosis, E3 ubiquitin protein ligase (XIAP), transcript variant 3, non-coding RNA. | 2166 |
| YBX1 | NM_004559 | *Homo sapiens* Y-box binding protein 1 (YBX1), transcript variant 1, mRNA. | 2167 |
| YWHAZ | NM_001135699 | *Homo sapiens* tyrosine 3-monooxygenase/tryptophan 5-monooxygenase activation protein zeta (YWHAZ), transcript variant 3, mRNA. | 2168 |
| YWHAZ | NM_001135700 | *Homo sapiens* tyrosine 3-monooxygenase/tryptophan 5-monooxygenase activation protein zeta (YWHAZ), transcript variant 4, mRNA. | 2169 |
| YWHAZ | NM_001135701 | *Homo sapiens* tyrosine 3-monooxygenase/tryptophan 5-monooxygenase activation protein zeta (YWHAZ), transcript variant 5, mRNA. | 2170 |
| YWHAZ | NM_001135702 | *Homo sapiens* tyrosine 3-monooxygenase/tryptophan 5-monooxygenase activation protein zeta (YWHAZ), transcript variant 6, mRNA. | 2171 |
| YWHAZ | NM_003406 | *Homo sapiens* tyrosine 3-monooxygenase/tryptophan 5-monooxygenase activation protein zeta (YWHAZ), transcript variant 1, mRNA. | 2172 |
| YWHAZ | NM_145690 | *Homo sapiens* tyrosine 3-monooxygenase/tryptophan 5-monooxygenase activation protein zeta (YWHAZ), transcript variant 2, mRNA. | 2173 |
| ZAP70 | NM_001079 | *Homo sapiens* zeta chain of T cell receptor associated protein kinase 70 (ZAP70), transcript variant 1, mRNA. | 2174 |
| ZAP70 | NM_207519 | *Homo sapiens* zeta chain of T cell receptor associated protein kinase 70 (ZAP70), transcript variant 2, mRNA. | 2175 |
| ZBTB24 | NM_014797 | *Homo sapiens* zinc finger and BTB domain containing 24 (ZBTB24), transcript variant 1, mRNA. | 2176 |
| ZBTB24 | NM_001164313 | *Homo sapiens* zinc finger and BTB domain containing 24 (ZBTB24), transcript variant 2, mRNA. | 2177 |

Table 12 lists all transcript variants for genes in Table 6 that were not 'discovered' by PBio on the basis of aCGH (CNV identified genes). The SEQ ID NOs correspond to transcript variants (oftentimes more than one per gene).

TABLE 13

Genes for which the total burden of heterozygous, damaging variants was found to be statistically greater in PML cases versus ExAC controls

| GENE | Ave CASES | Ave EXAC CASES | Ave EXAC SAMPLES | Ave FET | Ave FET corr(419) | Ave OR | Ethnicity | Overlap |
|---|---|---|---|---|---|---|---|---|
| PLCG2 | 17 | 1,806 | 31,277 | 1.43E−10 | 6.21E−08 | 10.27 | EUR | EUR + AFR |
| RBCK1 | 6 | 187 | 29,324 | 4.27E−07 | 1.86E−04 | 24.60 | EUR | |
| EPG5 | 9 | 764 | 32,835 | 7.11E−07 | 3.09E−04 | 10.79 | EUR | |
| IL17F | 4 | 61 | 33,346 | 1.67E−06 | 7.28E−04 | 54.57 | EUR | |
| SHARPIN | 8 | 646 | 32,162 | 2.58E−06 | 1.12E−03 | 10.84 | EUR | |
| PRF1 | 8 | 715 | 33,027 | 4.44E−06 | 1.93E−03 | 10.04 | EUR | |
| JAGN1 | 5 | 163 | 27,768 | 6.80E−06 | 2.96E−03 | 21.71 | EUR | |
| TAP1 | 5 | 203 | 28,125 | 1.80E−05 | 7.82E−03 | 17.63 | EUR | |
| POLE | 11 | 1,660 | 29,108 | 2.84E−05 | 1.23E−02 | 5.51 | EUR | EUR + AFR |
| LRBA | 11 | 1,876 | 32,136 | 3.47E−05 | 1.51E−02 | 5.38 | EUR | |
| EHF | 3 | 49 | 32,588 | 4.83E−05 | 2.10E−02 | 48.59 | EUR | |
| IL12B | 3 | 58 | 33,112 | 7.44E−05 | 3.23E−02 | 41.70 | EUR | |
| ATL2 | 8 | 31 | 5,041 | 4.03E−11 | 1.75E−08 | 90.11 | AFR | |
| NHEJ1 | 6 | 27 | 4,384 | 5.48E−09 | 2.39E−06 | 64.56 | AFR | |
| LYST | 11 | 291 | 4,748 | 1.09E−08 | 4.76E−06 | 16.85 | AFR | |
| HIVEP1 | 9 | 150 | 4,432 | 7.41E−08 | 3.22E−05 | 23.83 | AFR | |
| AP3B1 | 5 | 46 | 4,937 | 1.69E−06 | 7.36E−04 | 33.23 | AFR | |
| TNFRSF10A | 7 | 149 | 4,626 | 3.28E−06 | 1.43E−03 | 15.03 | AFR | |
| PIK3CD | 7 | 148 | 4,549 | 3.52E−06 | 1.53E−03 | 14.87 | AFR | |
| PLCG2 | 8 | 256 | 4,410 | 1.47E−05 | 6.41E−03 | 9.99 | AFR | EUR + AFR |
| PNP | 3 | 11 | 5,189 | 2.00E−05 | 8.69E−03 | 78.45 | AFR | |
| POLE | 8 | 297 | 4,752 | 2.48E−05 | 1.08E−02 | 9.23 | AFR | EUR + AFR |

TABLE 13-continued

Genes for which the total burden of heterozygous, damaging variants was found to be statistically greater in PML cases versus ExAC controls

| GENE | Ave CASES | Ave EXAC CASES | Ave EXAC SAMPLES | Ave FET | Ave FET corr(419) | Ave OR | Ethnicity | Overlap |
|---|---|---|---|---|---|---|---|---|
| MCEE | 3 | 13 | 5,164 | 3.10E−05 | 1.35E−02 | 66.04 | AFR | |
| DOCK2 | 6 | 173 | 5,023 | 6.39E−05 | 2.78E−02 | 11.21 | AFR | |
| ALG12 | 4 | 43 | 4,252 | 6.73E−05 | 2.93E−02 | 23.03 | AFR | |

Table 13 lists genes for which the total burden of heterozygous, damaging variants was found to be statistically greater in PML cases versus ExAC controls. Gene burden analysis was performed as described below at minor allele frequency (MAF) cutoffs of 0.01, 0.02, 0.03, 0.04 and 0.05. Not all genes survived statistical analysis at all MAF cutoffs. For each gene that survived at multiple MAF cutoffs, the averages of the Fishers Exact Test (FET), nominal and corrected, were calculated, as were the other relevant metrics. Two genes overlapped between AFR and EUR analyses. FETs were corrected for multiple testing with the number of genes used in this study (419). Only genes for which FET_corr was <0.05 and in which variants affected >10% of cases within the given ethnicity (>2 for AFR, >4 for EUR) were considered for inclusion.

TABLE 14

Top tier of variants found to be significant on the basis of variant burden analysis

| Gene | Variant (hg19) | Genotype | PML EUR 44 | PML AFR 21 | PML LAT 5 | ExAC EUR | ExAC AFR | ExAC LAT |
|---|---|---|---|---|---|---|---|---|
| PLCG2 | chr16: 81942175, A > G | het | 2 | 5 | 0 | 512/32281 | 88/4707 | 116/5548 |
| IFIH1 | chr2: 163136505, C > G | het | 6 | 1 | 0 | 611/33155 | 23/5182 | 119/5671 |
| TCIRG1 | chr11: 67818269, G > A | het | 0 | 4 | 0 | 103/33193 | 200/5170 | 60/5770 |
| IGLL1 | chr22: 23917192, G > T | het | 4 | 3 | 1 | 751/33348 | 603/5183 | 236/5782 |
| MAVS | chr20: 3846397, C > T | hom | 4 | 4 | 0 | 800/32122 | 684/4982 | 52/5691 |
| SHARPIN | chr8: 145154222, G > A | het | 8 | 4 | 0 | 2916/33177 | 59/4865 | 171/5780 |
| CHD7 | chr8: 61654298, T > A | het | 5 | 0 | 0 | 1103/33106 | 39/4840 | 93/5725 |
| CX3CR1 | chr3: 39323163, A > C | hom | 11 | 4 | 0 | 4723/31219 | 193/4376 | 1357/5491 |
| LRBA | chr4: 151199080, G > A | hom | 3 | 3 | 0 | 2260/33328 | 20/5195 | 54/5785 |
| HIVEP3 | chr1: 42047208, C > G | het | 5 | 3 | 1 | 3383/32494 | 123/5061 | 902/5756 |
| IFIH1 | chr2: 163124051, C > T | hom | 20 | 3 | 1 | 12107/33356 | 184/5199 | 1076/5776 |
| RNASEL | chr1: 182554557, C > T | hom | 7 | 2 | 0 | 4543/33356 | 78/5202 | 167/5785 |

| Gene | PML EUR OR | PML EUR FET | PML AFR OR | PML AFR FET | PML ALL OR | PML ALL FET |
|---|---|---|---|---|---|---|
| PLCG2 | 2.95 | 0.154755 | 16.40 | 0.0000 | 6.49 | 0.0002 |
| IFIH1 | 8.41 | 0.000156 | 11.22 | 0.0927 | 6.38 | 0.0002 |
| TCIRG1 | NA | NA | 5.85 | 0.0082 | 7.31 | 0.0028 |
| IGLL1 | 4.34 | 0.017218 | 1.27 | 0.7286 | 3.47 | 0.0036 |
| MAVS | 3.92 | 0.023868 | 1.48 | 0.5191 | 3.47 | 0.0036 |
| SHARPIN | 2.31 | 0.053526 | 19.17 | 0.0001 | 2.68 | 0.0040 |
| CHD7 | 3.72 | 0.015268 | NA | NA | 2.64 | 0.0485 |
| CX3CR1 | 1.87 | 0.088087 | 5.10 | 0.0128 | 1.51 | 0.1806 |

TABLE 14-continued

Top tier of variants found to be significant on the basis of variant burden analysis

| | | | | | | |
|---|---|---|---|---|---|---|
| LRBA | 1.01 | 1.000000 | 43.13 | 0.0001 | 1.69 | 0.2736 |
| HIVEP3 | 1.10 | 0.803620 | 6.69 | 0.0143 | 1.30 | 0.4283 |
| IFIH1 | 1.46 | 0.212471 | 4.54 | 0.0374 | 1.21 | 0.4372 |
| RNASEL | 1.20 | 0.658473 | 6.91 | 0.0403 | 1.22 | 0.5616 |

Table 14 lists the top tier of variants that were found to be significant on the basis of variant burden analysis, as described below. For each variant (genome coordinates are based on UCSC hg19), detailed information is presented of the numbers of EUR and AFR cases that carry the variant, along with the ethnic-specific and aggregate statistical metrics.

TABLE 15

Second tier of variants found on the basis of variant burden analysis

| Gene | Variant (hg19) | Genotype | PML EUR 44 | PML AFR 21 | PML LAT 5 | ExAC EUR | ExAC AFR | ExAC LAT |
|---|---|---|---|---|---|---|---|---|
| SHARPIN | chr8: 145154824, A > C | het | 3 | 0 | 0 | 2/30,670 | 0/4,471 | 0/5,302 |
| RTEL1 | chr20: 62305450, C > T | het | 0 | 2 | 0 | 1/32,552 | 0/4,838 | 0/5,737 |
| IGLL1 | chr22: 23915745, G > A | het | 2 | 0 | 1 | 19/33,348 | 74/5,184 | 9/5,783 |
| PGM3 | chr6: 83884161, C > G | het | 0 | 2 | 0 | 0/33,069 | 26/5,167 | 3/5,748 |
| ATM | chr11: 108202772, G > T | het | 3 | 0 | 0 | 170/32,707 | 3/5,099 | 7/5,713 |
| TMEM173 | chr5: 138856923, C > T | het | 2 | 2 | 0 | 108/32,327 | 204/4,842 | 58/5,770 |
| CLCN7 | chr16: 1510535, C > T | het | 0 | 2 | 0 | 1/32,898 | 66/5,119 | 0/5,732 |
| MAVS | chr20: 3843027, C > A | hom | 4 | 2 | 0 | 803/33,206 | 167/5,171 | 46/5,779 |
| ORAI1 | chr12: 122064788, G > GT | het | 4 | 0 | 0 | 371/28,708 | 5/3,555 | 16/5,354 |
| RBFOX1 | chr16: 7714909, C > T | het | 0 | 2 | 0 | 1/33,367 | 69/4,902 | 4/5,782 |
| MALT1 | chr18: 56401523, C > T | het | 4 | 0 | 0 | 466/33,239 | 9/5,179 | 40/5,760 |
| GFI1 | chr1: 92946625, G > C | het | 2 | 1 | 0 | 206/29,111 | 6/4,156 | 39/5,114 |
| DOCK2 | chr5: 169081453, G > C | het | 0 | 2 | 0 | 48/33.350 | 43/5,201 | 27/5,786 |
| ATM | chr11: 108117787, C > T | het | 2 | 0 | 0 | 93/33,256 | 2/5,151 | 28/5,756 |
| SNAP29 | chr22: 21235389, A > G | het | 3 | 0 | 0 | 283/32,917 | 21/5,149 | 32/5,740 |
| TICAM1 | chr19: 4817657, C > T | het | 0 | 2 | 0 | 32/31,437 | 71/4,814 | 19/5,687 |
| GTPBP4 | chr10: 1060218, G > A | hom | 3 | 0 | 0 | 334/33,367 | 20/5,202 | 21/5,786 |
| BACH1 | chr21: 30698953, T > G | het | 2 | 0 | 0 | 134/33,122 | 4/5,103 | 6/5,778 |
| DOCK8 | chr9: 304628, G > A | het | 2 | 0 | 0 | 149/33,298 | 2/5,161 | 5/5,762 |

TABLE 15-continued

Second tier of variants found on the basis of variant burden analysis

| STXBP2 | chr19: 7712287, G > C | het | 2 | 0 | 0 | 161/32,104 | 4/4,626 | 11/5,686 |
|---|---|---|---|---|---|---|---|---|
| FAS | chr10: 90771767, G > A | het | 2 | 0 | 0 | 175/33,304 | 3/5,182 | 10/5,731 |
| GOLGB1 | chr3: 121415370, T > C | het | 3 | 2 | 0 | 1,111/33,349 | 26/5,179 | 84/5,779 |
| FUK | chr16: 70503095, A > G | het | 4 | 0 | 0 | 741/33,341 | 23/4,899 | 73/5,787 |
| IL10 | chr1: 206945738, C > T | het | 2 | 0 | 0 | 206/33,343 | 2/5,198 | 6/5,787 |
| ITK | chr5: 156593120, C > T | het | 2 | 0 | 0 | 206/33,353 | 5/5,203 | 5/5,789 |
| STIM2 | chr4: 27019452, C > T | het | 2 | 0 | 0 | 219/33,369 | 5/5,202 | 9/5,789 |
| ASH1L | chr1: 155317682, C > T | het | 2 | 0 | 0 | 218/33,367 | 2/5,203 | 17/5,789 |
| TBC1D16 | chr17: 77926526, C > T | het | 3 | 0 | 0 | 496/31,905 | 15/4,845 | 21/5,707 |
| LYST | chr1: 235840495, G > T | het | 3 | 0 | 0 | 517/33,239 | 10/5,156 | 35/5,756 |
| SALL2 | chr14: 21993359, G > A | het | 3 | 0 | 0 | 519/31,729 | 14/4,520 | 17/5,718 |
| CHD7 | chr8: 61757805, C > T | het | 3 | 0 | 0 | 517/32,880 | 14/4,872 | 41/5,765 |
| BLM | chr15: 91306241, G > A | het | 2 | 0 | 0 | 266/33,277 | 10/5,061 | 17/5,756 |
| NOD2 | chr16: 50741791, C > T | het | 0 | 2 | 0 | 285/33,369 | 21/5,203 | 2/5,789 |
| IGLL1 | chr22: 23915583, T > C | het | 2 | 0 | 0 | 265/33,334 | 21/5,183 | 26/5,787 |
| TTC7A | chr2: 47205921, C > T | het | 3 | 0 | 0 | 589/33,202 | 13/5,173 | 61/5,759 |
| KITLG | chr12: 88900891, C > A | het | 4 | 0 | 0 | 1,023/33,226 | 31/5,158 | 40/5,760 |
| ATR | chr3: 142281353, C > G | het | 4 | 0 | 0 | 1,037/33,343 | 14/5,130 | 69/5,785 |
| ATM | chr11: 108123551, C > T | het | 0 | 2 | 0 | 217/29,921 | 66/4,955 | 40/5,425 |
| CR2 | chr1: 207641950, C > T | het | 0 | 2 | 0 | 391/33,363 | 19/5,203 | 8/5,754 |
| HIVEP2 | chr6: 143092151, T > C | het | 3 | 2 | 0 | 1,718/33,370 | 50/4,901 | 209/5,788 |
| ITSN2 | chr2: 24431184, C > T | hom | 3 | 2 | 0 | 2,019/33,339 | 17/5,186 | 55/5,784 |
| ITSN2 | chr2: 24432937, C > T | hom | 3 | 2 | 0 | 2,026/32,472 | 17/4,958 | 56/5,672 |
| DOCK8 | chr9: 312134, G > A | het | 3 | 2 | 0 | 2,114/33,251 | 79/5,180 | 161/5,768 |
| VPS13B | chr8: 100205255, G > A | het | 0 | 2 | 0 | 811/33,345 | 19/5,192 | 100/5,778 |

TABLE 15-continued

Second tier of variants found on the basis of variant burden analysis

| | | | | | | | | | |
|---|---|---|---|---|---|---|---|---|---|
| NRIP1 | chr21: 16339852, T > C | het | 0 | 2 | 0 | 901/33,355 | 19/5,203 | 64/5,780 | |

| Gene | PML EUR OR | PML EUR FET | PML AFR OR | PML AFR FET | PML ALL OR | PML ALL FET |
|---|---|---|---|---|---|---|
| SHARPIN | 1122.00 | 0.000000 | NA | NA | 905.40 | 0.0000 |
| RTEL1 | NA | NA | 1240.64 | 0.0000 | 1268.41 | 0.0000 |
| IGLL1 | 83.53 | 0.000351 | NA | NA | 19.41 | 0.0006 |
| PGM3 | NA | NA | 20.81 | 0.0055 | 44.58 | 0.0011 |
| ATM | 14.00 | 0.001636 | NA | NA | 10.78 | 0.0032 |
| TMEM173 | 14.21 | 0.009863 | 2.39 | 0.2226 | 6.97 | 0.0033 |
| CLCN7 | NA | NA | 8.06 | 0.0308 | 19.18 | 0.0055 |
| MAVS | 4.04 | 0.021706 | 3.15 | 0.1480 | 3.98 | 0.0056 |
| ORAI1 | 7.64 | 0.002562 | NA | NA | 5.76 | 0.0064 |
| RBFOX1 | NA | NA | 7.37 | 0.0361 | 17.48 | 0.0066 |
| MALT1 | 7.03 | 0.003411 | NA | NA | 5.14 | 0.0093 |
| GFI1 | 6.68 | 0.039391 | 34.58 | 0.0347 | 6.80 | 0.0113 |
| DOCK2 | NA | NA | 12.63 | 0.0137 | 11.02 | 0.0155 |
| ATM | 16.98 | 0.007047 | NA | NA | 10.53 | 0.0169 |
| SNAP29 | 8.44 | 0.006584 | NA | NA | 5.79 | 0.0171 |
| TICAM1 | NA | NA | 7.03 | 0.0392 | 10.08 | 0.0183 |
| GTPBP4 | 7.24 | 0.009925 | NA | NA | 5.25 | 0.0220 |
| BACH1 | 11.72 | 0.014110 | NA | NA | 8.96 | 0.0227 |
| DOCK8 | 10.59 | 0.017020 | NA | NA | 8.31 | 0.0261 |
| STXBP2 | 9.45 | 0.021028 | NA | NA | 7.06 | 0.0350 |
| FAS | 9.01 | 0.022902 | NA | NA | 6.89 | 0.0365 |
| GOLGB1 | 2.12 | 0.180743 | 20.86 | 0.0055 | 2.71 | 0.0443 |
| FUK | 4.40 | 0.016488 | NA | NA | 3.13 | 0.0449 |
| IL10 | 7.66 | 0.030787 | NA | NA | 6.06 | 0.0458 |
| ITK | 7.66 | 0.030770 | NA | NA | 6.01 | 0.0466 |
| STIM2 | 7.21 | 0.034346 | NA | NA | 5.57 | 0.0532 |
| ASH1L | 7.24 | 0.034067 | NA | NA | 5.48 | 0.0548 |
| TBC1D16 | 4.63 | 0.031269 | NA | NA | 3.53 | 0.0584 |
| LYST | 4.63 | 0.031299 | NA | NA | 3.47 | 0.0606 |
| SALL2 | 4.40 | 0.035528 | NA | NA | 3.37 | 0.0650 |
| CHD7 | 4.58 | 0.032169 | NA | NA | 3.36 | 0.0654 |
| BLM | 5.91 | 0.048875 | NA | NA | 4.40 | 0.0799 |
| NOD2 | NA | NA | 25.97 | 0.0037 | 4.21 | 0.0860 |
| IGLL1 | 5.94 | 0.048403 | NA | NA | 4.15 | 0.0881 |
| TTC7A | 4.05 | 0.043427 | NA | NA | 2.94 | 0.0891 |
| KITLG | 3.15 | 0.046242 | NA | NA | 2.38 | 0.0964 |
| ATR | 3.12 | 0.047671 | NA | NA | 2.33 | 0.1021 |
| ATM | NA | NA | 7.80 | 0.0327 | 3.64 | 0.1093 |
| CR2 | NA | NA | 28.72 | 0.0031 | 3.09 | 0.1422 |
| HIVEP2 | 1.35 | 0.494339 | 10.21 | 0.0202 | 1.64 | 0.2458 |
| ITSN2 | 1.14 | 0.748301 | 32.01 | 0.0025 | 1.55 | 0.3862 |
| ITSN2 | 1.10 | 0.753875 | 30.59 | 0.0028 | 1.50 | 0.3937 |
| DOCK8 | 1.08 | 0.757661 | 6.80 | 0.0415 | 1.37 | 0.4238 |
| VPS13B | NA | NA | 28.66 | 0.0031 | 1.37 | 0.6600 |
| NRIP1 | NA | NA | 28.72 | 0.0031 | 1.30 | 0.6698 |

Table 15 lists the second tier of variants that were found on the basis of variant burden analysis, as described below. For each variant (genome coordinates are UCSC hg19), detailed information is presented of the numbers of EUR and AFR cases that carry the variant, along with the ethnic-specific and aggregate statistical metrics.

TABLE 16

Potential testing scenario, based on top variant burden hits

| | Proportion | | | Patient information | | |
|---|---|---|---|---|---|---|
| Gene/Variant | Cases solved | of Cohort (n = 70) | Test Method | Primary disease | Ethnicity | Gender |
| All 4 SNVs | 28 | 40% | genotyping | M, H, O | A, E | both |
| SHARPIN, IFIH1, PLCG2 SNVs | 24 | 34% | genotyping | M, H, O | A, E | both |
| IFIH1, PLCG2 SNVs | 13 | 19% | genotyping | M, H, O | A, E | both |
| SHARPIN SNV | 13 | 19% | genotyping | M, H | A, E | both |
| IFIH1 SNV | 7 | 10% | genotyping | M, H, O | A, E | both |

TABLE 16-continued

Potential testing scenario, based on top variant burden hits

| Gene/Variant | Cases solved | Proportion of Cohort (n = 70) | Test Method | Primary disease | Ethnicity | Gender |
|---|---|---|---|---|---|---|
| PLCG2 SNV | 7 | 10% | genotyping | M, H | A, E | both |
| CHD7 SNV | 5 | 7% | genotyping | M, H, O | E | both |

Table 16 lists a potential testing scenario, based on top variant burden hits (reported in Table 14). The analysis is for illustrative purposes only, it being acknowledged that greater diagnostic yields can be obtained by assaying for a larger number of variants, including those listed in Table 15. Examples are given for diagnostic yield using singleton variants, as well as a variety of combinations, including the use of the top 4 variants. For this set of variants, the test method is described as genotyping, as opposed to whole gene sequencing (i.e., determination of the status at each of the bases, which yields a binary output, as opposed to identification of variants elsewhere in the relevant genes).

TABLE 17

Potential testing scenario using genes identified as having
a greater burden of damaging, heterozygous variants in the PML cohort

| GENE | Ave CASES | Ethnicity | Ethnic-specific yield (%) | Overall yield (EUR + AFR) (%) | Test Method |
|---|---|---|---|---|---|
| PLCG2 | 17/44 | EUR | 38 | 38 | Gene sequencing |
| PLCG2 | 8/21 | AFR | 38 | | Gene sequencing |
| POLE | 8/21 | AFR | 38 | | Gene sequencing |
| POLE | 11/44 | EUR | 25 | 29 | Gene sequencing |
| LRBA | 11/44 | EUR | 25 | | Gene sequencing |
| EPG5 | 9/44 | EUR | 20 | | Gene sequencing |
| SHARPIN | 8/44 | EUR | 18 | | Gene sequencing |

Table 17 lists a potential testing scenario using genes identified as having a greater burden of damaging, heterozygous variants in the PML cohort (see Table 13). The nature of the testing method is 'gene sequencing' since the variants are not known in advance—any and all potentially damaging variants need to be considered in such an assay.

TABLE 18

Summary of genes that survive case-level,
gene burden and/or variant burden analyses

| Gene | Case Level | Variant Burden | Gene Burden |
|---|---|---|---|
| PLCG2 | Yes | Yes | Yes |
| CHD7 | Yes | Yes | |
| IFIH1 | Yes | Yes | |
| AP3B1 | Yes | | Yes |
| EPG5 | Yes | | Yes |
| PIK3CD | Yes | | Yes |
| LRBA | | Yes | Yes |
| SHARPIN | | Yes | Yes |

Table 18 represents a summary of genes that survive case-level (2 or more examples in Tables 7, 8), gene burden and/or variant burden analyses (based on Tables 13 and 14). Of note is that PLCG2 satisfies all 3 criteria (2 or more examples, in Table 8, presence in Tables 13, 14). This summary demonstrates that many genes have been identified as significant on the basis of independent analysis methods.

Example 11

Figures Referenced in this Study

FIGS. 1-12 represent example CNV data from the PML gene discovery study (71 PML cases, see Table 7 for patient information) using array CGH (methods described herein). In each figure/drawing: 1) genome coordinates are listed at the top (hg18 assembly, chromosome number and position depicted); 2) data track 1 (labeled 'Genes') depicts the location of the RefSeq genes (exons are dark gray portions of the bars, introns are light gray portions of the bars); 3) data track 2 (labeled 'Normal Cohort') depicts the size and location of CNVs found in the NVE cohort (PBio's proprietary control database consisting of CNV findings in apparently healthy—i.e. normal—subjects, see methods herein) with the y-axis corresponding to the number of NVE subjects that have the CNV; and 4) remaining data tracks are CNV data found in individual PML patients wherein the y-axis corresponds to the log 2 ratio (see methods herein), points represent individual probes on the microarray, and line segments are shifted positive (copy number gain) or negative (copy number loss) based on the output of DNAcopy, the CNV calling algorithm. Typical log 2 ratios for gains and losses on the Agilent 1M microarray (see methods herein) and our experimental protocols are: 0.6 for duplications, 1.0 for triplications (or homozygous duplications), −1.0 for heterozygous deletions, and <−2 (often −4.0 to −6.0) for homozygous deletions. Relevant genes are labeled in the 'Genes' data track.

FIG. 1 represents an example of a gene impacted by germline and acquired CNVs. Germline CNVs that impact the PRKCB gene include patient PML50 with a 4.8 Kb intronic heterozygous loss (also found in 7 Normal subjects) and patient PML11 with a 7.3 Kb intronic gain (also found in 1 Normal subject). Acquired CNVs were found in 6 PML patients, a series of gains at ~23.9 Mb with varying log 2 ratios, suggestive of a mixed cell population (array CGH experiments were performed on blood-derived genomic DNA).

FIG. 2 represents an example of potentially PML-relevant genes (TNFRSF13C and CENPM) impacted by acquired CNVs. Acquired CNVs were found in 9 PML patients, a series of gains at ~40.6 Mb with varying log 2 ratios, suggestive of a mixed cell population (array CGH experiments were performed on blood-derived genomic DNA). All 9 PML patients (see Table 7 for patient information) had a primary diagnosis of HIV and were mixed gender (3 females and 6 males) and ethnicity (4 African ancestry and 5 European ancestry).

FIG. 3 represents an example of a gene impacted by germline and acquired CNVs. A germline CNV, which is a 7.2 Kb intronic heterozygous loss (not found in Normal subjects, but an adjacent loss is found in 8 Normal subjects) that impacts the PKHD1 gene, was detected in patient PML26. Acquired CNVs were found in 3 PML patients, a series of gains at ~51.9 Mb with varying log 2 ratios, suggestive of a mixed cell population (array CGH experiments were performed on blood-derived genomic DNA).

FIG. 4 represents an example of a gene impacted by a recurrent CNV loss. The 14.7 Kb intronic deletion impacts the BMPR2 gene. Heterozygous deletions were detected in patients PML58 and MVGS811-13a (also found in 2 Normal subjects), and a homozygous deletion was detected in patient PML29 (none found in Normal subjects). All three PML patients are males and their primary disease is HIV (see Table 7).

FIG. 5 represents an example of a gene impacted by a recurrent CNV gain. The 10.2 Kb exonic gain disrupts the COMMD6 gene. Two PML patients, PML29 and MVGS811-13a, have a homozygous duplication (log 2 ratio comparable to triplications) based on the observation that 1000 genomes subjects are reported to have this gain (see hg19 assembly DGV variant esv3632749, which reports 148 of 2504 subjects as having this gain; no Normals were found in PBio's NVE db). Both PML patients are males and their primary disease is HIV (see Table 7).

FIG. 6 represents an example of a gene impacted by a recurrent CNV gain. The 27.4 Kb exonic gain disrupts the KCTD7 gene and the right breakpoint is 16-90 Kb upstream of RABGEF1 transcript variants (RefSeq: NM_001287060, NR_104676, NM_014504, NM_001287062, NM_001287061). Patient PML29 has a homozygous duplication (log 2 ratio comparable to triplications) based on the observation that 1000 genomes subjects are reported to have this gain (see hg19 assembly DGV variant esv3613515, which reports 28 of 2504 subjects as having this gain; no Normals were found in PBio's NVE db). Patient PML63 has a duplication. Both PML patients are males of African ancestry and their primary disease is HIV (see Table 7).

FIG. 7 represents an example of a gene impacted by a recurrent CNV gain. The 344 Kb exonic gain disrupts the FPR2 and ZNF616 genes (via left and right breakpoints) and additional genes fully encompassed by this CNV are: FPR3, ZNF350, ZNF350-AS1, ZNF432, ZNF577, ZNF613, ZNF614, ZNF615, ZNF649, ZNF649-AS1, ZNF841. Patient PML03 has a homozygous duplication (log 2 ratio comparable to triplications) based on the observation that 3 Normal subjects (PBio's NVE db) are found to have a duplication of this region, along with patient PML10. Both PML patients are females of European ancestry and their primary diseases are HIV and MS (see Table 7).

FIG. 8 represents an example of a gene impacted by a recurrent CNV loss. The 1.1 Kb exonic deletion impacts the PIK3CD and PIK3CD-AS1 (previous gene symbol was C1orf200) genes. A homozygous deletion was detected in patient MVGS811-13a and this loss (heterozygous or homozygous) was not found in Normal subjects or the DGV public CNV database. The PML patient is a male and his primary disease is HIV (see Table 7). He is presumed to be of EUR ancestry (ethnicities were not available for MVGS samples).

FIG. 9 represents an example of a gene impacted by an intergenic, recurrent CNV gain. The 16.7 Kb intergenic gain has a left breakpoint that is 105 Kb upstream of the CD180 gene (RefSeq transcript variant NM_005582). Patient MVGS995-4a has a homozygous duplication (log 2 ratio comparable to triplications) based on the observation that 1000 genomes subjects are reported to have this gain (see hg19 assembly DGV variant esv3605336, which reports 2 of 2504 subjects as having this gain; no Normals were found in PBio's NVE db). The PML patient is a male of European ancestry and his primary disease is MS (see Table 7).

FIG. 10 represents an example of a gene impacted by an intergenic, recurrent CNV loss. The 7.7 Kb intergenic homozygous deletion has a left breakpoint that is 3-4 Kb upstream of VDAC1 transcript variants (RefSeq: NM_003374, NR_036625, NR_036624). This loss (heterozygous or homozygous) was not found in Normal subjects or the DGV public CNV database. Patient PML30 is a male of European ancestry and his primary disease is HIV (see Table 7).

FIG. 11 represents an example of a gene impacted by an intergenic, recurrent CNV loss. The 6.8 Kb intergenic homozygous deletion has a left breakpoint that is 4 Kb downstream of EGR1 transcript variant (RefSeq: NM_001964) and 26 Kb downstream of ETF1 transcript variants (RefSeq: NM_001256302, NM_004730, NM_001282185, NM_001291975, NM_001291974). This loss was found to be homozygous in 1 Normal subject and the loss was also reported in the DGV public CNV database (see hg19 assembly DGV variant esv3606925, which reports 33 of 2504 subjects as having this loss, homozygous vs. heterozygous subjects are unknown). Patient PML69 is a male of European ancestry and his primary disease (condition) is kidney transplant (see Table 7, reported as 'Other'). Patient PML69 was treated with CTLA4-Ig (belatacept, a CD28-B7 costimulation blocker and T-cell anergy inducer). The CD28 pathway includes links to the patient's genetic finding (e.g., homozygous deletion adjacent to the EGR1 gene) and several other genes that may be related to immunodeficiency (e.g., CD40LG, ITK, LCK, LRBA, PIK3CD, PIK3R1, PLCG2, WAS, and ZAP70) (Dekeyser M et al. Open Forum Infect Diseases, 2016, Refractory T-Cell Anergy and Rapidly Fatal Progressive Multifocal Leukoencephalopathy following Prolonged CTLA4 Therapy).

FIG. 12 represents an example of a gene impacted by an intergenic, recurrent CNV loss. The 5.6 Kb intergenic homozygous deletion has a left breakpoint that is 20 Kb upstream of ITSN2 transcript variants (RefSeq: NM_019595, NM_006277, NM_147152). Heterozygous losses were found in 50 Normal subjects and the loss was also reported in the DGV public CNV database (see hg19 assembly DGV variant esv3590068, which reports 222 of 2504 subjects as having this loss, homozygous vs. heterozygous subjects are unknown). Patient PML65 is a male of African ancestry and his primary disease is HIV (see Table 7).

FIG. 13 represents an example of known and/or predicted protein interactions using the String database (string-db.org; see Szklarczyk et al., (2015) and references therein). A non-redundant list of all genes reported in Table 7 (43 genes, which included those whose expression was inferred to be impacted by a nearby intergenic CNV) as best solutions/explanations for 61 of 71 PML cases (11 PML cases are reported as 'unsolved', including 1 case for which only CGH data was obtained) was assessed using the String db. The 'minimum required interaction score' was set to 'high confidence (0.7)' and no additional 'interactors' were added. Of the 43 input genes, 21 were found to have high confidence interactions, as shown in the figure, along with annotation of the number of PML cases that had each of these genes as a solution/explanation (e.g., 3 PML cases in Table 7 were found to have a PLCG2 solution).

Example 12

Gene Burden Analysis

Gene burden analysis was performed as follows. Using a variety of in-house scripts, and data downloaded from ExAC (exac.broadinstitute.org), a count was performed for all variants occurring in each of the 419 genes listed in Table 6. Each variant was classified according to whether it was deemed damaging (on the basis of at least one of the prediction algorithms SIFT, PolyPhen2 or MutationTaster) or non-damaging, heterozygous or homozygous. This was performed in parallel for PML variants and those found in ExAC. ExAC data for which quality/coverage was <80% of expected was not used and gene burden analysis could not therefore be performed.

An ethnic-specific (EUR or AFR only, there were too few LAT cases for this type of analysis) comparison was then performed for each of 4 categories:
Homozygous damaging
Homozygous non-damaging
Heterozygous damaging
Heterozygous non-damaging For all 4 categories, variants with minor allele frequency (MAF) cutoffs of 0.01, 0.02. 0.03. 0.04, 0.05 and 0.1 were considered.

For each comparison, odds ratios (OR) and Fisher's exact test (FET) were calculated for the comparison of numbers of PML cases with at least one variant of the type under consideration and those in ExAC. Correction for multiple testing was performed by multiplying the FET by the number of genes being considered (419). Only genes for whom the FET_corrected was <0.05 were included in Table 13, which contains data on the average values for a given gene at all MAFs that passed FET_correction. In practice, only the category of heterozygous damaging yielded significant genes.

Example 13

Variant Burden Analysis

For each variant identified in at least one PML case, a count was performed in order to obtain the frequency of the same variant in the cohort as a whole. This aggregate data was compared to counts for the same variant as reported in ExAC. ExAC data was filtered for quality/coverage and variant burden analysis was not performed if ExAC coverage was <80% expected.

Variant burden analysis was performed separately for EUR (n=44 cases) and AFR (n=21 cases) cohorts (LAT cohort was too small) and the OR and FET values calculated. From this analysis, only variants with OR>1 (i.e., potentially indicative of increased risk for PML) for both ethnicities (AFR and EUR) and for which the ExAC frequency of the variant was <5% were considered. Furthermore, only those variants for which the frequency in the ethnic-specific cohort was >10% (5 or more EUR cases, 3 or more AFR cases) were considered top-tier (Table 14), although other variants have been tabulated in Table 15.

Example 14

Exemplary PML Risk Prediction Tests

Table 16 provides exemplary markers for creating a low-cost, simple (genotype specific SNVs) PML risk prediction test. Other embodiments could be similarly devised from other SNVs reported in Tables 14 and 15. Different combinations of SNVs from Tables 14, 15 could be utilized in tests of varying complexity, to develop a test that would yield higher diagnostic yields than the top example listed in Table 16 (i.e., 40%).

Table 17 provides exemplary genes that could be included in a gene panel sequencing test for PML risk prediction. Other embodiments could be similarly devised from genes reported in Table 13, or from other tables disclosed herein.

Table 9 contains 'example' variants that may be considered as 'AD' causes of immunodeficiency (i.e., presence of just 1 of the 2 reported het SNVs in a given patient may be causing immunodeficiency), which may increase the risk for PML. For example, this may be a more likely scenario for het SNVs that are 'novel' in the ExAC db (i.e., not found in the general population), and even more likely if such novel SNVs are found in >=2 PML cases (irrespective of the invoked disease model). Examples of this include the following 3 genes:
  AK2, 2 cases (Table 9)
    chr1:33476435, C>A, novel in ExAC
    PML20 and PML33, AFR and EUR, both HIV
  EPG5, 2 cases (Table 9)
    chr18: 43445601, T>G, novel in ExAC
    PML25 and PML27, both EUR, both HIV
  TNFRSF11A, 9 cases (Table 7)
    chr18: 60052034, A>C, novel in ExAC
    see Table 7 for case IDs, 2 AFR and 7 EUR, all HIV It can be appreciated by those skilled in the art that immunodeficiency genes presently known to cause AR disease may potentially cause AD disease. Numerous examples have been reported in the literature, including several of the genes listed in Table 6 (e.g., Disease_model is indicated as AD_AR for 32 genes, such as ADAR and TICAM1).

Example 15

Exemplary 96-gene Panel PML Risk Prediction Tests

Table 19 contains an exemplary 96-gene panel based on genes that were found to have at least one PML case count from Tables 7 and 8. The "Genes" and "Case_level_solutions" columns showed genes and total number of PML cases (with at least one 'case level' solution) reported in Tables 7 and 8. In addition, the top 7 genes (CHD7, IFIH1, IGLL1, MAVS, PLCG2, SHARPIN, TCIRG1) from Table 14 with SNVs based on 'PML_ALL_FET' values <0.05 (column O) were also included in Table 19. Among these 7 genes, 3 genes (IGLL1, MAVS, SHARPIN) with SNVs were based on 'PML_ALL_FET' values <0.05 (column O) from Table 15.

TABLE 19 exemplary 96-gene panel

| Genes | Case_level_solutions |
| --- | --- |
| AP3B1 | 5 |
| APOL1 | 1 |
| ASH1L | 1 |
| ATM | 1 |
| ATR | 3 |
| BLM | 1 |
| CARD11 | 3 |

TABLE 19-continued exemplary 96-gene panel

| Genes | Case_level_solutions |
|---|---|
| CDKN1B | 1 |
| CHD7 | 4 |
| CLCN7 | 1 |
| DCLRE1C | 3 |
| DDX58 | 1 |
| DOCK8 | 8 |
| EGR1 | 1 |
| EPG5 | 3 |
| ETF1 | 1 |
| FPR2 | 1 |
| GATA2 | 2 |
| GFI1 | 4 |
| HIVEP1 | 1 |
| HIVEP2 | 2 |
| HTR2A | 1 |
| IDO2 | 1 |
| IFIH1 | 3 |
| IFNGR2 | 1 |
| IFNLR1 | 1 |
| IGLL1 | 0 |
| IKBKB | 1 |
| IL17F | 1 |
| IL1B | 1 |
| IL21R | 1 |
| IRAK4 | 2 |
| ITSN2 | 2 |
| JUN | 2 |
| KAT6B | 1 |
| KCTD7 | 1 |
| LIG4 | 1 |
| LRBA | 1 |
| MALL | 1 |
| MAPK3 | 2 |
| MAVS | 0 |
| MCEE | 1 |
| MKL1 | 1 |
| MYD88 | 1 |
| NBN | 1 |
| NFKB1 | 3 |
| NOD2 | 6 |
| NRIP1 | 1 |
| PIAS1 | 1 |
| PIAS2 | 1 |
| PIK3CD | 4 |
| PIK3CD-AS1 | 1 |
| PIK3R1 | 1 |
| PKHD1 | 3 |
| PLCG2 | 5 |
| PNPT1 | 1 |
| POLA1 | 1 |
| POLE | 1 |
| PRF1 | 1 |
| PRKCB | 1 |
| PRKCD | 1 |
| PRKCH | 1 |
| PRKDC | 4 |
| PSTPIP1 | 1 |
| PTEN | 1 |
| PTPRC | 2 |
| RABGEF1 | 1 |
| RAD51 | 1 |
| RAG1 | 4 |
| RAG2 | 2 |
| RIPK1 | 1 |
| RIPK3 | 2 |
| RNF168 | 2 |
| RTEL1 | 2 |
| SHARPIN | 1 |
| SKIV2L | 1 |
| SMAD4 | 1 |
| STIM1 | 2 |
| STIM2 | 1 |
| STXBP2 | 3 |
| TAP2 | 1 |
| TBK1 | 2 |
| TCIRG1 | 1 |
| TICAM1 | 2 |
| TLR3 | 2 |
| TLR4 | 1 |
| TNFRSF11A | 10 |
| TNFRSF13B | 1 |
| TNFRSF8 | 1 |
| TP53 | 1 |
| TRAF3 | 1 |
| TRAFD1 | 1 |
| TRPM2 | 1 |
| VPS45 | 1 |
| WEE1 | 2 |
| ZAP70 | 3 |
| TOTAL (96 genes) | 172 |
| Non-redundant cases | 67 |
| Dx yield for PML cohort (n = 70) | 95.7% |

The non-redundant number of PML cases and diagnostic yield are listed in the last 2 rows of Table 19. Specifically, a test including the 96 genes had a diagnostic yield of 95.7% based on the genetic findings from the 70 PML cases used in the present study.

Example 16

Exemplary 39-gene Panel PML Risk Prediction Tests

Table 20 contains an exemplary 39-gene panel based on genes that were found to have multiple PML case count from Tables 7 and 8. The "Genes" and "Case_level_solutions" columns showed genes and total number of PML cases (with at least two 'case level' solutions) reported in Tables 7 and 8. In addition, the top 7 genes (CHD7, IFIH1, IGLL1, MAVS, PLCG2, SHARPIN, TCIRG1) from Table 14 with SNVs based on 'PML_ALL_FET' values <0.05 (column O) were also included in Table 20. Among these 7 genes, 3 genes (IGLL1, MAVS, SHARPIN) with SNVs were based on 'PML_ALL_FET' values <0.05 (column O) from Table 15.

TABLE 20 exemplary 39-gene panel

| Genes | Case_level_solutions |
|---|---|
| AP3B1 | 5 |
| ATR | 3 |
| CARD11 | 3 |
| CHD7 | 4 |
| DCLRE1C | 3 |
| DOCK8 | 8 |
| EPG5 | 3 |
| GATA2 | 2 |
| GFI1 | 4 |
| HIVEP2 | 2 |
| IFIH1 | 3 |
| IGLL1 | 0 |
| IRAK4 | 2 |
| ITSN2 | 2 |
| JUN | 2 |
| MAPK3 | 2 |
| MAVS | 0 |
| NFKB1 | 3 |
| NOD2 | 6 |
| PIK3CD | 4 |

TABLE 20-continued exemplary 39-gene panel

| Genes | Case_level_solutions |
|---|---|
| PKHD1 | 3 |
| PLCG2 | 5 |
| PRKDC | 4 |
| PTPRC | 2 |
| RAG1 | 4 |
| RAG2 | 2 |
| RIPK3 | 2 |
| RNF168 | 2 |
| RTEL1 | 2 |
| SHARPIN | 1 |
| STIM1 | 2 |
| STXBP2 | 3 |
| TBK1 | 2 |
| TCIRG1 | 1 |
| TICAM1 | 2 |
| TLR3 | 2 |
| TNFRSF11A | 10 |
| WEE1 | 2 |
| ZAP70 | 3 |
| TOTAL (39 genes) | 115 |
| Non-redundant cases | 57 |
| Dx yield for PML cohort (n = 70) | 81.4% |

The non-redundant number of PML cases and diagnostic yield are listed in the last 2 rows of Table 20. Specifically, a test including the 39 genes had a diagnostic yield of 81.4% based on the genetic findings from the 70 PML cases used in the present study.

Example 17

Exemplary 23-gene Panel PML Risk Prediction Tests

Table 21 contains an exemplary 23-gene panel based on genes that were found to have multiple PML case count from Tables 7 and 8. The "Genes" and "Case_level_solutions" columns showed genes and total number of PML cases (with at least three 'case level' solutions) reported in Tables 7 and 8. In addition, the top 7 genes (CHD7, IFIH1, IGLL1, MAVS, PLCG2, SHARPIN, TCIRG1) from Table 14 with SNVs based on 'PML_ALL_FET' values <0.05 (column O) were also included in Table 21. Among these 7 genes, 3 genes (IGLL1, MAVS, SHARPIN) with SNVs were based on 'PML_ALL_FET' values <0.05 (column O) from Table 15.

TABLE 21 exemplary 23-gene panel

| Genes | Case_level_solutions |
|---|---|
| AP3B1 | 5 |
| ATR | 3 |
| CARD11 | 3 |
| CHD7 | 4 |
| DCLRE1C | 3 |
| DOCK8 | 8 |
| EPG5 | 3 |
| GFI1 | 4 |
| IFIH1 | 3 |
| IGLL1 | 0 |
| MAVS | 0 |
| NFKB1 | 3 |
| NOD2 | 6 |
| PIK3CD | 4 |

TABLE 21-continued exemplary 23-gene panel

| Genes | Case_level_solutions |
|---|---|
| PKHD1 | 3 |
| PLCG2 | 5 |
| PRKDC | 4 |
| RAG1 | 4 |
| SHARPIN | 1 |
| STXBP2 | 3 |
| TCIRG1 | 1 |
| TNFRSF11A | 10 |
| ZAP70 | 3 |
| TOTAL (23 genes) | 83 |
| Non-redundant cases | 50 |
| Dx yield for PML cohort (n = 70) | 71.4% |

The non-redundant number of PML cases and diagnostic yield are listed in the last 2 rows of Table 21. Specifically, a test including the 23 genes had a diagnostic yield of 71.4% based on the genetic findings from the 70 PML cases used in the present study.

Example 18

Exemplary 15-gene Panel PML Risk Prediction Tests

Table 22 contains an exemplary 15-gene panel based on genes that were found to have multiple PML case count from Tables 7 and 8. The "Genes" and "Case_level_solutions" columns showed genes and total number of PML cases (with at least four 'case level' solutions) reported in Tables 7 and 8. In addition, the top 7 genes (CHD7, IFIH1, IGLL1, MAVS, PLCG2, SHARPIN, TCIRG1) from Table 14 with SNVs based on 'PML_ALL_FET' values <0.05 (column O) were also included in Table 22. Among these 7 genes, 3 genes (IGLL1, MAVS, SHARPIN) with SNVs were based on 'PML_ALL_FET' values <0.05 (column O) from Table 15.

TABLE 22 exemplary 15-gene panel

| Genes | Case_level_solutions |
|---|---|
| AP3B1 | 5 |
| CHD7 | 4 |
| DOCK8 | 8 |
| GFI1 | 4 |
| IFIH1 | 3 |
| IGLL1 | 0 |
| MAVS | 0 |
| NOD2 | 6 |
| PIK3CD | 4 |
| PLCG2 | 5 |
| PRKDC | 4 |
| RAG1 | 4 |
| SHARPIN | 1 |
| TCIRG1 | 1 |
| TNFRSF11A | 10 |
| TOTAL (15 genes) | 59 |
| Non-redundant cases | 39 |
| Dx yield for PML cohort (n = 70) | 55.7% |

The non-redundant number of PML cases and diagnostic yield are listed in the last 2 rows of Table 22. Specifically, a test including the 15 genes had a diagnostic yield of 55.7% based on the genetic findings from the 70 PML cases used in the present study.

Example 19

Exemplary 11-gene Panel PML Risk Prediction Tests

Table 23 contains an exemplary 11-gene panel based on genes that were found to have multiple PML case count from Tables 7 and 8. The "Genes" and "Case_level_solutions" columns showed genes and total number of PML cases (with at least five 'case level' solutions) reported in Tables 7 and 8. In addition, the top 7 genes (CHD7, IFIH1, IGLL1, MAVS, PLCG2, SHARPIN, TCIRG1) from Table 14 with SNVs based on 'PML_ALL_FET' values <0.05 (column O) were also included in Table 23. Among these 7 genes, 3 genes (IGLL1, MAVS, SHARPIN) with SNVs were based on 'PML_ALL_FET' values <0.05 (column O) from Table 15.

TABLE 23 exemplary 11-gene panel

| Genes | Case_level_solutions |
| --- | --- |
| AP3B1 | 5 |
| CHD7 | 4 |
| DOCK8 | 8 |
| IFIH1 | 3 |
| IGLL1 | 0 |
| MAVS | 0 |
| NOD2 | 6 |
| PLCG2 | 5 |
| SHARPIN | 1 |
| TCIRG1 | 1 |
| TNFRSF11A | 10 |
| TOTAL (11 genes) | 43 |
| Non-redundant cases | 33 |
| Dx yield for PML cohort (n = 70) | 47.1% |

The non-redundant number of PML cases and diagnostic yield are listed in the last 2 rows of Table 23. Specifically, a test including the 11 genes had a diagnostic yield of 47.1% based on the genetic findings from the 70 PML cases used in the present study.

Example 20

Exemplary 10-gene Panel PML Risk Prediction Tests

Table 24 contains an exemplary 10-SNV panel based on top 7 SNVs in Table 14 and 3 SNVs from Table 15 (based on overlapping genes between 14 and 15: IGLL1, MAVS, SHARPIN). Specifically, Using the top 10 SNVs (7 from Table 14, along with 3 from Table 15, residing in genes already selected from Table 14), an additive count (column "Case total additive (non-redundant)") was performed to determine how many PML cases had at least one of the variants when these were considered in order (e.g., column "Order (FET)": '1', first, followed by '1'+'2', followed by '1'+'2'+'3', etc). Since some individuals harbor more than one variant, the additive count is not equal to the simple sum of PML case numbers for each variant (column "Case total per SNV"). All genome coordinates are based on hg19 build.

An additive count was performed for ExAC subjects (column "ExAC subjects total additive (redundant)"), as follows: i) The average cohort size for ExAC for all variants was calculated; ii) Each total subject count (all ethnicities) was normalized to this average cohort size. The ExAC additive count represents a simple addition: labeled as "redundant" in column "ExAC subjects total additive (redundant)", because information regarding the possible presence of multiple variants in the same individual is not available; iii) Odds Ratios (ORs) and Fisher's Exact test (FET) values were calculated (columns "PML ALL OR additive" and "PML ALL FET additive").

TABLE 24 exemplary 10-gene panel

| Order (FET) [1] | Table source | Gene | Variant (hg19) | Geno-type | Case total per SNV | Case total additive (non-redundant) [2] | Dx yield (non-redundant) | ExAC subjects total additive (redundant) [3] | PML ALL OR additive | PML ALL FET additive |
| --- | --- | --- | --- | --- | --- | --- | --- | --- | --- | --- |
| 1 | 14 | PLCG2 | chr16: 81942175, A > G | het | 7 | 7 | 10% | 730 | 6.50 | 2.00E−04 |
| 2 | 14 | IFIH1 | chr2: 163136505, C > G | het | 7 | 13 | 19% | 1,473 | 6.49 | 6.37E−07 |
| 3 | 14 | TCIRG1 | chr11: 67818269, G > A | het | 4 | 16 | 23% | 1,830 | 6.73 | 2.94E−08 |
| 4 | 14 | IGLL1 | chr22: 23917192, G > T | het | 8 | 22 | 31% | 3,388 | 5.42 | 9.41E−09 |
| 5 | 14 | MAVS | chr20: 3846397, C > T | hom | 8 | 26 | 37% | 4,947 | 4.60 | 2.13E−08 |
| 6 | 14 | SHARPIN | chr8: 145154222, G > A | het | 12 | 33 | 47% | 8,064 | 3.91 | 5.10E−08 |

TABLE 24-continued exemplary 10-gene panel

| Order (FET)[1] | Table source | Gene | Variant (hg19) | Geno-type | Case total per SNV | Case total additive (non-redundant)[2] | Dx yield (non-redundant) | ExAC subjects total additive (redundant)[3] | PML ALL OR additive | PML ALL FET additive |
|---|---|---|---|---|---|---|---|---|---|---|
| 7 | 14 | CHD7 | chr8:61654298, T > A | het | 5 | 36 | 51% | 9,292 | 3.89 | 3.26E−08 |
| 8 | 15 | SHARPIN | chr8:145154824, A > C | het | 3 | 37 | 53% | 9,294 | 4.12 | 8.10E−09 |
| 9 | 15 | IGLL1 | chr22:23915745, G > A | het | 3 | 38 | 54% | 9,394 | 4.30 | 2.59E−09 |
| 10 | 15 | MAVS | chr20:3843027, C > A | hom | 6 | 38 | 54% | 10,393 | 3.77 | 5.26E−08 |

[1] SNV order based on lowest FET value reported in Tables 14 and 15 for combined ethnicities
[2] PML case total = 70
[3] ExAC subject total = 43,419 (average for the 10 SNVs)

It can be appreciated by those skilled in the art that the above gene panels were selected based on the present genetic findings in 70 PML cases. Furthermore, a gene not presently selected for any of these exemplary gene panels may be added to the gene panel. For example, genes in which only 1 PML case was found to have variants fulfilling the criteria may be added to the gene panel if genetic validation in additional PML cases shows a 'n=1 case' gene is impacted by more than 1 PML case when the data are examined for a new set of PML cases. In some cases, additional genes (e.g., PML-linked genes such as DOCK8, BAG3, STAT1) may be added to the gene panel.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (2177 sequences)

SEQ ID NO: 1 - DNA, 49654 bp, Homo sapiens
cttctggggtctaaggccagaagtgacctttcttctcacggaggcacccccacatcacaggccccaagctcccaccaggagtccccaggcagcaggttttccaccacagccgggaagagccccgccttcaccacccaccaccagccaatcccgagaccaccgaagcccccagaccgggccctttgcccctcctgccccccggctctccctactgcccagagcctccgccagcacccagggacccacgtccacctcccagagcggccctgcccagggtccttccctgccctccacgattctccgtggcccttggagaaagagcagcttctccccaggctctgcccccagcccttccaccccagagcctctgcccagacgtcccgtcccatcccggggggctgtcacgcttccgccccacctctcgcccattcccggacagtcacagccgtggaacaacgcagcgtgtggacacagccccagggaagcttgactctgcctggtccccatggcgtgcggtggctcaccagccgcccccatcgctccatgaaatctgactacacctgtcccaaaaatcaaccagctcccaggcaggtcccgccgtgcagggggccaagggccacacctgggaccagtgagtgaggcggcgtgcgggtagtgggggtgtgagcccgagacgggggtccagccttctcccacttggatgccaacagcagactctggatttggaggtgtgggcggtgccttagtctccccagaagacaagagcccacccgccgggtgtgtcctgaccccacccccacctgccccacacagacacctgagtgggcatcagagtgggccgggccctgactgtccgggggagggactgttggggcaagggcagtgggtcagaggtcaccggtgcccccaggaccagtttccagcgagaagagagccaggagccccgggcacaggcccacggtgatgaggctcctgaccgagctcccagagctcattatggaaaaccgtggggtccgctgggacctctctgctggtcgggctaattacagaccgtttgtcgtttcattatgggctcttcctctgggagatgcgagaagcaaacactttgccatgggaggggcgcttcccggaccgggcgggggccctgccctccccacccccagacccctggtcccccaggccttccaagctcccaaagaaaacttgaacccccactccaggggctccaaagtaacctccagagcccagatggggatgttccgggagctgctggggcctctcagctgtccctgcctcgcagggaggctcaggaaggcacccacacccctccctcattcccccagctgtgggtctgtggggtctcggagcctcttgcccattggggtgggactgggggcacgtagctcctccgagcccctggcgaggagaccgatcctgagacccacctgggcctacggggggtcccttcattgctccaaaattaagggctgcgggcctggagcaaagacaggcaggtatggcccctgccctctgtccatgagaggcctcagccccatgggacagggcaccaccgctgcagggaggcggcgggcaggttgtgacccctcaccctggggccaccctacccgcttctaaggcagcctgggaaggagccctgcggagctggggggtggggaggcagaggtggagaggcgagagttgcccgcggctgcccctacccctgcccatgtcgcccacactccacacgggccccacagaagccttcccatcctggcttttgttcaacctcggtgggcggcaaggtgggggcgggacggagtctgcggggcctgcggggcccgggcctgcgtcaccgtcactggcccgcctcccgcccggcctatgggagcccaggggacacacctgtcgggggccaggagcggagattggccagcgggagctcgcacctgtgtggggcggggagcactgctccttgtaaggcgagcccccgccgagccggctcttccctcccgaggcccccacctcgccaccgcctcccattgtcccgtcgccctcgaaactctcccagagacgggcgagttgtccacctgtgcaggtctgaactgacttcctgtgccagggcctcgcctgagcgggggcaggaagctcacccttgcaggtctccccgcgccaacggacgccctgaggcctgaccctggctgaggcagagcacccagctccgtggaccgggacggacgggctcaggtgccccccattccttccgaagccggttcacacccacccgggcctggcacaggggaggcgctggctgcagggtcggggcgggagcagcctcaacccggctcctgggccgcggccgcagcagtggaacctgtcggggcaggtaagggcgggcagcggggaggctgaggcgcagggggaggcggctccctgcaggggggccctcgccagcccccgccgtggccgacgtggggcaggggcgcaggtgacagatgggctgtcgccagcctggccagcgtccaggggagctccggtcactgcagacacaggctggagcgggtccttcccccccccagggaaaggtgggcccctgcgcagatgcggctgggtttcgggtgtggagccatcttggacccacgggctgcgtcttccgggcacgggcacagtgtgtgggctccaggcatggggtgccctcagggcagggcctgggcagagggcaggctccgagaggggtcacgttcttgccgcctacctgacagcaggccttctagaaagttctctccagaagcagccaccgccgtcctgaggcactttgtgcggagacgggaagctgtcgcctcagaggtgggtgcgtagaagggtttggccgggtgcgaggatgaccgcgtctcccttgggctctggagtctgcggtgggaagggcttggtttcagcaccctctggtcagaggccggccgagcccatgggcggtgaggttggtgcctggggtcgtggctggtctggtacaggtggggctcagcccggagaagctggagccggttcccaggccccgcgctatgactggggtgggggcaacgtctctcgtgaggttttttacttaaatgtgaaacggctcagtacggtggccgcagccgggaacaaggtccgacccaccgaggcccagccttgaacttgccgcgggggcacctgaacacggttttacagcccggatcactggctttcttgaagtttgggaactgattgatcatggtggcgggaggtaaggttcattgttcttgatgaacaaaattcttagggcgtgaagagccgatgctttaattaaccccccgggagcgtctcaggcctccccccgggagcgtctcaggccccgtttacgctgagtgtctggggaaagacgtggtttggttttgtttttctagtaacccagatgaaatgtttaaaagcatggttggcagcacattgaatttggcaaaattaaggtttgcatttgtgaaaatgcggatgcagtttgcggttcttttcagacattttggtaatttgcaaatacttatttgcgaaacgagtttgtcagaacattttttagtatctagaggaagatgagatgggccgaggaggtcgcgcacccctggatccctggaggagctggtgtgttctctgtggggcgggtggacgtggcccggacacacgggccgtgctcacagccggcctgcgagggctgcaaatccacgcccgccgtgtgggtgaaatggcggctttgcctcccagacgcgtagctccggcgacgcagagggaagaacctgagtgcccgccaggccgagctccgcaccccaccccccggcagcctctgactcccggctcggctcccgcggtcggggagggttggatttcacactttgttctcgaggccgcaccattgattaagcccgtcgggcaggttaaccaacaagttaggttttcacgccgggatcacattcctcgccgggcgctcccaccccaccccagcctgtgcaggtgggacccggccaggcaggcgggcagggcggccaggtgcgccgaggggcgcctccacggggagtgtgctccgcagagaaccccttgctggggcggctctgggcctcctgactcactcctggattttcccaagctgagtctggccccgcggtgatgattaacccaacacctcaaccggcaccgccacgctagctccacttcccggcgacggttgacaagaaagcgccgcgtggggctctcggaaaacagggaaggtccgttttcgcttttcatttcttgacctgtggccacggtaagactcggccgcctgcccacccgactccttgcccctcacccctgtgccaggcacaaggccctgcgaaatccttggtcccccagctgagcctgccggcccaggccaccatctccccacccagccctggagccagggtcggcctctcctgctagctgctcgttggctttacagcttctgcactcaggaggcgcctgggaatcctgccctggaacttaggaaggaggcttctcccacctgcctgccacacgggtctgtccctgggtcccagcctctgccgtgtgcccctcagcctcccgggtgagaacgcaatgactgatgagcctggggtggccaggccagctctggccctgtggggttcctgagaaggctggccctgggtggccaagggcctggggacactggccccgggccctgaacctggcagtgggaggccggcccgtccgccgggtgggctgggaactgtgtttggccccagctgcaagggacgagtgccgggcacctgctgccctccccacgtgacctggcagccaggaatggagctgaaattcaactctgctctgaacgggaagtcttagtttcctttagctcagaaaacaggtgaaattgtgttcctgaagcactgatttgatgggatttgatggcattggtggcgaaggcctgtgaggtgatggaaagggaaagccgggtgccctggagcctgacaggctggggccagggcaggggacctggtgtggggtctccggagagggtccaggcgtgagggaagctgggtcaggacctcggagacgtggcctttggaggaggagactggaaccgggtggacccggcagcaggcgggggcgggcggacacgacctttgttgtggtcggcgggcagacaggggaatcggcacagggcctgcgccccacctacagcctctgtgggtggaaggtgccagaaaacttgaagagtggctctggccagctctctgggcccagttggcaccaggtggttgcagagaaagggtgggaaggaggacaggaaggacggcgtgtccagcgggcggggagccttggtctggcctgagggctgaacctccctcgggtcctgagtgtgcctggagtagaagcctagggtctctgggctccaggcagggccctgagcaaggaggggccacagggctgcccacttcctcctgcccccctgcagaggcggctcagccctcgcggcgtctgaggcttgactgcctgtgtctgtgtttgtggccggtctgcctctgtgcctgggtcagaccccagaccagcagacacacaaaccgcagggacggctgggcagggtcaggagcctgccccgcccgcacccccacccacacccccacccccacccccgcctgcaccccctgccctcagacgctgtgcagtgagcggggcagcatgggagaggggtctccaggtggcggggaccgttctgtctcgagagcctcgcagacaccgggcctttgagaagagaaggggctgggcagggaagcagctcctggaacaccatcctggagacagaggcccttgtcccctgcctcagacaaggcagcacgtggggcccggggggctggggctgctgtccaggccttcctatgggaccacccagagggaaggtcccccgcagaggggtgggggcagagggccgagcggggcgggcagagggcccgtgtcagccccactccgacctagtcctcggccgtctggccaggacacttcggccccccaggtgcccaccccaggacccaaagctggtggctgctggactcggcagggctggcgggtggggctcacccgggcccctgccctccggcgatgctgtcctcagtgccccaggaggacgaggccccccagctactgagcttcccagcgagtcccatgcaaccctcagccgggcggcccccggacccagctcgggcagccgtggccatcttactgggcagcattggatggagtcaggtctctaatactgcctggtaatgatgacggcggagccctgcacgcagcgaccggccgaccccgtcccggcccccagggcctcccgccgagccccacactcccctcccacacagcccgctcaccggaccccaccccgtccgggccagatggctctggggagagtgacggggggacgtgaccttcggaagggggctggggcgccccccaccagcatctcagagaccccggaatgcaaggcctcctgcagctgcacccagggcgccccacagtgatctggggattaggacgctcaggtgtccgggccctgcccacagcgcctgggcgggagctgctgtcacacccagcaggtgcgggccgagcaggacccaacagagggctcaggagggcaaggcccaaccgggagccacgtggaacccagaggaagccgccccacccagcttggccacagccatcttccctcctgccggacagggtgggccggccaccgagcagaccagtgcccccgccttggtcccgggtcagcagccccagggtccccttgccctggaggaagcagggagggtgggcctgtgtgcagtctcagggcccccaagcccctctccgccagccctgtccggtcccggcaccacccctggctgctcaccgctccggttcttccctgggcttccacagcagcccctgcctgcctggcgggaccccacgtccctcccgggcccctgtgagcatcttaccggacagtgctggatttcccagcttgactctaacactgtctggtaacgatgttcaaaggtgacccgccgctcgccggggacaccaccgaggcacatccggagctcctactccagggatgggctggggcggagggccgagcggggccagcagacgggtgagggcggagggccgagcggggccagcagacgggtgagggcggagggccgagcggggccagcagacgggtgagggcggagggctgagcgggcggcagagggcctgtgtcagctccgaagtccagcccccaggggaggggccggcctctgccgggggtgcccccggggtcactcacgcccaggctgggtctgacaccttgaggaccccttggtgcctccacaggtggcctggagggcatcctgctccccctcccggagccgctgtgcctcccccacccaacctcccaggctgggttttagggtgacctggctccaggaaaggccatagggctgggatgccagggctggagagggaagagcaacagtggcctctctcacgtggtccgggctccgtggagggtctgctgggggcgcaggaaggacaaggtgggttcagattcccgagccccaccatgcaggggagcggggacgctctgcgcttgccctctgagggacaaggggtctcattccttcccccagtcaacaagaacaggaactttgtccaaaacccaccaggccaggatgacccattgtttcatcttttccatctgcaaccagggcgcctgggaccgcacccccacacaaggccccagcctggggagggggcagccaccggggagaggctgcccttcactgttactcattaacccgaccgagcttcaggaagccagcgaggggctgcagggaacctttgccaagagcagggcctgggtgaccaggtggctcccgggtacccccacacagccaggctgggctgggaccaggtgctgggatgggggctgtcagggaagtgcctcgggggctcgttctgcagacccaggagggatcagggcagctgcaggaggtggcaggagccgcccccggggccttcccttcacaggccccgcagacaccagcccaggacccggaggccacccacaccaccgccggccgatgggcgtcttaccagacatggttagacctggccctctgtctaatactgtctggtaaaaccgtccatccgctgcctgatcaccgttagaggagagagctgcctgccctgcagctcatcagtgcaaagccgcccggtctggggctctcatgcccccctcactatggcctgtgcccatccgcagcccatcagtgcaaagccgccggggtctggggctcttgtgccccaccctcgccatggcctgtgcccacccggcctcctggggccctcgagctgtagtccccgggcagatgctgtggaccccgtgctatcagcctggcccctggggtcacagtcacagatacccggagccccaccccacagccccagccccctcgccacctggggaggctgagacagaagcagctgggccccccaaagtgcctgagcccagggcacggaggagcacaaatgcccagcagggacaatgtcacagcgtctcagcggccaggcagcaggacgcagagacctctgggaggttcccggggccagccctggccctcctcctccaggggccagccgtgggatgcagaccacactctccctccagggcccatctctggggctgaggcgggcggggccggtgcccagctgcaagaccatgggatagggaaggcaggtgcttggggccacgcagccctgcactgggggcccctccaccccaggcggctcacgaggtgtcatctggagctgtccccaagccgggatctgcaggttgacctcccccacccggggctatctccagaccctctttcctccctggggagatggggcagtcccccgcagggccagctgaaaccacccccatgctgctgccgcctgagcgacgtgtgtggggaagaacttggagtgccacccccagaatgtggcgtccacctcaccagaccgcacgggtgagccctggactgcaaggtgcatataacacaaggtttggacacacctggagagctcgggccaggcagggccacacctgtgagcctgagctcatccaacaccgcccggagctcggggaccttccccatcccagcacctcctcaccgctgtgcccgtctggccagtccctccaagcacccctcggatgaagttgcgccccacactgcagtggggctcactctccacagcgcctgctgcgttgcacggggtgtgacaggaaggaccctgctggggctggcggggccgtacccagagcctccctgtgcggtttctcctcctcctcctcctctccataagcaccgggaacaaaacagaaaaaagtctttgtatagtaataaagtctgcagttcacgcacccatgcttggaccagctccttattttaaccacacgtgcacagacccccgccgtgcaaagggcccagctgaggacagaaccccagacactgcatccggccccggaggcccccaaggttcctgggagaggctccctccctcccttccctcctctttccctccccctcctccttcctctcctccatccctccttccccctcctccctcctcctcctctctccgtccctccctccctccttcttttgctcaggaatcttccctgactctcctgtggtcagctcaggtcaaggttctgggggaagggggagtccctgagtggagacacctcagcctgtgctgaagggagctaccgagggggcagccggtggccctggggggcctctctgagcaggtgaccaagagcgtatggtgccggccagcaggagcgagggctgcggacaggatggaggcagccaggcgccagccaggagggcttcctggtccagccacacctgccccggtgacagccacaggttggtggcaaaggggccacctcccttccagtggcagggcctggcctgcctggagaccccacccactgcccgagaggtgccaggcctcccccattctgcctggccctgggggctgcacccacctggacacgcgggccgggcacacccacggcccaaggtcctgctcccacctgccctgcgcaggaaccttgctggggctacaggtatccgtggctgccacaccacccagattttgggattaaggggcagagttttcaagtttgaactcaggaaagctgtgagggacgaggtagtgcctggctggggagcctgggggcttctgagggcggtggggagtcctcaggcctgtgtggggccccagggaggggaggctgcaggggttgggggacctgcccgctgcaccccctctccccccacacaaggaaacccgtcctccgaggtgtgtgtccagatcacatcctccaaaggccggtgcgccacaaagatgaacacggggctctccctcccagcccaggggcaaggaccctgccttgctctgttcccggaagggccagttctggagaggagctgggcgagtccttcccatccccatcagctcctgtcaggccacctgcctcagcctcagggaggaggggacacacgtaggccccttcccagagtcagagcttccgaacccggatctgctgctcccagcctggagagccacagcagccaccgaaggaaccccccacccgtcacccccaccaagtgggccctgctccccgaaggcccagccactcagcccaggacctgccccagccccacctgccacctgacctgaggctcccagagggcagaggggcctcctgggtctgctccgcaccagggtccagcgggaccatctcaaagcttgagcaccaggcgcaaggtgggagtgcggggaggggacgaggacactgttcccagctggacagaaccaggaggacggtgggagacgccccccaccgccccgcttccgagagctctctcttccttccagggactccccagggacagccggggccccttcttcccccacagctcaggccccagggacacagagcggggaacccccaggctgccgccccggcgtgggtcggggaggcggctccggagcgggcaccacactctcgaaagggtggcttctcctcccggctgctgaaaaaccacacaggcaggcacaacaacagacgcttacgcccgcatctggaggccagaactccaaagccacagggcaggcagggctgcacccctctgggggctccaggagaggaccctgtctgcctccccagcccctgccagctcaggcatcagtggctgtggccgtgtcacccatctctgccccccagtcccacggcgtctcccccacgtctgcgtctcctctctccacctccctctcaggggggcagaggccattgattcagggcctgccctgggtgatgtcactagagatcctgacgtaaccccacctgcaaagccccttcttctaaataaggtcacattcgaggtttcagggctatgatgtggttgtcttttgggggcaccaccagccccctgcaaggggaccctaagcacagaggccctcgtgacccacgcaaagctctgaaggacacggatgggtaggggacacgtggctggaggctcagagtttgaggcagaggggatcagaccgtgccatgggtcatgccaggagcccaggactcccagacctcgtatcattaggtgttttaaagagaaggcgagggcaggccaggcgcagtgactcacgcctgtaatcccagcactttgggaggccgaggcgggcggatcacctgaggtcaggagttcaagagcagcctggccaacatgatgaaaccctctaaaattaataataaattaataataaaataattataataatatagaaaataatatataaaataataaatatataaaatataaaacaaaataaaaataaaaaataaaattaatattaaaaatacaaaaattagctgggcactgtggtgggcacctgtaatcccagctactcgggaggctgaggcaggagaattgcttgatcctgggaggcggaggttgcagtgagccgagaccgtaccattgcactccagcctgggcaaaagagtgagactccgtattttgaaaaaaaaaaaagagagaatgtgagggttaaacaaagacacacagagatggagaaagggcagccttacatcaacacgggtacattgcaaacacctgcagaggtgggggaccagctggatgccagagcccactgccgcctacgggctggggtgcctataggtatgggtgggagcggcccgggccacacggcttcaggatgaggccgtttgtttggcccttgttcccgcagaaggtaatcgtgatgttcctcggtgtttttccccgcagagtgttcaagtcaggtgtcgggcaggctgttcctcacggcccaaacccctgcggaatgcttcactttggccgaggtctgtgacacagcgaggggcttacagaaaggtgcagtttggaccgatagatgtgagtccccctctggggggcactcactttgtggagcccccggttcctgtttgcagaggggggcacagtggcacctcgtccgctgtggagtgagaacagggacccgaccacgtgaagcacagagaatgctcagggatcggcagccgtgtatccagccaacatcaccagggtgcacgcagagcctggcccgggccaggtcctggggtgctgagcatgggtggggcctgagagacggctcagggaccatcctgggagggccgggcggaggggcagcaactggggctcaggctcaggcagtcccagcagtgactgggaggcagctgtgcccatgaagctgtgcccttctccagcctcagccctcagcccggcttcccgggctggccccgccactcagcagcccctccccatcctccgaaaacccaagctcacctctgggttccggctgggtgggggttgccaggagacggttgccaggtcaccactgttgtttcctggcccaggctcccaggaccttgtgggctgggcaggtaagaagcgccggcggccaccagctggggtccagtgggctcggccccgccctcctacgccctgcctgcgggtcccctcgggaggctgctcaggagaggaggaggctggggaggggactggacagggatcgggtagggtggggccaggctgagcctgctctgcgggtcccggaccccagcgccaccgtgcgagaggctcgggtccaggccaggccggggaacggtgtgtgtacccggtggggtgggagggctgggcagccctgggacgagctccgtggcctgggaccaggtctgcctccgcagagcaagtcctggacggacggctgcttgagcccacaggtcgtgcgtcctttgacagcggcctccggccgggaggcaccagctcttcgaacaatgtcagtaccttcctagggccccacgtggccaagcttggattctggggggagaactcgcagcaggacactaacatgtggtcgctttttggatgatttcttcaggtttaaaagtctcttctgttcatcctaccggggtgccgtctcctgccggtcttttcatctcaccaggtaaaacgcttattttacaatttattgtaaggtcgtgcaccaagtttccacgccgcctttacaccgtgtccccaccgaggggcgtcacaaccgtcctccacaccgggcgtcaccggcttcccaagtcccaccgctataaaggacacgtcagtcagcatctcggagtgagacgctttccttctggattcagaatcgcgtccgtcagagactccaaagcacatttgctagatcgacaggcgtgaggagccagcggctcccggcgcttgggaggctgcgtcccacctgcattcaggccccgggttcaccacacacacagcgggcagctgcttaagaaacctttgatttcagtccggggcggtggctcacgcctgtaatcccagcactttgggaggccgaggtgggcggatcacgaggtcaggagtttgagaccagcctggtcaacatggagaaaccctgtctctactaaaaatacaaaaattagccgggcatggcagcaggcgcctgtaatcccagctactcaggaggctgaggcgggagaattgtttgaacctgggaggcggaggttacagtgagccgcgattgcgccattgcactccagcctgggcgacagagtgagacttcgtctaaaaaaattaaaaaaaaaaacacctttaatttcaatgacaagaaataacagctcacaacttatttagttatttgtgaacatcataaggacataaagttagaaaagcccaaaggaggcctcaggcttacgatgaaatcagcacctggctgcctcttccagctgctgcttcttctgcagcagaagagacggaggcagtttcctgggtgggggggtgggtgctgtgcttccgctttctaactgcctgtttccaaaaagcacctgatgctgctgcttctggagcttccagtgcagaaattccccgtggacggtgaaaggggcttgtcttccacacgctgccctgtccatatcatcccggcacgaatgatgtttggggcagagctgcccggcctccccgggtggtgcccatttgttttcctcagagttggcgatcgccttgcttttcacatgtgcttgtgttcccgcctatcctgagctgtccctgagctctctgcctcccgtcacccccacagtcaccatcaccacagccctgcagactgcgcagtgtgtggcgggtgctgtcctgacattacatgtggaaactccatctttgcagcaaccctgcgaggctgctgctcccagctgctgtgcaggtggagagaggctgctgttgtgcaggtggagaggctgctgctcccagccgctgtgcaggtggagagaggctgccaccgtgcaggtggagagaggctgccgctgtgccggtggagaggctgctgccgtgcaggtggagagaggctgccgctgtgccggtggagaggctgctgctcccagccgctgtgcaggtggagagaggctgacgctgtgcaggtggaaagaggctgacgctgtgcaggtggagaggctgctgctcccagccactgtgcaggtggagagaggctgacgctgtgcaggtggagaggctgacgctgtgcaggtggagagaggctgccgctgtgcaggtggagagactgctgctcccagccgctgtgcaggtggagagaggctgacgctgtgcaggtggagagaggctgacgctgtgcaggtggagagaggctgccgctgtgccggtggagaggctgctgctcccagccgctgtgcaggtggagagaggctgacgctgtgcaggtggagagaggctgacgctgtgcaggtggagaggctgctgctcccagccgctgtgcaggtggagagaggctgacactgtgcaggtggagagaggctgacgctgtgcagctggagagaggctgacgctgtacagctggagaggctggggcacacagtcatcaggtcagctgcaagctcacagctgctgcatcttttccctgacagctcactcctgtgagagtcttccaggcttcccggagggacggatgtctcctcaccttttcccacctccacaccttttcccacctccacacctggtaggccaggtatggaattcctggaattcccggctgggagcctcctgggccggttccagccctgtgtgtccccaggaaggctggagggctgctagtggcctcggtgggcacccagggctggccaggaccacacctccttcctccggctctgtgcctgtatctccccgggcctcccctctcgcctggggctccacggtgaccctgctgtgcggcacctcggatttacacccacagtcccatccccagggttcccttctgggcagtttccttgacttaaatcccaaccccggtgttgcatttttaattcccaccggctcttttgtattctctgtgcctttgctttaaaagcacgcggctctctgaggggtcctgtctccatcaccccagccttttccaggctggtttgtttccctgtttctccccttttctcttcctctgtgtgcgtctgtgtgtctgtgtgtctacatgtctgcgtgtctgtgtgtgtcagcgtctgtgtgtgtgggtgtctgtgtgtgtgtgtgggtgtctgtgtgtgtgtctgtgtgtacgtgtgtgtgtagacgtgtctgtgtgtaggtgtctgtaggtgtgtctgtgcatgtttataggtgtgtgtgtgcatgtctgtaggtgtgtctgtgcatccatgtgtctgtgtgtgtaggtgtgtctgtgcatctgtgcaagtgtcgacatgtctgtgtgtgtctgtgtgtagctgtgtgtctgtgcgtgtgtgtgtgtaaatgtgtctgtgtgtcattctttttttttttgagacggagtctcgctctgtcgcccaggctggagtgcagtggcacgatctcagctcactgcaagctccacctcccaggttcaagctattctcctgcctcagcccctcaaggagctgggactacaggcgcccaacaccatgcccggctaattttttgcatttttagtagagacaaggtttcatcatattagccaggatggtctcaatctcctgacctcatgatctgcccgcctcagcctcccacagtgctgggattacaggcgtgagcctccgcgcccggctgtccttgtgtcactcttcttcacacttgggagtccctctgatgatgcctgttgggcctgggcagcccctttggctgagagtcagtactttagaggatccccttccccagcaggaatcctgggtgctgagggcccatgagaaggagctgaggtctcccatttaatgcagagtcttgcacgcacacacctgctccgtgcctgcgcagggtccagcctcttccaaaagtcctcctgttctgggtggggaggggtctcagggctcctgacttcttccattcttgcccagcccaccctaggaagagggcgtgaggctctcccagacacaggtggggggcccagcctgtgttccgctcctccctgaggacgggtcccagtggccccacccgactgggtcatcgtgcagacggctgcctcagtttccccaccttcccctgcccgtgggcttcctcgttgtctccttccctcctgtcactcaggcggggcagggaggggcagacacaaaggcttcctgcgggtgagattggtgccgagctctgtgcccagcctggagcctcaggcctaccccagccttctccagcctcagagcccccacagcctctgcccaacactgccgtgtgctcccctgtctcctgggcgagttccttcaaacccttgaaagccctcacctaagccgggcacagtggctcacacctgttatcccagcactttcagaggccgaggcaggcggatcacctgaggtcgggagtttgagaccagcctgaccaacatggagaaaacccatctctactaaaaatacaaaaagttagctgggcatggtggtgggtgcctgtagtcccagctacctgggaggctgaggcaggagaatcgcttgaacctgggaggcagaggttgcagtgagcctagatcgccccattgcactccagcctgggccacaagaatgaagctccgtctcaaaaaaaaaaaaaaagttctcacctcccaagcagccccaagatgggtttgtttgctggagacagaggtagaaagatctgtcgaggaactggctgaaaattcctaagttgcaacatgggaaggtgttgctggagacagtgtcctgggggtcgggcctggcacccaggggcggccgcagaggaaccctgatggcaggtaccaggcggctgcacacagcccacagctgggctccggggtcagcagcggagacagagaagacccctgctcaggccaaggagccctcccaccctccattcttcaggcaggcgccccacccagcaggcctgacgctgcccctccttccagccggcacccaggccgagctcagccacacctgaagagccgctccggccagggaggacatgcccggcagagacagggtgcagagacagcctcgcccccacacggcgccaggccccacagctgccacagagacgggagccagccgcacgcagaggctcaagcccacggccctgggaggcgccctttcctgggcagggtgggcctgactgcctgctccatccaagcactggggcctcgggccgcgcggaggtcccacaggagggtcagagcggcatcttcccttcagggccctcgcccgggcaccccccggccaatggaccacagctgcacccggttcatccaccgccggggaccacccactcggacccgagccggcttcaagaggggcaagaggccaaggatccagcagaggcctcgggctcgagtctcaggtgaatagagcagccctgggtggcctcctacctctccaaggccaaggcctccctgggacgggtgccccatacccaaggaagtcagtcggcctcatggggcaggggcaggatccacacatggccatgccccgctgctccgagagaggggccagctgtgggcgccgggctctgcaggcacagaggggagctgtcgcgctccgcggcccagggttccgcctggctggcaccacccctggaagggcagcccctcgtctcccggcctgacaatggccccttgggtcacccatgacatcatcatggacattgtgacccctgccctccagggaccatccctgcgtcacgtctgcacccagcaccggcctcacagcccggcccctgccctgcaccaggccactgccctgttggtgaggagggtcggaggggcgacctccctgccccctgctccaagctccccacccccacctggaacctgccggcaggaagcctggccctggagggtggtcacggcccctccccagatgtaagcagtccccaggccgcctggtggggccagagctcgggctgaacttgagccccagacgggccagggggattgtccagggtattggagaaatgggctgggagcaaactggctgagccatgtccgggctgagtgggcagctcccgtagccaccccggtgggaccccaccccgttcacaggcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatgtgagtagcggccctgggcgcccgtggtcccactgaatacccaccgcctgctcccggggcccagcccggcctccgctggccgcccgccatccccaaccccttgcctcggcccccaggtcacccccgcccccacccctcgcagcatcagctcctactgcaaaagcaagggctggcagcgcatccatgacagccgccgggacgactacacgctgaagtggtgtgaggtcaagagccgagacagctacggcagcttccgggaaggtagcgggagccggcaccagaggcgggcagcctgcaggggcctcctgggccggagcacagggcaggttggaggggtggggaccgaggtcctgcgctccctccacacgagccctggcctctgacctccaggagagcagctgctgtaccagcttcccaacaacaagctcctcaccaccaagatcgggctgctcagcacccttcggggacgggcacgggccatgagcaaggccagcaaggtgccggggggggtccaggccaggtgagtctgcccctgcccctgcccccgtccctgcgcccgcccctacgcctgcccctgcccctgcccctgcacccgccccacccctgcccctgcgcccgcccctgcccttgcccctgcccctggccacccaggctcccaggctggctccagcccctgcccctgcccttgcccctgcccctggccacctgggctcccaggctggccccagcccccacccgtcagcacctgcctccaccttccacctgtcctttaaagggccaaacccctgtcccataaacccaccctcttcctcgtggctgaacggggaagatcccacacgtccccaacccactgggcctgacacccacccacctgtccatctcacagacccacccaggtacaacccacctgtcaatctgccttcaccccaaacatccatccaatccatccacaatcccacaccgtgcccaccgtcacctgtgggtgccctgagtgaggccgtccatcgctcacccaagtctgggccatccatcctagcgacttcgtcctcctgctcccagccctgcccactgcccttctatggacccacctatccctcctcacttcatttggcccagacatttttgcaccaagcacccgcccagccaaccgcagctgcctccatctgcaccccccgcccctggttgcctgtgacaccagctttacaccatgtccagcgtccacttccagcctagagcaacacagctgtttcccccaggcaccgccgtccacccagccacctccttccaccacaactcacagtccgcccactcaccacccatgccccatcccccagtccccacccgctccaagcaccatgagctggcccctcagtccaggccctctgtcccctgggctgcaggctggaaaaggacgcagcagcgcccgccctggaggacctcccgtggacaagcccaggatacctcaggccacagaggtagactcagcccagctgtgaggggcccttcagaccgaagttcagacctaaacctggtgtcgtctgaaaaggagaaagcggggcgggggtcccacacaaaggaaaaccacgagctagagtcagaggttcagccaggccaggccgagatccacgctgaccccccagtgcacacagagctggggcagggccaggggctcaggccacgctctccgcccatcccagccgtgaggacactgccatgaggtggtggctcacaaatggctgagacggtgccagccgggagagcaaccatgagggaaaaagcagccagcgggaggggcccgggtgggggtcagcggccagaaggatgcagccagcagcacagcccgttgggggggtgctgcaaaggggcaggaaacgcaaagtccccacaaggagaacggccgcgggcgccaggtgccactgcccacactccctcccgccgggccacaggctgggcctcaaaccgcccacccagccaggggcgaagggacagcagctcatcctcctgcctccctgccctgcagggtcctgagaatggaagagtttttcccagagacctaccgcctggacctcaaacacgagagagaggcctttttcaccttgtttgatggtgagacgctgctggccggacaccaggctggccctggggagacagggtgagggctggaccaaggcgggggctgatgagggcagggctgggtctggaggggctgcgtggggctgggacgagacgaggtggtcaggaaggggccagggctgggcctggtctgggtggggactgaggagttggaaaggggagggtctggccttcgtggaggttggggtatgagggcactggggccagggctggagcttggtccgggtgagcgtggtcgaggcacgggcaggagctggggccaggcgtgtggttagcgcagggccaaggttggaatggccgggccgagggtcgcagcctggaggggagggtcctggtcgggccctaggaggggcgtggctgggttgggggcgaggccaggggctcaggccgcgctctctgcagaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtgcggcggcgggtgcccggaggggtgagggtctgggctggctgacccgggccccactggtgcagtcagcagggccgccgaggagcccttggtcgtggaaagcagccgcaccaccagcccctgtgcagaccacagccgggcccccgtgtagccagcagaggggaggggtcacaccaggccggggtcacagacacaggatccagggttgaggggttagtcagtttgtccttcagctggggccccctctgtcctgcaggtggcctggcctgggtggcctcccggctgccagcccccctactccccggcccagccagccagctgcagccttcaggcctatggccaagctgaccactccttccctgagtgggaaggcttcctccagaaagccccgtggctgcacgaggctgaaggtttagacctgtcgacctcacccccggccctcgtagagcctcactctgaccacagctgccgtctgccgtccccagcttccatcggctcctccctcgcgtccctccacctggcgagctctccgcctggcgcaccccctctgcctgctgtgctccctctgcctagcgcccgcctggcgcgctccttcccttcctctccaaagccaccttcatgccctcctcctccaggcagccctccaggctcctactgcggttatgccctggagcacccatcagggtgccaggcctttcctcccaattcccctgacatattcaggcccagaaatgccccctttccctggaggtcacacctgggacagaggcggggcgctgaggaaatggaacaggcccggggtggggtgtgaggggatgcaggccaggctggccccgtggctcagcccagcagccccgacatggtgcccccaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccaggtgagtctgccatgggtgagggccctccctgcagccttgggatgagattagaaggaggttctcactgctagggggtgcagagggggtgcagctacagaaggaggtggcccaggccgggaggtgtctcaggcctggaagtagcctgggctgcccccgctggcagtgagcactgcctctcacctcccgcttttggccacgtcagaagaagggcgtggcagggaccccgttagctggtgaaagggctcagagccctgtagccctcagcgtgcagcctggctcccaagccgcagctgagttttctgaggatggggtgcgggtgggcgtcggaaccgaggggattctgaggctgtcagaggaggggccctgtgggcagagatttctggggacgggtcttcatgggagagtccagggtagggaccttctgagaagatctgtggggtcctcacggctgaaggggggtctcagcggatgaaggtttttgtgggagggtctttgcaggcaggtcagggtggggccgggggagcaaggttaggggcggctgtctcagggacccccagagaacaggccttctaggttagggggatgttctcttggggacccccgtgaggacaggccctccggacagtctgggagccagtctccaggcaccgtgtgcccccagttcatgcagaagccttctaggttagggggatgttctcttggggacccccgtgaggacaggccctccggacagtctgggagccagtctccaggcaccgtgtgcccccagttcatgcagaagccttctaggttagggggatgttctcttggggacccccgtgaggacaggccctccggacagtctgggagccagtctccaggcaccgtgtgcccccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaaggtgcgtccactgtgccctccagtctgggagtgagatccctcggggcgggggtgtgtggtcaggctgggcaccaggcacacagatgtccgtggcgtgcgtgggcggctgcgctgaagtgtgacctgaccgtgtggaaccaaacccttccagcgtctctgctcacttagctggcagtgcctgtccccagcagccagcaaaggcccggacggaaagcccagtcgggggtctgtcggcacgagtcccgcgggcagcctcgccgtagggtcaggggacagctcggcttcagtgacagccaccatgtgaagagtctttgttcctttcagatcctccacttggcaggcagggccaacagcagcccccgggccaggtgtcctggagcagcagcagctgcccgtgcaggcccggactctccctagctaagggccatgtgcggtggagtgtcctaattttgcagggttcctttctgtgggggtacctgtggggtacttcaaacagccctagcagcaaaggcccttgagcagcgcggtgtgaaactgggataaaaacggggcttggccgaaggacttttatctgtcttggtcaccccggccaggccccggaagcagcagccagggatggtccttcctcacccacaggcgtgtgtcactgtggctgggacggcagcgctcagaggagcctccagttactttcctcacatctcccaaactctctcttaattgcgataattcacagaacataaaattcacgatcttaaagtgtgcagttcagtggcttttagtatttcaaaagttgtgcaattatcaccaccaattccagaacatttcatcacctcaaaaaagaaacactactaacgagccatcacagctacattgccggccattcctggtcaccgctgatggaccttctctctctctcctgtctcctttctcttaccgtggtgttttcagggttcatccacgtagttcacgtatccttttcttttcttttttttttttttgagacagagtctcactctgttgcccaggctggagtacagtggcacaatctcagctcactgcaacctccacctcctgggttcaagcaattctcctgcctcagcctcccaagtagctgcaactacaagtgcccgccaccacgcgcggctaatttttgtatttttagtagagatggggttttgccgtgttggccaggctggtctcaaactcctgacctcaggtgacccgcccgcctcagcctcccaaagtgctgggattacaggcgtgagccactgcacccagccatgtatccctttcatacaacgttccgtcatatggatggaccatattttgccatcagctggtggacacagttttattattgagctgttatgaataatgttgctataaatattcacacaaaaatgtttgtatgaatatatattttcagtgctcctgggaaaatacccaggaatggagtcgtgggtcacagggtgacacacttaactttctgaggaaccaggaatcacttttccagtttctccagatctcgccaacacttgttattttcctttctttattaaagaatcaccatctggtcggtgtgcagggatatctcattgtgggtttgatttccattttgctaatgacaaataacttcatgtgttcactggccagctatgtatattctttagagaaatgtctattcaaacgctgtggctgttctttaccatccagttgtgaaagttttttttgtttgttttttgtttttttttttttgagacagaggctcgctctgtcgtccaggctggagtgcagtgatgtgattctcggctcactgcaagctccgcctcccgggttcacgccattctcctgcctcagcctcccgagtagctgggactacaggcgcccgccaccacgcccggctaattctttgtatttttagtagagacagggtttcaccgtgttagccaggatggtctcgatctcctgacctcgtgatctgcccgcctcggcctcccaaagtgctgggattataggtgtgagccaccgcgcccggccaaaagttctttacatattctaaacactaggcctttatcagacatatgatttgccaatatttttctggaatattgtggctgtcttttcactttcttgataatgtcctttgaccacaaaagcttttagttttgatgaaatccagtttatccatttttttcctttggttactcatgcttttagtatcatatctaaaaatccattgtgccaggtgcggtgactcacgcctgtaatcccagcactttgggaggccatggttgttagatcacctgaggtcaggagttcaagaccagcctgaccaatatggtgaaaccccatctctactaaaaatatgaaaattagccaggcgtggtggtgggtgcttgtagtcccagctacttgggaggctgagaaagaagaattgcttgaacccgggaggtggaggtagctgtgagccaagatcgtgccactgcactctagcctgggcaacagagcaagactccatctcaaaaaacaaaaaaataaaaatccattgcactttgggaggctgaggaaggtggatcacctgaggtcaggagtttgagaccagcctggccaatgtggagaaaccccatctctactaaaaatacaaaaattagctgggtgtggtggcgtgcacctgtagtcccagctactcaagatgctgaggcaagcgaatcacttgaacccgggaggcagaggttgcagtgagtggagatcgcactgctgcactccaacctgggtgatggagcaagactccatctcaaaaaaaaaaaaaaattgccaaatccagcagagtgaaaattacacttatgtttctttctaaaatggtatagttttagctcttatatttaggtcttggatccattttcagttaatttttgtgtatggtgtgagttagggatccaacagcattctcttgcatgtggctatccagttatcccagcaccatttgttgaagagactattctttcccccatggaatggtcctggcatagtatcaaaaaccaattgaccagagctgcaagtgtttatttttggactctcagttccattccattagtgtatatgtctgtctttatgccagtaccacatggttttgattgctgtagctttgtagtaagtcctgaaattgggatatgtgagtctttcaatattgttctttttcaagattattttggctattcaggggccccttacaattccacaattccatatgaattttaagattggcttttccatttctggggaaaaagtccaatgaaattttttttttttttttttgagacagagtctcattctgttgcccaggctggagtgcagtggggcaatctcagctcactgcagcctcgcctcccaggttcaagcgattctcctgcctcagcctccctagtagctgggattacaggcacccaccaccacgctcggctaatttttgtatttttagcagagaccaggtttcactgtgttggccaggctgatctcgaactcctgacctcaggcgatctgcccacctcagcatctcaaagtgctgggattacaggtgtgagccaccacacccagcctcatcgaaattttaataggcattgcattgaatctgtaagtcacgtagcagtggcatcttaacaatatttagtcttccgatccatgaatataggatgtctttccatttttctaggtcttcttccatttctttcagcaatgttttctagttttcagcatacaagtctgtcacctacggtaaatattattctaggtattttattattttgacacttgtgaatagaattattttttaaatttcctttttggattgtccattgctagtgtataaaaataaaactgatttttgtgtgttgatcttgtatccttcaactttcctgaattcacttattagctccgtgtgtgtgtgcactcttcaagatttttatataaggatcatgtcatctggaatagaaacagctttacctcttcctttcaaatttatatgcattttatttcttttcttacatattgccggctacttccagaacaatgttgaatagaagtagcaaaagcagtcatccttgtttgttcctgatctgaggaggaaggccgtgggtttctcataaatgccctcgtcaggttgaggaagttcccttctgttcctaattggttaagtgttttttgttaatatcctagaaggatgttgaaatctgtcaaatgctttttctgtctccactgagatgagtgtgtcttatttccccttcattctattaatgtgttgtatcgcactgattaactttcatatgacaaaccccgcttgatgatggtatagaaccatttaaatttaaatatgctgttggatttggtttgctaatattttaatgaggatttttgtgtctgtgcttataagcaatactggtctgtagtgttcttttctcgaatgtctttgcctgggtggtattaaggtaaccctggcctcatagcatgttaggatgcattctttcctcttttatttttggagtctttgtgaaggattgctgttaattctttgtttgaaataattcaccagtaaagccacctgggttttcctctgtgggaaagtttattattattattactaatactgctgcaatctttacttgttataggtccatccagattttctaatctttagtctgctttattttgctaagaatttgtccatttcaccaggcacggtggctcatgcctataatcccagcactttgggaggccgaggaaggtggatcatgaggtcaggagatcgagaccatcccgggtaacacggtgaaaccccgtctctactaaaaatacaaaaaattagctgggcgtggtggcgggcacctgtagtcccagctactcgggaggctgaggcaggagaatcgcgtgaacccgggaggcggagcttgcagtgagccgagatcgcaccactgcactccagcctgggggacagagcgagaccccgtctcaaaaaaaaaaaaaaaagaatttgtccatttcttctaggttatctaatttgtttagtgtacaaagtattcccttgtcatccttttaatcaatataaagtctttctcccctgattttagtaatttgattcttctctcctttttttttttttctttttggtcagtttctctaagtccttatcaattttgttgatcttttcaatgaaccaactcctggtttcactgattttctctactgttttctattccatttatttccactctatctttattatttccttcttactacttgccttgggtttagtttgctcttcttttactaattttttttttttttgagatggagtcttgctctgtcgcccaagctggagtgcagtggcacgatttcagctcactgcaacctctgcctcccgggttcaaatgattctcctgcctcagcttcccgagtagctgggactaagggcacgtgccaccactcccagctaatttttttgtatttctaatggagatggggtttcaccatgctggcaaggctggtctcaaactctctttttctaatttcttaaggtcaaaagttaggttatgatttcagttttttcttcttgcttaaggtaggtgcttagtgctatacattttcctctgaccaccacttttgctgcatccataagattttgcgtgttgtcttcattttcatttgtctcaaagtatttttatttttattttttattttatttgagatggagtttcgctcttgtcacctaggctggagtgtaatggcgcaatctcagctcactgcagcctctgcctcccgggttcaagcgattctcctgcctcagcctcccgagtagctgggattacaggcacctgccaccacgcctggctaattttgtttgtattattagtagagatgggggtttcaccatgttggccaggctggtcttgaactcctgacctcaggtgatccgcctgccaaagtgctgggattataggcgtgagccatgatgctcagctgcaaagtattttaaatttcctttgtaagcttttctttgacccattggttgcttaagggcctgttatttaatttccacatatttgtgatttttccaattttccttctgttattgacttctaatttcattccattgtgtcagagaacatactttataatttcaaccctttaaaaattattgaaaaattattggagctggtgtgttggcacatacctgtaattccagctactcaggaggctgagatggaaacattgcttaagcccaggagtttgagtccagcctgggcaacacagcaaaaccccatctttaaaaaaacaacaaacttactattcattaagtggatcattaaaaaacaaaaacaaaaaacacttgaaacttgtttatgtcccagcatatggtctatcctggagaatatccatgtgcactggagaaggaggtgtatcctgtttttgggtgtagtgttctgtagatgtctgtgccgagaccagctcggtcggggagaccctaacccggcggcgctagaggaattaaagacacacacagagaaatacagaggtgtgaagtgggaaatcaggggcctcacaaccttcagagctgacagccctgaacagagatttacccacatatttagtaacagcaaaccagtcatagcattgtttctatagatattcagttaactaaaagtatcccttacgggaaacgaagggatgggccaaattaaaggaataggttgggctagttaactgcatcaggaacacgcccttaagacacagatcgctcctgctattgtttgtggcttaagaacgcctttcagcggttttccgccctgggcgggccaggtgttccttgccctcattcccgtcaacccacaacctcccagcgtgggcgttagggccattgtgaacatgtcacagtgctgcagagatttgtttatggccagtcttggggccagtttatggccagattttgggggggggcctgctcccaacatgtctgttaggtctgtttggtttataatgttgttcgagtcttctatttactcgttaatcttctgtctctgtattgaaagcgggatattcagttgtctacttctcccttcagatctgtcagttttttgtatatttcgaggctctgttgttgggtgtgtgtatgtttatgattattagatcttcttggtttatcgttataaaaattttcctttaatctgcagtaataatttttgtgtaaagtctattttctgtgatatgagtgtagacactccagttggtataagtgtagacactccagttgatatgaatgtagacactccagttggtatgagtgtagacactccagttggtatgagtgtagacactccagttcgtatcagtgtagacactccagttgatatcagtgtagacactccagttggtatgagtgtagacactccagttggtatgagtgtagacaatccagttgatatcagtgtagacactccaattgatatcagtgtagacactccagttggtatgagtgtagacactccagttggtatgagtgtagacactccagttcgtatcagtgtaaacactccagttggtatgagtgtagacactccagttgatatcagtgtagacactccagttggtatgagtgtagacactccagttgttcatatcagtgtagacactccagttggtatgagtgtagacactccagttggtatgagtgtagacactccagttggtatgagtgtagacactccagttctactttggttaccgtgtgtggtacatctttttccatccctttactttccacctatttttgtctctgaaactaaagtatcttttgtagatggtatatcatgtttttttaagaaactccgtcaatgtctattaattggaaagtttaattcacttacatttaatataattactgataaagggccgggcacggtggctcacgcctgtaatgccagccctttgggaggccaaggcaggtggatcacaaggtcagggattgagaccatcctggctaacacggtgaaaccccgtctctactaaaaatacaaaacattagccaggcgtggtggtgagcaactgtagtcccagctgctcgggaggctgaggcaggagaatggcgtgaacccaggaggcggagcttgcagtgagccaagattgcgccattgcactccagcctgggtgacagagcgagactccgtctcaaaaaataataataataataattactgataaggtaggatttacatatgctattttgttatttgttttctatgtctgtctttttttgttcctcagtttctccattactgcctcctattgttttagagagatattttctagtgtagctttttttttttgaaacggagtttcgctcttgttgcccaggctggagtgcagtggcgtgatctcggctcactgcagcccccgcctcccggattcaagcgattctcctgcctcagcctccctagtagctgggattacaggcgcatgccaccacacccggctaattttttgtatttttagtagagacggggtttcactatgttggccaggctgatctcaaactgctgacctcaggtgatctacccgcctcagcttcccagggtgctgggattacaggcgtgagccaccacgcctggcttagtgtagcattttaattaccttgtcatttattttactatatgtttttgagttattttagtggttgtcctgaggattaccattaatattgtatcttaatttactacaattagggtgagtgtggtggcttatgcctgtaatcccagtgctttgggaggctgaggcaagaagatcatatgaggccaggcatttgaaagcagcctgggcaacatagtgagaccccatctctaaaaaacaaaattagctcagcatgggagtgtgcacctgtagtcctcctagctatttagggggctgagatgggaggatcacttgagcccaggaggtcaaggctgcagtgagccacaatcaaaccacattaccccagcctaggtgacagaacaagaccctgtttctaaaataaaaaatgttttaaaataaacaattcagttttttattaataccaagttaatttcaaaagcatacaaaaacacactgctcctaaaagtatacaaaaacactcctcctacacagccccacccctctcatgctgttgtcacaaattacagctcagtatatttgtgtccatcaacatggattcataattattgttgtatacagttgtcttttaggacaaaacaatcacatacaaaaaaatacatgtatgctgtctcttatatttaattacacaatgaccttttctggggctctttatttcctcctgtgagttccagttactgtctagtgtcttttcatttcagcctgaaggacggtagggcgggtctacctttgtttatctgggaatgtcttaatctccccttcatttttgaagcagcttttgctagatgtagaatttttggtcaacagtatttttacttttgggaatttgtgccatcccactgcctgcccacctcacgacctctaatgagaaactggctgttcatctttctgtggatgcctcatacataacgagcggcttctctcctgctgatttcgacgttctctgtcttttggaagtttgctgatgaggtggtggatctctgagtttatcctactttgagttcattgagcttcttgaatgtgtaggttgtttttcattaaactgggaagttttctgccattattttttcaaatattgtttctgctcctttctcttctctccttctgggactcccattatgcatatgttggtccatttgacagtgtcccacccacaagtctctgaggctttatttttcttccctctctctctctctttcattttttgttttgagacagggtttctgtcacccaagatggagtgcagtggtgcaatctcagctcactgcagcctcctccttctgggctcaagcaatcctccggcctaccagcctcccaagtagctgggactacaggcacgcaccatcacatctggctaatttttgtatatttagtagagacgaggtttcacaatgttggccaggctggtctcaaactcctgacctcaagcgatccccctgccttggcctcccaaagtgctgggattacaggtgtgaagccactgcacccggcctcctttttctttctgttcctcagactaaataatctcaattggcctatctgcaaacaattcaaatctgctgttgagcacttctagtgcatgttttatttgttctacttttgttctacttttcaacttcagaatttctatttgattctcttttataatttttctctcttcaccagtattctctattatttgataagacatcatcgtcatacttttttttttttttttttagttttagtagaggcagggtttcaccatgttggcaaggcttgtctcgaactcctgacctcaggtgatccacccacctcagcttcccaaagtgctgggattacagacgtgagccactgtgcccggcccatacttcttttttttagacagtctcactgtgtcacccaggctagagtgcagtggcacaatctcagcttaccacagcctctgcctcttgggctcaagcagtcctcccacctcagcctcccaagtaggtgggactacaggcatacaccaccacgcttagctaattttgctaattttttggtagagacaaggtctccctatattgcccaggctgatctcagactcctgagctcaagcgatcctcctgcctcagcctcccaaagtgctgggactacaggtgtgagccacgcgcccgaccaacttgtgtatttctagtagagatggggtctcaccatgttggccaggctggtctcaaactcctgagctcaagcaatcctcctgcctcagcctcccaaactgctgggactacaggtgtgagccacgtgcctggccctcacactttctgttagtcctttcaaatgggatcttccaaggaactactagacataagaaaacaaataatgacaatttttttttataaatgaggtctattttgctatctccagttctggggatgcatgctgttggttttttgaggcaaccattgagctggggagcagaggatgaaaccagagcacgttaaaatacaacataattcacagttcttaccaagattcgagattttacgtatcccatttgctatccgtctcttctgctcaagggcagagatttcctgtgagttttcctcactctcgtatctccagtgcctgacacaggacaggagctgcacgagtttgttgagtgagtttctggctgtgaacctgtgaggctgagtgcacgaacgtgtgggcaggtgtggctgtacaggtgcgggttcagatgggagtgcaggtgagggatgtggctgtggctgttcagacctggggtgtgatcagggcctacgggccgcagccaggatgcctccctgcctccctgcagaagcggatgcagcagatcatggcccactgctttctggccgccaagcccaagctggactgcaagctgggttactttgacctcattggctgtgacttcctgattgatgacaacttcaaggtgctgtcctgggcggcggggggcacagtagacagatgcaaggaggcaggggccatctgtacaccctgaccacactggcaggccccaggcagaatctgcagtcagcccccaccctgcctgcatgcagccctggggatgggtgtatccatgaggctcaccccctgtgcagctaggatggaactgcaccccctcctcagagcagccccctcaggccagagcttcagaccctcagagcttcagtggacaaacaggggagcaaggctataggaaggaagcaatctcccagagccatctgtctgaatgaggaccagggcctctgcctcctgctggcccagtgggctcggggtgaggagggactgactggcgtctggggcaggtatggctgctggagatgaattctaacccagccctgcacaccaactgcgaggtcctgaaggaggtcatcccaggtgtggtcatcgagaccctgggtgagcctccaagcccccaccccacacccccacaacctgcccagtcttgaatgcctacctgccctcttcccaagttcagacccccacagatggggctcttccacctcccgagggcctgtgtggcagcgccgccccctgccccaaccttccccacacctcagctcacctgggtcccacccctcacaccctccccaccccctccagccccagcctctgccccccactcaccctctctcccccacccgcaccagacctggtgctcgagaccttccggaagagcctgcgcggccagaagatgttgcctctgctgtcccagcgccgcttcgtgctcctgcacaacggtgaggccgacccgcggccgcacctggggggctcgtgcagcctccgccgctggccgcccctgcccacccgccaggccaagtcctccgggccacccatgccgcatgccccagaccagccgggcgcccgcaggcctgcgccacctcccttggtgccgcagcgtccccggccacccggccccgacctggacagcgcccacgatggggagccccaggccccgggcacggagcagtcgggcacaggcaacaggcacccggcgcaagagccttccccggggacagccaaggaggaacgcgaggagcctgagaacgcgaggccctaggggcagccacccgcgcccagcgccccgcgccccgcgccccagccgtgctgcctgccctcagggacctataaagcccactttgctacaaacacagtctctgcagcagagtcctgccacctcagcgcccctgagcccatgcccaccggggtcacccccaccacaccagcactggcctgaaagatgctcccctgggacttccccaggcccccactagcccccagtccatggctgggccctgtccctggggagactgtgctgagggagggggtctccgcggctgggcccagtcctggggggctgttctgagggagggggttccccacggctggtctatactccctcccgggctgccccatcctgggctcccgcccaccaccctgtgcccctcagcacctgggccctcctgccgccctgtgaccccacggcccccatggcctggccggtgatccaccattgcctgtcatccccaggaagggtctgaacccctctggagctccaaaggaggagccccttgagcccaggattgctgccgtgggcacccacagagctcgccccagcctgcctggcacagaaccttcctgggcctttaagccccaagcctggcgctccagctccctgagcccccaaccttcctgcagtggccccaggacttagccaggggtgaggggcacagggcagctagccccaacaagagggtcccacagaagacatgctaagcccacactggccaggccctggtcagccctgtgtagccgctgatggttctgttccccatgggtctgggggtttgcgaggagagctctggcgtcccggggcctctgaggcgtccacactacccaccccctcactcatctcccacccagagagctaaagtgtatgggcctcttcccaatggctggctcaaggtgtctgtgccccccaagtcgagacctgaggatcggggggccccgcccccaggcccaccccccacatgccctgcctccgactccacacggtcacggccaagtcgccggtccctcctcctgccctgctccgcagccacgggggactgaggggccagcagaatctgctttggccacgtggccaccctgcgctccacagggacagcagctccattccctgggactcggcagccccggcactgctagaaggcaccgtcggctgtggtctctggccagcacagcaggtggggcacagccagggcgccaggaagaggagaaggcaggacagagggaactggggaccacagaggccaaaggaggccccaggtctcagagccagtgaggaaccaccccaggccaggggcagcccccaccaacatggtcctttcgctggggcctggagtgggggttcccaggtgaggggctgggaacacacctgtcattgtgatggggtccccagtcccctcccagcaggtctgttggaccctctgggggccaagggcagcagcggcctgttctgcagcccactgaggccagggaggggtgaagcaggaggggcctgggaggggtgaagcctccatggctggccaagcacccaggacttggttaatccacacctgctcttaggggtcagggccacactgcctgacggcttccaaggccgctaatggccacatcacctcagggtcctccctctgctcttgctaccctgatgcccctggggcccctgtgccctccggcctctgccctcggctctgccccacatgcctggtgctgtgtcgcgccatgatcccaggtcaggactacatcccctggtgacattggaaccgtccagctcccctccctgtggcgcgtgtggttacacccccaggctcaggggccccacgacgtcagcagaggtcacctgagcccgaggggacaatggaacctttgccgcccctgggccctgactggatgtgtcaccgccagaacccatgaggagggtgcacgctggcagtggcctgccctggcgtgaccgagccccaccccctgcaacccagggccccctgaagacctaagctgaggacccagatactgttcaggagtccttggtgccccaaagagcccaaaagtcaatgaataaacaaggtttccagagaacccaggaacaacggccacatccccgccgcccagcccgtaagcacccgtctgcgaggtcacaacagcatggaccaccagggagagggggactgtgggtgcctgagtatctggcagtacaaggtgctccccaatattcaagtgaagtgaccagccaggggccacaggaaaggcatcagaactcctcggggacacgagaagttcaggcagggtcagggcgcttcctggagacggcgccaagctggagcctgggacccaaggtggaggttcctgacagctgacccccccacctccctctccccctctctcttccacaggtgagtcctgggtcctgctgccaggtagcggactcaaggggaaggtgtgggggattaagctgccccccactcggacccaggtacagccacacaccctccatccccacagcctccatcgtggggcctggccagcacactctcaccagcagcgggggcctggggtctgctgagggccagtgggcctgcgtgtctgtttcagctaaagagacctcggaccccggaggactcgaggcctgcgtgtccatggggccccctgtgcccccgccccctccagcccgtctcccctgagtgtgtctttaagacggggaccaggacaactgaattaccaactccggaaagacccccaattcctggtttccaggaagatgagatttgtgagaggcgggggtctgcttcctccccaacgccaggcgccaccgcctcccatgagggtcactggccgagaggagctagccctctcctgtcctgtcctcagagctcagcccagcatcggaggggacagcagtgatgacccaggtcctggtcagcgggcacagatcccagcagctggggcagccggggaccacctgtccctcaaggacctccccacctgtcctggcgctgggaaaggctgtgtccagctctgtctgcgaaggggcccccgccataggtgtctctgtcagctgcggggggttcccgcagggccaagtccagatctcagtggagggtggggagggggctggctgggaggggaggctccgcagcggccggaagcgcttctgggaacagaggtggcctccggcccttttctcaaaagtccgaccccagcgggaggttggggcggctgcggttttccgggcagatggaggccgccctgtgcgagtggctcgggcttccagggggagcagagaggggcccctccccgtggagccgagaccactgcgccccgagtgggagggggcggcggcctctccgccgcgaccccggccccttctccgcacccggccccgcccgaccctccgcgcccttgggacccccccctccatggcgggttcgcgctggcctcggcctcccccactgagacccctggaggcgcccccgcccccacgcgcgagaacccgcccgcctcccccgggctccgcgacgcacgctggggcccccgccaggcccggagggtcgcgctccaggtaaagcgcgcggggcgggcccgggaggagccggagactccggagaccccgcccagagcccgctccgccgcccgcggaatcccccgcccgtccgctgtgcgtcagcccggccgcccccgcgctgacgtttccgcgccgaggcccacgcgaggccgcccacgaggagtttccgcgctgagtcagccccgcgggacccgcgctacgcgggccgccggtgttttctggggccggtgcgggacagccccggtgtggggggcgcgtggggagagccggggccaggcggggaggatccgggctgcaggcaggagtgcgcggggcagggcccgaccgctcagcctccccggggctcacacgggaggagcgcgccgagccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagcccccagcccagtacccagccccgagcccagtacccagcccccagcccagtacccagcctccagcccagtacccagccccgagcccagtacccagcctccagcccagtacccagccccgagcccagtacccagcccccagcccagtacccagcctccagcccagtacccagcctccagcccagtacccagccccgagcccagtacccagcccccagcccagtacccagccccgagcccagtacccagccccgagcccagtacccagccccgagcccagcacccagcctccagcccagtacccatccccgagcccagtacccagcctccagcccagtacccatccccgagcccagtacccagcctccagcccagtacccatccccgagcccagtacccagcctccagcccagtacccagccccgagcccagtacccagcctctagcccagtacccagcctccagcccagtacccatccccgagcccagtacccagcctccagcccagtacccatccccaagcccagtacccagccccgagcccagtactccacgacgccgaagggccgggtcctgcctccagggctgagcaccttccccagtgtccctgtgccacccttgggctctccacactccaggtcccatgttggggggggaggggagcagacgtcccctctgccccgtccacctactgtgagctgggcccaccgccccactgggagctgagctgggggccaggtgtgctgtgcctccagggtgctgctgagacgcctgcaccagcctgcccgccactccccggcagctgagggagcctgtatcagatctcacctggagcctggagtgggaggctgggcgggccgagggtgggatggtgaggagagagggctggcctggagacggggccgcccagcaccagaaagtgctggatggcacccgggggccggcaggctgtgtggccagaaaccagagacccaggggcaccagagaagagccccagaacgggggaagccgctgagcctgtatccctgaggagcgctgggcccaggactggaatggcccctcctcgggccccacccccacccagccaggagttcccagaatgggccctggctgccctccgctttgccccctgtggaggggaccacggccaggcatgagcacggtgccccaaagcccagccccgggtgccccgtcctcccccagcacccagcatgcatccactcaggtcactggacaagtgtttattgaaggtcccctgcagccgggtcccgtgctgggcactgcacacccacggacacagcctcccgtcctaagaccccaccccatcagggccagcaagggaggaagggggccatgactgtgtctctctctccctcctgcagggcccagccgcggccgccgaactgcatggtccagggcgctggtcactgccaccttcctgcacccacttctgctgccaggggagcagggcccggcccagagcagaacgcagagcccctgcggcctggggagctcctggggaggggctggctgcggtcggtggccccggaggacggccaggctcacacccacaggtctcccagccgccccttctcctctgccgatcgctcgccccgctcttcctcggggaactggcagcttctggcgtcttcggtcgacggcggcacctccagcagcagctgggtctctgcaggggggccacggtcagcaggcagccatgctcccacctccccgcaccaggctgtgacagacctcggggccacatgcactgactcctcagctgccagatgtgcagtccaagctgggccgaggtcaggaggaggacgcaggcggccacggccaggaggacgacggtcagccacccaagcggctctgccggcggggaccctgggacgcacacagcgttgtgggtcttgttcccagggaacacagtgagaaacccgaactgggtgcagctggaatacatggacgcggcctcctatcagcccccggacacggcctccgatcagcccccggctgctgccctccgtgctgtctggggcaagggacaggagaggacccttcctcagagtgggcctggaccacccggccaccggcagggcccacccaggactcactctgtccaaggtttgcagtggccttcgtggcccccggagaaggtccccgaggcacagtcgatacactggaagccaaaactgaatttccctggtgtggggtgtggggggagggagggagggaggctggtggagttgctgggatggatgaggagggcgtcaggccagtgcaggggtccatctggggtctgggtgctgagtagaatgccccccccatcatccattcaacagagttcttcatggcccaggactggggcccatgtctgcccgtcccaggtggggcgtctggggtggggcccagtgagggcacctgggggaggtgcgcagagtgcagtgggcctgccagggaggggaaaggcctgcccattgggggctgagggtgggcagaagccaggcaggacccagtagaacagagggtggagaacagtgagggtcccagagagagtgaggctgggtcccagttgaccccagaccctgccccgtccaacctgacacaacctccccagttgtaccttctcccagctctcatgtgcccagcctgacctctcctgtcaggtaaacaagccgctaagaggacttgagctgctccttccagaacagggtgcagccccaggccccagacaggactccggggggcacagggcaggctctttcagtatgtggtgaggacagacaggatgggtgtcccgggcctgagagccagacagctcctggaacccgcccccacctccccgcagggttctcacagccctcgtgctggatggagaagcccaggctgagaaagcagggacaggacacccccagagcttcatggcctgtggtgcctgagcatggcctggcctgcccggcctcacaggactccggaccccacacaccacatgtcctcgccggacacctgtgcccacgagctctgcctcgggccctagtggaacccctggcctgtgtggactcccagaggcacctccaggacttaccctgggactgtaccccctggcctgggggacaagggtggtgccggcaggtcgtgcagcaagggtctccgcagtggaattcaggctggacacacatgcagtcccactcggaacagcactcctcgcctgggcaggagacaggccagccccccagcagctgggctgaggccccctcctccccaggcctcccctcggccctccaggggagtgaggttgtccgttctccacccacagttggctccagggagcagagggctcctggctgggagtctggaccctgggtttatccagctgtctctttctcctggggccatgtggcctggctactccccctttgcgccccacagctgcccctgcccaggtgctaactccatatgcaaccaggagctgcccctgcaggacccaggggtggcccccaacagtgcacagtcccctggaggcccgtcgacacctcagaggccgcctgcctggtgtctgggcgctgctgtccccaccaccagccacactgggcctccggacagagcctcccttcccaacccacaggccctggaggaagaagctctggggtgacttccctgccagcttcctctccagaccagccgtgtcagctgaaccctcatccccaggtgcaggtcagaggcaggcagcaggccagacggtggtgcaggggggccctcaactgggcaggagggggctgggcgatggccaagggctcacgacccgcccagcaggacctggaacagccgtcctccacctccagaccccagacccctcttgagggcgctcccacctggctcacccctgctcccggccggggccactggctggagctggcacacctccgcctccctctgggatcctgcctccctccggaaggctcccgctgctggcggctctgtgcccaccctccttagacctcagcaacgccggtctgagcacgggaaggggggcgcccacccatcccggcttccgcgggacgccttggccggtccgcgttaagtaaacgcggtttacttacccgggtaatcgcggcagcagcgcgtcgtgtgaacccggcagcagcgcgcgtccgttcccgtcccaagcaggaggcgcccagggccgcacccgggacccccggtggggcgctgacccaggctgagcgcgcacagcagcgccaggccgcacagggcccgaaacgcgcccatcgccccgtgctgtgccatgctcgggtttcaagagcccacagccagttggacacgccccgtccccgtcctcacccgccctgcccggaggtggctgggaccgttcatgacctgagaatcccgacccaggtgaagtgcgtgtgaggagggggtgtagacactgcggacacagcccggtcccccgcaggtcgccggcaggggcggggaaaccaggctggcggggatcagaaaggttttctatgcaaagtctgcggccacattggtgtccccagtgcagggggcggcgtttatagcaccttgtcccatgggggccccttggagggcgggggtcagccaatcactcctccatcccactgcctccgggtggtatctgcgagtccccgagaggtctccacaaattctggccacccccagagagcctcaaccatggagccccgtgctggggaaccccacagaatggggacagggacccctcggctcagcacaccccacctggctggcttcaggtgtgaaactcaccatgggctgcaggcctgtgggctcccctcccccttgcttgcagctctccaggacccccctcaggccaacctgggaagttccccggggcttgggaggggcaccaggaggagctggtggggagacgagagggtgctggcgcctcctcgggacagtgtcagccgcccccgcgggcacccagggcccggtctctcagagccaccttcatccgtcacaccagacagatccaggtcccggagggagttgaggaggagcccctcgcagagctcttgggagactgtcctatgtctttctgagcctcagtttcccctgtgggcaccgaggggttctgggaccctgcctccaccaggaagcctccctggattgcccagccctgcttctgcgccgtccagcacaggtggagacccccatgaatgctgggggtgggggctctcgggaacgtgagcgtggatgtggttcaacacccttttgagacctgcagccaccgcctcaccccgtaaggcggttcctccttttccaaggtaaatgacaggaattagctgtttgtgacaccccggagttctcaaatccaagatgtaggagcctgccttggagaggcagccctcagacactgcagagaaggaaggggtctctgcagctccaggccgccccgacgctcggaaggaaaggggtggggccagctgggcctgggggcctttgagaggcctggagatcttcagccccgaggctgggagggggtctgggcccctggatagaaagaggcgccatcagtggctcacgcccgtaatcccagcattttgggaggccgaggtgggcctcggatcacctgaggtcaggggttcgagaccagcctgacccacatggagaaagcccgtctctactaaaaatacaaaaaaaattagccaggcgtggtggcgcacgcctgtaatcccagctactcgggaggctgaggcaggagaattgcttgaacctgggaggcagaggttgcggcgaaccaagatggcaccattgcactccagcctgggtgacagagcgagactccatcacaaaaaataaagaatgctcatcagaccacacggtgtgagtcatccatctagaggcagggacagagttagaggagcgagcagtttatggggccaagtgggaggcggccagcgggcagaggagcccctcccccccgccccgtggcgcagctgacactttgaacagccggagagcagcttgccacacagggtggtccccggaggggctgcaggggtgtgacgtccaccctcccatccctctcgccgcagaaggcccctccccggctccccgtgactcctatccttgggctgcgaggctggaggtgacttgttcatcttattgagcagctcaccggtgacacaaatgacggggcattcacacagcagagcagcccacgggccgggcgagggacagcccttgcgtacgtccagaagggcagctgtgaggccccacggggagggtgcagatgggcactgagccagagttcaggcagggccttcggcacagatggcacaggagttgccagcagagatggcgtcaggcgagggggcggggagggtgagcatggagaccaagaggaggtggccccgtgtccatctgggggtgcggcaaggggtcctgctggggaataagtcccacggggcctggggggtgctgtgcccagaggggaggagacaggaagcgatgggtatgggcgccaggtttggggaggaggcccctttcccatagccgtcgacctgcgggccccacaggatctggccgctccagtcccggccacctgaccccttcccccacccacccgccatcctgcctggaggtctggcctcgcctgccccacggggcggggggcggggggctctcagaggcgcggccccaaccctgtgcagggcctgcaggctgaaccgtgtgcaggaacccggggaactcggtgaaggtgctggatgggggacaggacggcctctgacttccctatgctgcggggggggaggcttgtggttagcagagagtgggtggaagacagaggtttgaggagagagagacccaggggagaaaaccagctgcagaggcaggaggggtccagggcagcccgaggccagagatgggcgtcttccttacagccacctgtggtcccggcaccttgggctgttgtgagtggcgcgtggcgctcccactgtgcacccccggggccggttccccacttccacgacaccggcaggggggagccatccgccaggcacaggaggcctggacagccgtgggcagcgtgcgctgttggaggacgcagggagagggaaggctggcccagggacgctgtgtggggcagcgggtgcagctgcggggctgggccacaccagccacggtagccggagtgtccaggctgtgccaggccctcagcaaaaccttccatgaggcttcatgtgtttcttcttaagtaatttttttaaatttctttttttttttccagtcacgtctcactgcagcctccatctcttgggctcaagtgatcctcccacctcggcctcccaagtagccgggaccacaggcatgcaccaccacacccggctgattttttctatttttcatagaaaagggtcttgccatgttacccaggcgggtctcaaactcctgagctcagacgatcgtctggcctcagcctcccaaagtgctaggattctaggcgtgagccaccgtgaccggcctcggctgtgtgtttcttgctcatgagtgcagtgagggccaggcgtggtggctcacacctggaatcgcagtactccagggcaccgaggcaggtggatcacctgaggtcaggagttcaagaccagcttagccaacatggtgaaaccctgtctctaataaaatacaaaaattagccgggtgtggtgctgggcgcctgtagtcccagctacttgggaggctgaggcaggagaatggcgtgaacccgggaggcagaggttggtgagctgagatcacaccactgcactccagcctgggtgacacagcaagactccggcaaaaaaaaaaaaagaaagaaaaaacaagtgcagtgagacgtcttagccctcgggagtgtttctcttcagcccctgacaccatggaggcgaacaggcacctccgcctcccgagggacacagatgtcgcttagacgcccggggtgtcttccctgcgggaagcctgcagggctgctcccgccttgttcccgagctgtggcctcgggcgtgactggcgctcgggagcaggctctgtgctgctcgaaggataccccactcccagacaccagcttgagaagattcccgcacggccggggacggccccagggccttgggagcgtctgtggacacctgtggtgtgggccgaggagctgggagctcatctgaacacgccagcactcgcgcatccacgctgctggcggatgcctgggtttctccactgtggggccacg

SEQ ID NO: 2 - DNA, 1113 bp, Homo sapiens
cttaaaggcgcctaggacctttatttcgttgttttcctttgcataaaaagaaaacttgttttgtagaagggcaagcaaggtgcagcttccagaggcacctgggatgatgcccctctagcggtaggcgaactggggagtgtgggcggcgggggaaggcgaggccctggaggacctgttgtttttcctgttgcaagtgaaaaggaaacaaagtgggaagtggagtgtgcgggttggcggcaggcggggcgccccggcgcgccccgcctccctccctcgaggctcactcgcgcccagcgcagtcgctccgagcggccgcgagcagagccgcccagccctgccagctgcgccgggacggtaagcgatcgccgctggctgcgtcaggggaggtgggaagaggaccgcggccaggggctttgggagctgcggctgcgctcgggggcgcggggctggctggcgggcgtctctccggcacacacagcccgtgcgccctggccctgggcgcctccccgagtctagcgagccgggtcctgggagccccgggggccgggctgctgggacctgggcgggggctgccctagaggcccggggccgtcccccgtgggcccgccgagaggggcgtgcgcagctccccggcgcctgcactgcgcgccttgcccgcctggcccggcagcggggtttcagctgcgctcacagcggcggtgcggcctccggtgcgccggctgaggcgcgaggatactggaagcgctcagcgcgtgcgcccgctccgagcgctgactagaggaccaggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagatcagctccggatctgcggccgagccggggttacgccggcaaaaccgcccccagctttgc

SEQ ID NO: 3 - DNA, 14070 bp, Homo sapiens
caagatcacctacttctcccaaaactagtgtcttgtgttggtcatttagaaataagaacaaagatctgactcctccattgcctgcaccacggcttagaaccatgaccctggccaggcagcggcctgaagtttgtcttcttggacctaaccatgctggagacagtcagctgaggacgtgagaaaaggcagaagctcaaatccagcctgggcaacatagcaagaccccatctctcttaaaaaaaaaaaaaaaaaaaaaaggccgggcacagtggctcatgcctgtaatcccagcactttgggaggccaaggcgggcggatcatgaggtcaggagatcgagaccatcctggctaatatggtgaaaccccgtctctaataaaaaatacaaaagaattagccgggcatggtggcgggcacctgtagtcccagcttctccggaggctgtggcaggagaatagtgtgaacccgggaagtggagcttgcagtgagccaagatcgcgccactgcactccagcctgggcgacagagcgagactccgtctcagaaaaagaaaaaagaggctgggcatggtggttcacatctgtaatcccagaactttgagaggctgaggcgggtggatcacttgaggtcaggagtttgagaccagcctggccaacatggtgaaaccctgtctctatgaaaaatacaaaaattagctgggcatattggcaagcacctataatcccagctactcaggaggttgagctatgagaatcacttgaacttgggaggcggaggttgcagcaagctaagatcgcgctattgcactccagcctgggtgacagagtgagactccgcctcaaaaaataaaaataattaaaataagagcttttttagaggcaggttcttgcccttgcccaggctggagcacagtggctatttaccccactgctgatcagcactggagttttgacctgctctatttccaacctgagctggtttaaccctccttaggcaacctggtttcaaggaggtcaccatattgatgctcaagttagtgcagacaccccatcagcatagggcaccaaagccccgaactgggcacaagtgatcctcccgcctcagcctcctgaataggtgagacaactggcgagcaccaccacacctaacaaggcagggagatggattcctcaatagaaaggtgtggagctggccgggtgcgctggctcccacctgtaattccagcactttgggaggctgaggtgggcggatcacgaggtcatgagatcgagaccatcctggccaacatggtgaaacctcgtctctactaaaaatacaaaaattagctgggtgtggtggcgtgtgcctgtagtcccagccattcgggaggctgaggcaggagaatcgcttgaacctggggggtggagcttgcagggagccgagatcgcaccactgcactccagcctgggcgacagagtgagactctgtctcagaaaaaaaaaaaagaaaaaaaaaatgtgtagagctgatgaatgctctccaactggaacccaactccttgatatggtctgtaatgcctccaccattcccccactcactcattcattcaccagccacgtgttcgactcctcctgtgtgctaggcactgttctaggctctgcagatgcggcagtgaagcagacaacactagcacccacagccacaggagcctgccccctggagcttccctgctgctgggtgggggggctgcagtctgaaataagccagtaaacagaaaatgtgtcaggtggtgggaagtgctgggaagaaaaccagagcagcccgaccacgcttccctgacccacgtctcacacctcccacacccctcccaggcgaggctccagctctgctgaagcttttttctgggtcttaaaccggcaggctccccctggcctctgggtctttatctactccattgcctctgcccaaagctctcttccacccaatgaactcctactcagtcctcagcttctatttcaattcctcagagcccttccctgagccgaccgaactggccaaggctcctggagttgggttctgcagcatccccattgtagactttgtgacacttgactgtaagctccttgagagcaggaaccaagcctgtcctgtccttggcgctatccccagggcctagtacagcatgcggcatatgatagacgttcaataaataaatgttgaatgaacgagggagtaaatgagctcccaggtcttgggaaggtagacctggcagccctgagacccgaggttcctgtttcctgggattctagcactggggctgagctgctgctgttctagcttgcgctggtttctgcacatctgttgccctaggcctcaggcagattgtggggtctcggctcagcaccagtctcccaggggagtctaggaccctagggtggatggtagggagcggctggggacagctgaaacatcttcatctgggaaactctacgtccgccatccattggcagctgcagggcccagtcccttggcgtgcagatggaagtgtatggaaataaccccaccttccctccctcaggccacttttaacctcccaggcaagacaaggacctgttggctactgattgccaccctctgagagggaggctgcaaaggggaattctccctggaggggttgggtgacccttccactcccacttcatcatgaggtgaagcgtgcatggcccagaaacacacacacagctggatttcccccctctgcctttggaaagtggcattcagatgttctgagaatgcacactggctcaatgtagacttggctgtaggtttgctgaacttttcagcccaatctgtgggaggacatagagtgtagctccgaacacccgccctcggtattgccacccactgactgcgtgacggcggccgtgtcacttagcctttctgtatgtagctcagttttgtcatctgtacacgggcgataactccaagaagaggtgaaccagatccgacctgcagagacccgggcacgtggtctgacggggaggggagctatgagaaatgataagactgtcatcagctcttccatcataagattgatgccatcctgttgcctggaatggaacctgccccctgagtttgctccagctcatgccttccccaggacgataagagagaatggaagcagggcatggagtcctttgatccagtggccttcacccccagctcctggaagggctgttgctgggagcagatgccggcagcagccttcttgccagtttcattagcatggaggctctgaggacagggagggaggagggatgtgggtgggcaggaccctccctggggccagtgctgaggctgtgagggtggatggctgaagccttgcaggaagttttgagaggaagctgggcccacaggatcgtgatgtgatcagttggggtggcataagagtgcctgatgatggtttgggtggcctttggggacatcccctgtcatgccatcaccatgctgagctctgaccacactctctttggccctctttatctgtggctaagagttggcaacacagcctctgaaactcagcagaaacccctctgcttcccccagccctgcctcctctatcccccaccattgttgatgggataccagaggcacccaggtgtcctgggcctccagctcccgaggcaaggaagcctttcttggccagccaggactcatgacatctcagccagtggagaaggggagagggagggctttgagaattccccaggcctcagatttggtgggggaacccttcctgtccaccaggattgagggttacagaacaccccagcctcgagggagaactagctgccccccatcccattcccagcaaattctgacaaacaccccctgactcccatggtggaagtttgccaggtgtcaactaaagaaaataaaaagctgaagaattagagttcgggctgggtgtggtagctcacacttgtaatcccagtaatttgggaggctgaagccagtggattgcccgagcccaggagtttaagagcagcctgggcaacatgtagagatgaaaccccatctctactgaaaatacaaaaaattagccaggcatggtgacatacatctgtggttcccagctacttggtaggctgaggtgggaggatcacctgagcccggggaagtctgagactgcagtgcgtggtgatcacaacactgcactccagcctgagcaacagagtgagaccatgtctaaaaataaataaataaataaaaatgccgggcgtggtggctcaagcctgtaatcccagcactttgggaggccaaggtgggcagatcacttgaggtcaggagttcgagaccagtctgaccaacattgagaaacccagtctctactaaaaatacaaaattagccgggcgtggtggcacatgcctgtaatgtcagctactcgggaggctgcgggaggagaatcgcttgaacccgggaggcagaggttgcagtgagctgagatcacaccattgcattccagcctgggcaacaagagtgaaactccgtctcaaaaacaaaaaacaaaaactttagagttctttttattcagaagttttaccaggactatagaccgagcctattgcctgagagcagccctgtggaggggttctatcagctgctctggcagtttcagttcacagtttatgtacaggtggtgaagctgtaatatgtacaaaatcacatcgaggtttgggtatagagtacatctggctatagatgactaaagcacatctgctgaatcgattgtggaggcagaatcactaaccccaccagatggtatcttatgtgtaggaaaaagcaagtctggggccatttatctttcaaggaatatagtgactcacgcaagagacatggggctctattctgttttgtcttcaaagcatccctccagagagctgcccattgtcacagagccagcggcttgtgaatccactcaagcagaaatgagcaaacataacttcttacatttgctacttaggctcacccaggagaggaagcagccccaggtgccagctgtgtgttgcagaacactggacctggagcctcagcctgggggtcagtgttggctgctgctcctgcacaagtcagtgggcttctctgagcctcagtttcctcatctgtagaatggggattagaatgctacctactgggccaggcaccgtggctcacacctataatgccaacactttgggaggccaaggtgggtggattgcttgagcccaggagctcgagaccggcttgggcaacatagggagacccctgtctctacaaaagaatttaaaaaattagccaggtgtggtggcacgaacctgtgtttccagccacttgggaggctgaggcaggaggatcacttgagcccaggagttggaagctgcagcgagccacggtcgagctactgcactccagcctgggtgacagagcaagaccctgtctcaaaaaacaaaacaaaacaaaacaaaacaacaacaacaaaaaaaaaaaacccagaaaaccaagaatgttacctactgcgttggggtttttagaggatgaaattagatgatcaggagatgaaatgcgtagtgcagtactgggcctaataaatgtgcaacattattatttgaaaccagggcctgtgtgcatattggcagatgaggatcctgtctctagaggggtccaccccacctggccagatacacagtaaggaatgagccgagtgggagcaggggaagtttcaggtgattcttccatgaaatgatggacacagggcgctggcccagtgtctgtgctggagtagggccctgcgggcctccaagcctgggagggtcagaggcctgaaaaccactcaggcccttccaggaatctttggttgggaactctagggactctgtaggacacggtgtgggaacagagcaggatgggggcagttacccacacctccattccactcctcctgcagggtaagacctgctcaagtcccgccttcaggccggattgcccaaacctttcctcagtctccctgcctggccacgtggactccccatccccgtaaaaccctcctgtggttctcctgaccgggatgggtgggttccttgggacttcttgccttgctgggctgggcccttctgaaggacaagggtctcccaggtgctgatcctccctgtgggcctcagctgccaaaggactctgaggacactgacatttgggagagccggcatcttctctgggtccctgatgtgggttcagaggtggccccccaaagatatgtccacctagaacttcagagtatatgaccttatttggaataagggtctatgcagatataatttttttctttttttttttttttttttgagatagtctcaccctatcacccgctagggctgtataacagaacaccacagactgcagggcttaagcaacataaatttcttttctttttttctttctgttttttgtttgtttgtttttggttgcccaagctggagcgcagtggcacgctctcggctcactgcaacctgcgcctcccgggttcaagtgattctcctgcctcagcctcccgagcaactgggactacagacgcacaccaccatacctggctaattttttgtattttcagtagagacagggtttcaccatgttggctaggatagtcttgaactcctgaccttaagtgatccacccgccttggcctcccaaagtgctgggattacaggcgtgagccaccatgcccagcctttctgcagatgtaattaaggtagggtaatggggctcttaagacgcgagtccctctccctctccctctccctctccctctccctctccctctccccacggtctccctctgatgccgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggcccgtctccagctcctaatcgcgagtgatccgccagcctcggcctcccgaggtgccgggattgcagacggagtctcgttcactcagtgctcaatggtgcccaggctggagtgcagtggcgtgatctcggctcgctaaaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgccctgccgccccggctgggatgtgaggagcgcctctgcccggctgcgaccccgtctgggaggtgaggagcatctctgcccggccgctccgtctgagaagtgaggagaccctccacccggcagccgccccgtctgagaagtgaggagcccctccgcccggcagccaccccgtctgggaagtgaggagcctctccgcccggcagccaccccgtccgggagagaggtgggggggtcagcccccagccaggccagccgccccgtccgggagggaggtggggggtcagccccccgcccggccagccgccccgtccgggaggtgaggggcgcctctgcccggccgcccctactgggaagtgaggagcccctctgccaggccaccaccccgtctgggaggtgtacccaacagctcattgagaacgggccatgatgacaatggcggttttgtggaatggaaaggggggaaaggtggggaaaagattgagaaatcggaaaaaaaaaaaaaaaaaaaaggtagggtaatgatctcaaaatgagagcatcctggtttagggagggctttaaatccaataataggtgtcttataagatacagaaaaggacacaccacagagacacaaagaattagggaacatgggccaggagtggtggctcacacctgtaatcccagcactttgggaggctgaggtgggcggatcacctgaggtcaggagtttgagtccagcctggccaacatggtaaaaccccgtctctactaaaaatacaaaaaaaaaaaaaattagccaggtggtgcgtgcctgtaatcccagctactcgggaggctgaggcaggagaatcacttgaacccgggtggcagaggttgcagtgagccgagatcacgccactgcactccagcctgggcaacagagcaaggcgctatctcactgaaaaaaaaaaaaaagcaagcagggaacatgatgacaggggcagagaggactgatgaaggatggcaggcagctgctagaagccaggggagaggcataggagggacagattttctgtcagagcttccagaaggaagcaaccctgccaacaccttgatcttggacttccggtctccagaactagaggctagaagtttcaattgttttaatcataccgtttgtgagcagttactacagtggccctaagaaatgaacacagactgggcgtggtacctcatgcctgtaatcctagcactctgggaggccgaggtgggtggatcacttgaggtcaggagtttgagaccagtctggctaacatggtgaaaccccgtctctactgaaaatacaaaaattagccggtgtaatggcatgcacctgaaatctcacttactcgggaggctggggcacgagagtcgcttgaacctgggaggcagaggttgcagtgagctgagatcacgccactgcactccaacctgggtgacagagcgagactctgactcaaaaaaaaaaaaaagaaatgaatacagttcacagttgcctggatgaatgatgaatgagatgctggggtggccacgtgacggctgtttgctcacggtcaagtccacagtttagctcttagcttcagttgggaattaattttctggggcaagcagaaacctcagtgtcctgggctgaactgtgtccctccccaaattcacatttggaagtcctaacctccagtacttcagaatgcaacagtcctttgagatagtctttaaagaggcaattaagttaaaacaaggcctttcaggtggaccctaatccaatacgactggtgtccttacaaaaaggggaaatttggccacagacctgtgcacgtacagaggaaagtccaggtgagaacgcagcgacaacatggccacccgtgagccaaggagagaggtcttgaaaaaacccagccctgctgacgcctcaaccttcacctccagaagtgcgaggaagctaatttctgtggcttaagccaccccatttgcgggactttatggcagcctgagcagactaacacgctcatcatgccagaaaattccttgttgggcttgaggtggagtggggggaaggaaactcatccctggccctccatcctgagattcctgaactccaaagctccccgctgcttgacctcagtgctccaagctgtaaatgcaggtttgtcttaccggccaaagcagcctctcaagatgacacgttggggagatgaggtctcccatagatgggaggggtggacagcaggcagtacccccaaccctctgccctggtcaccgacaagctgagacagcctcatggcccttggtgtctggccactccggcatctgatgtatcttggggttttataatcctgggggttcatctgtcctaggtgtactaaattcgggagctcatggcttgcaggcatcacttatggtagtaagaggaagatttttctttctattttttttttatttgagatggagtcttgctctgtcacgcaggctggattgcagtggcgcgatctcggctcactgcagcctccacctcgcaggctcacgtgattcttgtgcctcagcctctcaagtagctgggattacaggcacgtgccaccacgtctggctaatttttatgcttttagtagagacgggatttcaccatattggccaggctgttctcaaactcctggcctcaggtgatccacccacctctgcctcccaaagtgcagggattacaggcgtgaaccactgtgcccggccagtaagaggaagatttagatagtgcgtatcatgtgccatgcactattcttattttatttattttattttttgagatggagtcttgctctgtcccctagtctggagtgcaatcgcgcgatctcggctcactgcaacctctgcctcctgggttcaagtgattctcctgcctcagcatcctgagtagctgggactacagtcacgtgccaccacacctggctgattttttgtatttttagtagagacggggtttcaccgtattagccaggatggtcttgatttcctgaccatgtgatctgcccacctcagcctcccaaagtgctgtgattagaggcatgagccactgtgcccggccccaccatgcactattctaagagctccatatctcttactcttcgagttctcaaaaccatcctgtaaggtaaggttattatccccagtttagagatggggcatttgaggcacagagaggttaactgacctgtctcgggccacacagctatcaagggaccaagccaggattcgaactcagaccaccctgaactccagagtccgtccttttgagctgcatcacatgccccttggtagacatctgtgctgacatttctctcctcctctgctggcattgggtggactcctattttcctcgggaggcagcttagccaggaggagtggcaaagcctggattgggctgagtgagcccctatgtggccccgcactacataacctgacactgagctctgggccttccttcccttcctccctggctgacaggggttagaggtggggtcgctgccccacttgctgtgaagttgggggaaggggatcataatgctttgctgatcacacaccctggcacacttgcatacacacacacccttacacacacagccttgagcacacacctacccacccacatgcacacacccacacccacacaccgtcacacatttgcacacacaacctcaagcacgcagaacctcacacacacatccttgtgcacacacaccacgtgcatgcgcacataatctcaggggcacaagccctcgctgctctcacacactcatacacttacacacacaccctagacacacttgtgtgtacaccagctcacacacacaccccactctcatacacttgtggacacacagccttgagcccacaggtccctacttttgagggcacgagccctcttgcacaccctcacactccctcccttacacacactccctcacatgtgtgcacatgcatacacacacgcacacacacacgcacacacacacatgcacacacacacatgcacacacacacgtgctgcaggaagccctgtcattgtcagtgtggccccagaacttagtcatttaatgacccattgggccgtgtttctttcatggaagccaacacttggctttttctttaccgagatcttctcactcagtttctctcagtctcacttttcattttgactggcaaggagtttttttcaatctcttgtggttttaacagcaccagcggctacagctcaaacctcaagcatccagggccaccgcctgcctctccgatcggtctgttctggctgggagaagcccagggcttccctgcttgtcagcccggccgcttgcccagcagtttgtgagatggaaggtggagagaaagaactgtgggggtgagaagtgacgtcaccataggggctggggttgtggacaggcccccatcaaccctctcccgccacccccagagcaccaatgcgtcatcttggagtttctttagtgcttaggcagatgaattctgacgtgacagctgggaacccctgcgggggaagttggggtcaacagctgatcccagaggctcccgggggcactgacacctgggagccccagctgtgttgccccttttccagccatcaggtttggggggctccaagctggcatttatacccactgcctgcagccgtgtgaagtctttcagactgagttcaagtcttgtttcaccattgtcagcagagtcactcagcaaggtgctctgtcccctcccgtggaaaagagggtgacccagaggtacacagattgttagataggtcctaaggtttgaaaagtcttagagcattgccaggtatggtggctcacacctgtaatcccagcactttgggatgctgaggtgggcagatcatttgagcccaggagatggagaccagcctgcctgggcaacataggaagacccccatctctacagaaaataacaaaaattagccgggcatggtggtgcgtgcctgtagtttcagctactcaggaggctgaggtgggaggatcaattgagccagggaagttgaggctgcagtgagctgagatcatgtcacctcactccagcctgggcaacagagccagaagctgtctcaaaagagaaagaaaaaaaagaaagaaagaaagaaaggaaagaaagaaaaagacaaagaaaaaaaaaagtcttagaacaattcctgggatgaagcagattcttcctgcttaggaacctttcagatccaaatccatgactcccttcttccttccaagttctctggagttgagcccaggcacagaggacacggttattcattgaaacagtaggacatgttgcttttttcttttttctatgtgactttggacaagttgcctcacaactcaacttcatctctttctaagcctccttgtggatatgggaaataaatgaactcatgtggagaagagccgttatggactgaactgtgcctgcttctccctgccaagttcatgccccccaaattcataggttgaagccctaacccccaatgagacagggcctctttttggtttttgttttcatttttgtttttgtttttttaagacgaagtctttctctgtcatccaggctggagtgcagtggcatgatctcggctcactgcaacctccgcctcccgggttcaaatgattctcctgccttgacctccccagaagctgggattataggcacgtgccaacaagcccggctaatgtttgtatttttagtagagacagggtttcaccatgttggtcagggtggtctcaaactcctgaccttgtgatccgcccgcctcggcctcccaaagtgttgggattacaggcgtgagccaccgcgcctggccaagacaggacctttaaaaaggtaattaaggttaagcgaggtcctaagggtggggctttcagctaatgggattatcacactcctaagaagagaaaaggacaccaggaatgcacacgcagagaaaaggcccctcaaggacatagcaagaaggtgatgtcctcaagtcaaggagcgagacctgaggaaaaagcaaatctgctgacaccttactctcagattcacagccttgagaatgataagaaaataaatttctgggctgggcgtggtggctcactcctgtaatcccagcactttgggaggccaaggcgggtggatcacctgaggtcaggagtttgagaccagcctggcaacatggtaaaaccccgtctctactaaaaatacaaaaattagccaggtgtggtggcacatgcctgtaatcctagctactcgggaggctgaggcaggataattgcttgaacccgggagacagaagctgcagtgagcaaagattgtgccattgcactccagcctgggtgacaagagtgagactttgtctcgaaagaaaaaaaaaaaaggaaataaatttctgttgcttaagccctccaacgtgtgttgttctgttatactcagccctagtggactaatacagggactgctattgcaatggctggtaggcacctaggagctgctgatcaatgatagccatgattattgtttgcatagcaaacagtcttggaagctggaggtagcatctcccactgggctagcgagcaaatgtatttactttccaggacagtaaggactccctcccgtcccctagggagatgg

SEQ ID NO: 4 - DNA, 9407 bp, Homo sapiens
ctttcttcctgtgaaggctgtaagttgtaagatgcaccagtaattataacatcgctaagtgtacacattaagtgtaagaagcaatttcccaattttggcaacattaaaacgcaagcgatggctgggcacagtggctcacgcctgtaatcccagcactctgggaggctgaggtgggcggatcacctgaggtcaggagtttgagaccaacctggccaacatagtgaaacgctgtttctactaaaaatacaaaaattagccgggcgtggtggcgcaggcctgtaatcagctacttgggaggctgaggcagaattgcttgaatccaggaggcggaggttgcagtgagcagagatcgcgccacagcacttcagcctgggtgacagagcaagactctgtctcaaaatacaaaacaaaacaaaacaaacaaacaaaaaaagtgagcaagccacgcaacatagatttgagataatggtacatacagcacatctggcggagtaacacagatgtttctgacttaagatttttttgattctgcgatagtattcagtagaagctgtagtttgaattttgatcttttcctgggctagcgatgcacggtctgatcctccctcatgacgcagggagacagcagctcccacagctccccacaagccctgtgatcaaaaaggtgagcgatgacactctacagccaccgcgcgccaggtgctttcaccaaactgtaggtgtgttctgagcacatttagggtcagccagcctaagccacgacgcttggcaggttagggggattaaaagcattttctacttccagtggatttttcgtcacgtaaccccttcgagggtgcagcagcatctgtacctgctcatatgaggcacatgactcaaggcgggggttgtggttggttacctagggtttaatacaactgaggctggccgagagggccaacattaggaagccatttttgaccaacaaatgatttattctacttagaaatgagtcttccacatgccattaacaacaaagagctttttcaggaaacggtaagtcccctccatctctttcttttctcagacaggtgccctgaccatccagagataaataataaacaaaagcaggcctcctgggctcgctttcagccattcatactccaaaccccaaagctttgccctctggaatctcacagcctggaaggggccacaacggtttcctaaagaaagggtcaggaaggggcagaacaaagaagacaaatggaaaggagaaatgaaaatcactacatttgggtcaaccacaggcacacacaaggctcctgttgtccacatgtaaccttaagcttccctgaaggggatgaaccaggccctcggagcctaattaaatgaaccatttcctggccaggcacacaacccatcacctgtgtgcagagaagccagggtctctctaagctcccggctgcttttaattaaggactcgtccctgagagatgaagcacaacatacaaaaccaccttcgagtcaccagaatggaagtcatcttggacttagtgctgagaactgcctgcagccggccagccagccggcaggagaagctgccgcctacagccaggcgatggcctcaggctaaggagcacagggaggctcccctgactcaggcttgccccacacccagcatcctgcatgtctatccagaccacctttcttccccgtgttccacctaagtcatccttcagggtctgattcggccacgcctgcctcttccactgcaacctcccaaagccgcgacggcagaggccgttgccccgcctctactcctgcaccctgtgcaggatgcggtcttgagcctcacaggtttgtgacatgcatgtgtctccccagggcagtgatgagctgtctggacggcctcatgcccggcttgatgctggcaggacttctgaagcgttggtgggatggtgtgggatggtggaaaactagggccacttgggtcaggttctgatcttttgaagcccaagcctgccttggtgggaagcaagttctcagcactcttcagcacctcccttaaaggagggactattcttcggtgagtgggagacagaccgaaacttgacgtggatggcatttcatcttcctgactgccagccctgagttggatgaaggtgtgcacccactgggcgtgggctgccgcctgctgtggagctgccgctgcccctcgtaccctacacaggctcctcctaaagccagacccgcagccttcccagcatgaaggcaagcacggggtagctgctgttctcttcccggacggtcctcagtcctcggtccagctttctcagtccacatttttattaaggattattggccagacgcagtggctcatgcctgtaatcccagcactttgggaggccgaggcaggaggatcacttgaggccaggagttcgagaccagcctgaccaacacggtgaaaccccacctctaataaaaatacaaaaaaaaaaaaaaaaagaaattaggcactgtggcgagcacctgtaatcccagctactcaggagactaagggaggagaatcgcttgaacctgggaggcggagggtgcagtgagccgagatggcgccactacactccagcctgggtgacagagaggactctgtctcaaaaaattaaaaaaaaaaagattatcgtattggcttgtattcttctgtcacctgaaatctttttgggaaaagaccaggtaaaaatacacaaacataactcatatataagttgatttttctccaaagacactgtaatttcacagaggatctctgtcctctcgtttaagtgaaaagatacatagtgaaaccaaatttttgttctcgtcaacattttaatgaaacattattcaagggcctgctgtaggtcataattcccaagaacctatggacaacattaagtgaggacttactgaactatcaaagttatgattggaataacagcaaagatgtttaggtcttaccatttaaaaggcatgtaacacacatcctcattttatcatcacagcaaccctgcagaaggcaggggtgttattatcccacattactgtttacaggtgaaaaaaagaggcacaggtaggttaagcaacttggctatggtcacacagcaggtaattcaatgaaagccatgcgatcccaccctaaggccgtgcggactctagaatgacacctggtgagtaacctagcaggcaaaataattcagctgaaagagtcaccagctggatggtggcagagagaagtacttggcaagattggtttttcacacaaggtcaacgcgaacggaacctctcataccagccacctactagggtacagcatcaagacctaatttcagggagggaaatgggaaatgcatccatttcatcatcactggatactaagggttaggcctggcctcaggctttataaaccacatgtgtgccaaatgtccacgtctaaacctagagtttagggtgaaaactatgaatgggctaccatggaagttacaaaataagaatgcagggggaagcctgagggcgcgcgccacccgaatgcgggaggagccagatggggcagcataggaagggctgttctttaccactgatctggggggctcatgatcgcccagagggacagaccaacagcatcggggtctgtgggttgatattcatctgcacgtcgacactggtggggatgccagggaaatctcacatgttctgtttagcagaaacgagacacctgaggcagaaagtgacaataaggagtcacacggccaggcaaccatgggcaatggcaacgcaggggatactttagaatctgaaagcctgtgaaacaccctcaagtccgagaggatctgctccatgatgaggaactccgtgacctccagggcccacacacggaggtgagccacagtcatcctgccacacctgctcagtctcccgatgagccaggcgaggtgctgagccctgtactcctcgccccaggggtcctgatagccccttgggaggcgaatgacctttgaagccacagcagaggctgaccagctcagagcacggagccactgagtcagagggcggaggtctggcttcctccaacagattctccaaaaatcctcacgatcacaagcttctaaacctccatgacctaccatgattccagtaatacttctgtttcccttcaagtgggagtgtttgtgccatgtttacgtgtctgagtgggggagcgggtgctaaggcagactcaacaagtcgggttgcttcgctgttctcagcacaaaagtcacccaggctgtctggccacaatgtttcacactggattccttccactggagggatgtctcatcaggttttgctgtaatttcactgagtcacccatagaaacgaccaagcaggggagactggaggggacatctccagggggccacatctgagctgagttacagaaagtgaggcagggctggcagttagggcaggtcgcaaagcagcccaaggactaaggtgcagacagagagcatctctgtctgtcaaaggcagacagcgtgggatgccgaatgctgatagctgcacaactctttttttttttttttgtcacccaggctgcagtgcaatggagcgatctcgagtaccgcaacctccgcctcccaggttcaagcaagtctcctgcctcagcctcccgagtagctgggactacaggtgcttgccaccatgcttggctaatttttttattttttagtagagacagggtttcaccatgttggtcaggctggtcttgaactcctggactcaagtgatccgcctgtcttgccctcccgaagtgctgggattacaggcatgagccaccatgcccagctagctgcacaactcttgcgtgtgctaaaaaccattggaccgtacactttaaaagtgtaaatgttatgttatgtgaattatatctccagaaagctgttgttaagaaggtgaatcaagagaggatattttaggcagagagaaccacatggatccaagacatcacaggtagacatccaggaaaccaacagtttcagaatacgagtacgtcatgtgacccagagttaggttggtaaaaagtgaccctgggtgtcaggaaccatgggcagtgttgtctttctcctcactctcagtcgtagctgtttgactcttcactcttactacccagagcttttcctacatcaaaataaaccaaggtactgcagggacttgccactggcctggaagtcagagctggttctgccatgaaacggtgctacatggggcatgggccacagctccctggtctctgcaatggatggttctctgagagaggagcactttgagggctgtgagtacagagggaggagctcagggtgtcaagagtgggagaggaagtctgggcctaccaccttctacctggtttattcaagttctaagattttgcttaaaaaaagggctgtaccaattttccaaatgtttgaaaaccactagatgagataatcggtaaggttcattttagtgttgacatcctacgaagtttcatagttcaagacttgagagttactcaaaagtttgtgtcatccctcctaaaacaaacctttactaagcaaggtactctgaggctcaaaccaactgtggactgcccagctcttcggttcacagccttaggacacagatgcaagcagctgagtgagttattcacaagaaggggaagaaggaaaaggcttggaacccataatcttctcccctgaatgccatgttcaaatttaaactcttagggaatttctatatttgtatacagaatccaaattcccttctcttttctcttccaggagagattccgagcccaccccttgcctgcctccgagacctcaacaccatcctgcttactaaagggagcccagtttttcccgctacccatggcacaggtcttcgtcaatttcagtgtgcccttcatgaatctggcatgtggtcactggcagttaaagggggtgatgatggagaggagaaaccccaggctccaactacaaaaccctgcgggacacgcaggctcctctgggcttcccggcccacattcctggcctatttcaaacatcagggaagcagactgagcgtgccatgccctcctcaagtatttttaacctgtttccaaaaccagacatgttctaaggggggcgacccaggaattcctcatccagggccagtgcctgccaaccgcgagatgttggctttctaacagctctgaggagggagttgttgtctgccttttctggcacgtggggaagtgggatctctctccaattcacttttacgtctcacatttctcatcaaccagagggcaggatctaacttaaagtgagagtcttcagaccatcctcaatggaagctctccaaacactgttctccggcttccaacaacaacaggagtccataaggttccccaaatgaaggacctggatagatcttgtaggaaaaaaaatcctatgaggacaaggccaaggaacgggcctatatgcacttcacttgaattatgcctcctggctctaggtgacaagagccatctttttcaccactggagagctcagcctcctaccaccttgccccgatcctgacctggttcagattcctcgctaacatacttctctcaccttgtagcactgttgcacattgaacaggagggaaaagctcttttgttcattttccttagaatggaaccaaaatgatactccagtagctccatctaaaagctcaagtggcagctaacagcacggacaccaggggcatcccttgccagcttccaatgccatggtgagagacactcatcatggtttaaaaaaagaccagagagcattttcacaagcaattcctaagagacttaaatttcctacacataggcagaataaaaaccaaaaaggaaaaaaaaaaaacttcccccaaacaaaagtgagggctttcaaggagacttgctgagtgggcaaacattttggaaagatggaattttaaacacaaacacaaaagggcaaagatttgcagcagaagagctatgcacacagccgggaggactttaattagggaaagctttgcaaagcccagggagcatcagcatcggcaaatctccccttggtctccggaatggaaagaatgtggaaaccaatgggtgatcaaggagttcgaattttgcctgacactcttgctgggaatgaagcatgcagtcctgtcttttgccaccttttcagcagcctcaggtgagccttttaaaaaggtgaaaaacgaaggaccacctagcctgggagaagccagggtggatcctctccttcctagggtgcttcctgcagatggcacacagccaaagctcttctggtgttttaaggcagaaacagaattcaggggaggactaaacaacccctttagagctacgtgctgtgttttttgtttgcatttttccaagtccaggcatttttccaggtatttccaatgagactgaaatggcctacacataggctgacgacctataataacataagaaagtgatgttggccccctgctccacccagaggggacatctgcttatttggcttccaggtggtgggagcagtggttttccccaaacagctaatacccttcaattctttgctttctgtatcatgaagttcactggagtttggagcacagactctttaaaccagtaatttaactctacttttgaggataccctatgcccccagcagttatgagaagggttgccaaatcttaactcataagggtgacaggatcaggaacaaaggcctggactctccacccttctcctctgccaaaatctacgagttcaggaaaatggcaagccaggagtttactttaggttccctcaagagcagcagctgttcccaccagggctgcgaaggaatcaacaggaactgagagaacacctgaatggtctgattcagaaagtcccagctccctgtgaggtcaataaagaactttgtctcaacagaggcaacaaggccactgcctcctaggaaaggactgatgtgggcttttctagaggcaggcaggctcttggatcaacaggcttacaagggcacatttctcagttacgatcttaaaattgcagggaacctgctgatctctgtcccttacccatctagaaagtctgagtgggagctaacagctgatcctcagcaaaaccagagtgtgcgcccatcacctgctttctggtaagggacccatgtggcctgaatcaaaactcaaagctcactagacaccaattcacacgctctatctaatcaggcagaaacccagctgctcctgctcagtccctgcccagctagtaccttcccaccacccaccagctgtatctcaggctctgcccactctaagctttccctgggatttgcctgccaagggtgggccacggtgtcctctgtggtgctctgcagtgcccatgttcctcacatcagaagccttgcattctggctgggagcggtggctcacctctgtaatcccagcactttggaaggccgaggcgggtagatcacctgaggtcaggagttcgagaccagcatggccaacatggtgaaactccatctctactaaaaatacaaaaaattagctgggggtggtggcaggcacctgtaatcccagctacttgggaggctgaggcaggagaattgcttgaaccagggaggcagaggttgcagtgagccaagattgtgccatcacactccagcctgggcaacaagaacaaaactccatctctaaaacaaaacaaaaaaaaagaagccttgcattctatccatcctgggttatctggctcccaccgtggctatgagctctttaaagacacaactattctgttgtcactctgaccctggtgcttcagcttaggcagggccttgcattcatgggggctcaagtaggcatgcactcactgaatgtccgcttcaggcttgacagtggggatacaaaggtgaacaaaagaaaagatccctgccctccaagagccaaagctcctaggatggagcaagtccaagagacaggagaagcaaggggcatgctggggggcagggtgagggaagtgaggctccagcggagatgggaagatgagcagttagagggagcagagttggtgtggacatgtgtcccagtcaaggaaacggcatgtacaaagatgcaacaagacagggcacaggcctgggagtgtgcaagacaaggagacaggaggaaggggcagggccagatcaagagctcttccacctagatgtgttctccgggcttgatcccgacaatgtggagtcattaagggacattatccgaagtgcattttggcaagactactctgtatgcagagcaggcaggggatgacaggcaggaaggcctgtctacaggctattataacactccagtaatgcagggaggagcagtagcaataaaca

SEQ ID NO: 5 - DNA, 4287 bp, Homo sapiens
ctcttagttgtagaaccaaggagcaaaagtagtttgtggcagagggaagtaggataactgaatttcatcatctgggggcgggggattgggggtgtctcatcccattcacaggccagtcccctcttctttgggagctgccatgttggcactgcatgatcccgcccctatccatggttgattggaccaggagtggaccaagctgggccaatccaatgtctttgggagctgccatgttggcatcgcatgattcagcccccatctgtggttgattggaccaggagaggacccagctgggccaatccaattgtctctcctgggcactgggattgcaatgcacttgcttggggagccctggggaggcaaggtcctgctgcaacaacaaggaggaggagaaaatgggtctacaagcacagacgaacaaagcaggcacagagagaagaaactcagagataggaaatgggttggactggtaactgatcaaatctctgcttccagtctcttctggagtattggctgccttcctgcccttggctgtcatggacgaaccccccttttaataaactattctctttggttatgccagtggagaggttttccattacctgcaactaaatttttcattaatatagatatccaataaaataatgctcataagagcaggtatatctcttccaagggacttacaggtattattttacataaacttcccaacaaccctctgtggaagttgttaacattcccatttcacagatgaagaactgaggcacggagagcctcacttgctcaaggtcaagcagctactggagccagatttgagcccaggtagtctgacttcagagcctgggccacagtccatcactatagaccttttcatttgcaactgctaggagatgagggctcaggccttcggagcccaccccatcacgcgctcactctagccctgcaagcacacagaaaactggaggagttgaaatctgaggagggatgtttgccctctgtcccccgctgccctaaccactcccgccccctggaggtatgtgaagagtccagaatccctgggattcctgacactgcactttgaggtgataaacattaaacccactagtcttccttactctgagtgcccagaaacacctgggaccacgtagaaggaggctgtcaaggagactggactgtcctggaggtgtgccacacagtcactctcaccttccagaagggcttgtgggcatgccctctctctcccctgacagagactgtgaggccccgtggttagggggcctaggctgggagccacatgctgggtgcctgatcttggtttagcctccaagcctccgttttcattctctgttgaatggggatcataataacccctacccagaggagtaaatgagataatgcatccaaagggcttaaaaacttggacaggattaggaaaatgttggcgtatgatgggagaaaagcagggactctcaatatgtatcatcctacgcgcctatccttttaaagtttttttaaaaattagatttggaaagataaaaaccaaggtgttaaatgggatatctctgtgtgataagattaccaggcattttagtttacttgactttttgcatttacacttcctagcatgaacctagatgatttatatattttaaaacatattggactttacacatatacaatatttttattattatttacttcaagtgcttgcctaaatcctaaagctattgtgtgtgggacacttgtgagttgcctctccagcacccactcccctcttctcttttcagggcagattgggtgggttgaactccactccatctccaagggtgggcctggattggcttaaatcaatcactgttgtgacaggcttagggagctcatcgtggaggctgggtccaggagatgcaattccaagacttgtgtttgtttggggaaatagattttctttctttcttttctttctttttttcttcttcttttttttttttaatatattaacagtgacttccatatatcacctgggaacctctgcttgggtgagaatgggcccaagagggaggaagaggagctgagaatggaaagacagaaaagcaaggtcctgattatatcactgaaccactgggaagacgctctggatgtagacttttttttttttttttttttttgagacaggatctcactctgtcatccaggctggaatgcagtggtgtgatcactacccgctgcagcctcgacacccccataccccctccaccaccagctcaagccatcctcccacctcagcctccaaagtagctgggactacaggtacgtgccataatgctcaactactttttgtggggttttgttattgttgttgtagtgtttgtttttttgtagagatgggattttgccacattgcccaggctggtctccaagtcctgggctcaagccatcctcctgccttggcctcccaaagtgctaggattacaggcatgagccatcgtgccctgcctctggttatagacttttcattttagtgagcccatacattccattattttcaaaaccagtttgagaagttgtattttctgttacttggagctttctaactggtgatgaaactggtaccagaagtgggatgttgcaagtaacaggccttgcacagtgggacttgtagagctgacaaggtaggtgcaggagacctggacctgaggctcttggctgggaaggtggcaactctcaaatagttggtaattaaagaattggttactccacagcctgctgaatcttggaatttaaaccatgtgcctacataaggctacttctttaggagacttgtgggaaaattttagcattttgaaatgtttggctggccacttcttgtggtttttagtaaattcctacaagaaagaaatatacttcttttgaaacagggctgcttgaaagaagagagggaagaactacagctttgctaagagaggccctttggacttgagtcctgccattcaagttgatggagagtccaggagtccagccaaaaagcttaattctctacttcaagccatgtttagtgtaaggggaggccaggaggtaggagagagcaggagataaaactgaagaatcttcaggcccctcctaaacacagcctgttaagtattctttgtttgacaagcagacccagctcctcttctcatgttcttgctgggatgtagacagtaaacaagaggccaattactggtacctctctgcccctgtccatggctttaacctgccaagatagaggtcatccattaaaacaaggcctggaggaatgcatagagctcaaggtcagttgtcaggagatacgtacttccaggttgtgttctggacacagagacgtcgaaggtctctgggttgggctactggtccgtgcatttcagtggaagcaaatagacaggacacagagtaagcctttaaaaatattgttggcttggtgtggtgggtcatacctgtagtcccagcattttgggaggccgaggcaggcagatcacttgaggtcaggagtttgagaccagcctggccaacatggtgaaacactgtctctactaaaaatacaaaaaaaaaaaaaattacctggacgtggtggcatgcacctgtaatcctagctactcgggagaaggaggcaggagaattgcttgaacctggaggcagaggttgcagtgagctgagatcatgccactgcactccagcccaggctacagagcgagactccatctcaaaaacaaacaaacaaacaaaaaaagaatattgctaaaagaatccccaatgtggccaacaccagcctgccactgcccaggccctaaagcctccttaggtccctgaatttgcatctaacaggaagcgggatgctaaaatggtacagcatcccaggggaagcatctccaaggcttatatcagctgtatccacagaagacagggagatgatggctgggctcagtggctcatgcctgtaatccagcactttgggaggccaaggtgggtggatctcttgaagtcaggagttcgagaccagcctggtcaacatggcaaaaccccatctctactaaaaatacaaaaattagctgggcctggtggtgcgcacctgtaatcccagctactccggaggctgagacaggagaatcaccaggaggcagaggttgcagtgagccgagatcacaccactgcattccagcctgggagacagagcgagactgggtcttaaaaaataaaaaacaaaaaaaaagaagaagaagacaaggagatggacaggcaggctgaggtacaggc

SEQ ID NO: 6 - DNA, 26381 bp, Homo sapiens
tgtgtttgtggtcaaggtaaacatgtggcttcttcatgatgtcattacttacatgtttaggaaacatccactgggtactgactaggtatcaagcttcaggaagggagctgaggggaatgcggagatgaggcctccttgtatcctgaccttcaggagctgaaagtttggggtaaatgaaatatgcaaactaccaaaagaaagtgaccacggccacatatgagagcagaaaaagtgtggagggagtgtaaaggcaggaaggatcaccctggcttgggatgtggggctgaagaatcaggagaaattcagggaggaggcaaaaaattaatgaaaacattttaaatatctttgtgtctttccctttattcttctaatgtcttattcctacccattcagcaattattgtggtttgtctgccattcttctagccagagagccttcctgtctgccttcttatccttcctttccttcccatccatccatccatccatccatccatccttccttccttccttcccaaccaccctttcttctcaatcatcctttctaaccaatatttttttcttcctatgcctcctttcttattattcatttatacttctcaccttttatctagccagtgagccttctaacctactcatccattcttcccatacatccattcttcttttctctttcacctttctacacatccttccttcttgtctctccttccttccttccttgcttctccttcgctccagcccttccttccctgcctggatgtcctgcttttcttctatactatctacccacccatctcatccacccatctgccttttcttctgccttctgtgatggttaaattttttctttctttaagacagggtgttgctctgtcaccgaggctggaattcaatggaacaatcatggctcactgcagccttgacctcctgggctcaagtcatcctcctaccttggcctcccagatagctgggaccacaggtgcccaccaccgtacccagcgaatttaatttttttttttttttgtagagacgaggtctccctatgttgcctaggctggtcttgaactcctaggctcaagtgatctgcctacctcatcctcaaaggatcttcccaccttggcctcccaaagtgatgggattacaggtgtgagccacagtgcctggcctgtgatggttaagtttatgtgtcaatttagctgcactaagggatacccaggtagacagtaaaacattatttctgggcccatctgtgaggatttttccagaagagattaacattttaatcggcagatttggtgatgatctgtcctcaccagtgtgggcaggcatcatccaatccactgacggcccaaagagaacaaaaaatggaggaggaatggcacattcacattctctcttcctgagctggcacatcaacttctcctgtccttggacgttggagcttcctgttctccggcatttggactctgggacttatatcagtggcccctctgattgttgggcctgtggcctccgactgggggttacaccactgctcccctggccttgggccttcagactcagacagaatcacaccacaagctttcctggttgtccagcccatgactgcatgctgggggacatttttgtgtctgtgattgcatgagccaattcccataataaatctcctcttattataaattttttttttttgagacaaagtcttgctctgtcacccaggctggagtgcagtgtcgtgatctcagctcactgcaacctctgcttcccaagttcaagcaattctcctgcctcagcctcctgagtagctgggactacaggtgtgtgccaccacacacgggtaacttttgtatttttagtagagacagggtttcaccatgttggccaggctggtcttgaactcctgatctcaaatgatccatccgcctcggcctcccaaagtgctcagattacaggtgtgagccaccatggctggcctctttttatttatttatttatttattttgagacggagtcttgctctgtcacccaggctgaagtgcagtggcacgatctcagctcactgcaagctctgcctcctgggttcacgccatcctcctgccttagcctccccagcagctgggactacaggcgcacatcatcacgcccaactaatttttttttgtatttttagtagagtcggggtttcactgtgttagccaggatggtcttgatctcctgacctcgtgatccgcccgcctcggcctcctaaagtgctgggattacaagcttgagccaccgcgcccggctggcctcctcttagtgtatctgtatatatcctattggttcagtttctctggagaaccttgactaacatacttcctatcctccatctctctatccacacatatttccttcctaataggcatctatccttccatccaacctccttccttcccatttttccattgcttcctcctccatcccctccatcctccctttcttcttacccatctgtccttcccttcttttatccatccaccgagccagcttctttccacacgaatcatctcttcttccttctctaccatctcttcctgctgccctgcaatcagtctgtccctcttctctcttaaagccttattttgtccttgaacactgtgagaagcccgggcagcaagttacagctctcagctctctgaggacactgtctgggcatttatcctccctttgttacccggccctgcccgaggtcagaaagatccagttcacatctatgtccaccggttactagcggtatcaagtccactggttactagcggtatcaagtttcttagcttctgtgagtctcaggttgatggaaatgaacctcacaagtttgctgtgaagattaaaaatagactgaaaaaaaaaaagtgccctcctcacccaatgtcaatacatgatttctgccagtaagcatgggacatttttttttctatcatctttacccccccaccccccacaaatttctacagtgtatagaaaatacttttgcaaacagaatttgtttttttttctttgtttattaatttttttcttttgagacgctctgtcgcccaggctggagtgcaggggcgtgatcttggctcactgcaacctccgcctcctgggttcaagcgattctcctgcctcagcctcccgagtagctgggattacaggtgcctgccaccaagcctggctaatttttgtatttttagtaaagacggggttttgccatgttggccagggtggtctcaaactcctgacctcaggtgatccacctgccttggcctcccaaagtgctgggattacaggcgtgagccaccacgcctggcccagaattggttttaaacattgtttttaaggagagaagctgaacataaaaaataggaataagcatataaagtgccttgtgtagtccatgaccaaaatggtgctcaactgaaaataatgaacattgttagcagagggtgcacgtgagattgctggtgctggctggagctcccctaactccctgacaggctgccagacatggtccctcgctgttgctggtcccacaccccatctcaaagggcctggcccagggagctgccctctgctttggggaagtgggagacagatggtcaggagaacagaaccactgagcactgagcacagctccccgatgggatggacagccttccactcagtcccttacccacagacctaccttcaaaaaggtaatccaggtattcggactccacccagggggacttggagctgggagaaaccgtccgcacgcgtcccttgaacttgttgtacaggtcctgtttcttcaggcacatcatagaacatagcagctccttggttcccgcacactcttccacttcgcgccaccgtctacgggtgggagagctgggggaggagagaggagagcttgggccatggactcagcctctccgggtcagggaacttagagaacagttgatcatgcttccctctgtttggctggactgactttaggtccatccgtccagacaggcagccactggctgagacaggataagaacagcctggtcaggagctcaggttctggagccagatggatgggagtgggaatcccagccctgtccctccctagctttgggaccatgggcaggtccttgcccctaaacctcagtttcctcatctgtaatgcctccctcacaggactgttgcggtggctgctattcctagtactagcgaccattactatatgtttgttcattcaggcgtttatgggccacctgctgcatgccaaggaccatgataggtactctgtggatgtcagaggggaacatgcaggtccatgactccaacctggatacttcagagagctgcctggcccttctatctcttctgccacgtgaggacacagtgtttgcccttccgctatgcgaagacgcagcgagaaggcaccatcttggaagcagagagccgcccttaccagaacggagtcaggtgccaccttgaccctgaacttcccagcctctagaactgtgagaaggaaattgctattatttattaattgctattatttattaatagcaattattagaattacaccattctaaggtattttgttaaagcagtacaaatggactaagccagagacccagggagcctaacattttattttaatttttattttttgagatggagtcttgttctgttgcccaggctggggtgcagtggcatgatcttggctcactgcaacctccgcctcctgggttcaagtgattctcctgcctcagcctcccgagtagatgggattacaggccagcgtaaccacacctggctaattttgtatttttagtagagacagggtttcaccatgtcggccaggctggtctccaactcctgacctcaggtgacccacccgcttggcctcccaaagtgttgggattacaggcaggagccaccgtgcctggcctaacatgtttttacaagatcactctggtcaaccagcaaggaggccatggtagggatgtgagacaggatgatggtggagacagtgagaaagggctggattcaatatctattttggaggtaataatagaactaatagaacttgctaacggattggatgtagaatgtggggaaaaggagaatcaaggattgctcctgggtttggggagtgaccaaggatgaatggagaaggctgagatgggggctgacacaaagatcagattttgagaaagaaccaattcctctgttttgtttcttcatggaaaatgttatactatgcaaatattcacaccaaaggaaccagtgtagttatattaacaggagacaaaatacagacttccaagtccaaagcaatactaaagatgaaaagaacattagataatgataaatgattccattcaccaggaagacagaaaaattctaacttatgtgtgcctactaaacaacttcaccctctataaagcaaacagacaaactacaggtagaaagtgaacagccacacttacaacaagaaattttaatacatctcacccagcaattgatgaatagacaaagaaaaataaatacataaataaataaagaacaacacagttatcaagttggtctaatgaacatatacagaactaactaaacaaattggttgaaccacatgtgaactattaacaaaatattaacacaaagcaattcttaagaaattttaaagaataggtatctcataaagtatttcttctgattgcaaaacattcagttaaaagttaataacaaaaagagaactaaaggaagtttgaaaatttaaaaaaatatatattttttgagacagcgtcttgctctgttgcacaggctggagtgcagtggcacaaacatagctcactgcagcctctactcctgggctcaggtgatcctcctgcctcagtctctgagtcactgggaccacaggtacctgccactacacccagctaattttcttttctttttttttttgagacagagtctcgctctgtcatccaggctggagtgcagtggtgcaatctcggctcactgcaaactcctcctcctgggttcaaagaattctcctgcctcagcctcccaagtagctgggattacaggcacctatcaccacacctggctaatttttatattttagtagagatggggttttaccatgttgcccaggctggtctcaaactcctgacctcaggtgatccatctgccttggcctcccaaagtgctggtattacaggtgctgggatgagccaccactcctggcccagctaattttaaaaaaatattctgtagagagggggtctcactttgttgcctaggccggtctcaaacttctggcctcaagcaatcctcccacctcagcctccctaagtgctgtgattacagatgtgagtcaccacacctggccttaaaaatattttttaaaacaacccatagatgaaagaattataatggaaattaataaatagctgaaagtgaatgatcaccaaataacacaaatgaaaacgtataagacagctaagtaatacttagaggaaaacatatagctttaaatacttataatagaaaataagaaagaatagaaattaataagctaagcaataaatgataagaagccagaagaaacatgtcacaaaaacatatccatgaacagatcaaaactggaacctgatacttcaaaatgggcaaaagacagtaaaaagtgatgcaggacaagaaaaaaccacataaaacctaattagaaaaactcagacacagaaaagaattatatatatttttaaaaagcaaaattcatttcagaagtgaagaataaatcagaaggaatacaagaacaaattaacacaatagatgatgccttaaaagaaacagaaggcaagaagaaggaaagttaaaaaaatatgtaaaagctaaaattatagaacttccagaagaaagcatagaagaaaaatcttcatgaccctgggtcaggcgaatattgcttaggacaccaaaagcgttaactgttgaaggaaaaaaatctgatatattagtctgtgagggctgccatggtaagacaccacaggcagggtggcttcagcaacagaaatctggaggctggaagtccaagatcaaggcatcagcaggtttggtttctactgaggcctctctccttggcttgcagatggccgtcatcttgctgtgtcctcacaaggccgttcttctgtgtgcatgcgctcttggtgtcttcctcttcttataaagacaccagtcctattagattagggcccacccttatgatctcattttactttaattacctccttaaaggctcatctccaaatagtcacttagaggttagggcttcaacatatgaatttgtggggtagagtataattcagtctataacacctgatatactggattttatcaaattaaaatatttttctcttccaaaaaaaaaaaaaaaacccaccaaaaaagcctaacgaaaatgaaaaggccagccactggggaaaaaaatcacaatacatacactgataaaggatttgtattcatagataactcaataataagaaaataaatgacctaataaaaagtggaaaaatatttgaatagtcacttcacaaaagatatatgaatggccaataagcacatgaaaagatgttcaacatcattcatcattagggagttgtaaattaaagccataataaaatactactacatactcactagaatggttaaaatgaaaaagactgataatactaagtgtaacaagcacatggagtaactagaactctcatgtattgttggtggcaatgaacaatggtacagtcactttggaaacagctcgacagttccctgtaatagtacacattcattacctaatctcctaaatcttaaccctagatccatttttcttctccctccctccctccctccttccctccctctctttcttctttccttcctcccctctctctcttttttttagagacagagtctcactctgtcacccaggctggggtgcagtggtgcaatcatagttcactgcagtctaaaacccctgggctcaagggatcctcccacctcagcctcctgagatggcagggctacaggtgtacgccaccatgcctggctaattttgaaaattttttgtaaagatggggtctcactatgttgcccaggctgatactcctagatctttatctaagagaaatgaaaacatatccacacaaagacttgtacatgaatgttcacagcagcttaattcataatagccctattatggacgaattgagttcccccaaaattcatatgttgaagacctcatccccagtggtattgtgttttgagataagagctttaaagaggtaattatggttaaatgaagtaataaggctggggccctaatccagtaggactggtgtacttgtaagaagaggaagagataccagagtgaacacacacagagaaaaagccacgtgaggacacagcaagaaggcagccatctgctagccaaggagagaggcttcaggagaaactaaacctagcaacgccttgaccttggacttccaacctccagaattttgagaaaataaaattctgttgtttacccagactgtcgtactttgttatggcagccctagcaaaccagtgcagatttgggcaccagaaatgaggtgctgaggtaatcaatacctaaaaatgtggaagtggctttggaattgcataatgggtagaatcttgaagtttgaagtgcatgttagagaaagcctatattgccttaaaaagactattggtaggaatatagacattaaaggtgattctggtgaggtctcaggtggaaaagaggaatgtgttattggaaactggaggaaaggtgatccttgttataaagtggcaaagaactggttgaattgtcttctagtgttttgcagaaattagaagttaaaagttcattggctagccatctcaaaaatgataatataaaataaataacaaaaagataatttaaaagacataaacttggatgcttagcagaagagatttctaagcaaagtgctgaaggtacaacctggtttcttcttactgcttatagtaaaatgtgagagaagagatatatgaaaagaattggtaagccaaaaggaactagaacttgaagctttggaaaattttcagcctatccacattgcaaaaaaaaaaatgagaaagcatgttctggggaggacactaaggttgtggctagaacaaccttttgataaagagatcagaggtgcaactcatagacttaatcagccatttaagcagaaattagacatactgatgggattataccagcagaggcacttccagctttgactaaaggggacagagatgggacagaatgaaggaaggctgttggacttctgggattctaaagaaagggacaagagctggagctatttggctgtgaacacgcaatatccttcaagtatagggaaaaatttcctggaagatgattcagagatcagcagggttgtcactgccaccaaagacctggaggcaacactgtcccctccttagtttcagcaggctaggctgctgctaaccagtgactcgagggtagggtcaccacccagggcaaaggggatagggctgccgccccagtgggcccaaagggcagagcactgagccaaagagggctattcttgaaacttaaaatctaatggaatttgccctgcgaggttttagacttgcttgggacctgtcactctttccttctttcctatttttctcttttggaatgggaaagtctatcccatgcatgtcccatcactttattttcaaagcacataacctgtctggtttcacaggttcataagtggagaggaatttggcctcaggatgagtaacacctccagtcacacccatacctgatttagatgagactttggacttagagtagatgctgaaatgggttaagagttttggggctagccaggtgcagtagctcatgcctgtaatcccagccctttgggaggccaaggcaggcggatcacctgaggtcaggagttcaagaccagcctggctaacacggtgaaaccccatttctactaaaaatataaaaaattagccaggcgtggtggcgcatgcctgtaatcccagctactcaggaggctgaggcaggagaatctcttgaacccgggaggcagaggttgcagtgagccgagatcacaccattgcactccagcttgggcaacaagagcaaaactctgtttcaaaaaaaaaaaaaaaagagagttttggggctgttgggagggggtgaatgtattttgcatatgaaaaggacacaaattttgggaggccagagggcaagcatatggcagccctagcaaatgaatacctgcccagaactggaagcaacccaaatatccactgacgggaaaatggattaacaaatgtcatacatagtcatacaatggcattactactcagcaataaaaaggaattaactactgatacatgtaacaatgtgggtgaatttcagaaacattatgctgagggaaaggagccagacacgaaagggtacatactatacacatccatttatatgaaattctggaacaggcaaagtttaatccacagtgtcagaaagcagatctgtggttgcctagatctggaggcctgaatgcaaagtggatgagggaactttctggggtgatagagaacgtcttacatcttgattgtggtggtgggtacgtgggtgcccacttttgtcaaaactcatcaaattgtatactttaaaatgggaacagtttattctatatacattttaactcaataatgttggttttaaaagaaaattggaattaattcagcacggcaagctatgataagaaatgtgcgctcttagctacaaacatgtcagctaaaagcagactagagtttcaggaaaaataaatgtaaccaagagaaagattacaaataagatgttgaataatctcacacatggaagcatacagttttttaaaaactcaagagtgaaacctatttcatttagagagcagaatagtagatagatagacagataaaaggcatttgaaagaaaaagacaagtattctctcctttttctttaatttgagacagggcctcaccatgttgcccaggctggtctcaaactcttgggctcaagcgatcctcctacctatgcctcacaaagtcttggaattataggtgtgagtctctgtgcccaaaagacaaatactgaacacagaaaaagaagatccaacatacaagtgatatgagtccctaaagaagaaaatcaaaacaagagaatagaacaaatactaaaactataatttaagaaaaccttcctaaaataaaaatgccttggaaccatgtattaagtgagaatattgagtgcctaaaaatatcaactcagaatgaatgagcaataccaacacacagtcaaataaaattactagattttaaagaaaaagcaacaaccctttattagtcagggttctccagaggaacagaactaataggttatacgtatatatgaaagggagtttattaaggagaattggctcacacgatcacaaggcgaagtcccacgataggccgtcagcaaggtgggaaagaaagaagccatagtgactcagtccgaatctgaaaccctcaaaaccagggaagctgaaagtgcagccttcagtctgtgaccaaagatccgagagcccccagcaaaccactaacttaagtccaagagtctaaaggccaaaaaacccggagtgtgatgttcaagggcaggaggagcagaaggaagcatcccgcacgggagaaagaaggaagctggaagacccagcaagtgaagctatcccaccatctgccacctgctttccagccagcctggcagccagttgggttgtgcccacccacactgagtgaggacgagtcttccattcccagtccactgactcaaatgtcagtctcctctggcaacaccctcacagacacccccagaaacaaaactttaacagccatctaggcatccttcaacccaattaagttgacacctaatattgaccatcacaaaccctttgggcgaaaagagcaagaaactattaagaggcaagtatgtatgttttgggataaagaaaatgagtaattatgggtcattctagttctatcatgtcccctgtccttgagaaacaggattctcagtgtgaaagaaagaaaatatagatgtaccatagaagtcaggtaaaaatcctaaggaactaaatttagatgggaagcacccgtataactcattaggcattttatcttaaaaattatgtacatgtaggctgggtgcgatggctcatgcctgtaatcccagcattttgggaggccgaggggggcagatcacttgaggtcaggagttcgacaccagcctggccaacatggtgaaaccccgtctctactaaaaatacaaaaattagccgggtatggtggtgggcgcctgtaatcccaactacttagtaggctgaggcaggataatctcttgaacccaggaggtggaggttgcagtgagccgagatcatgccactgcactctggcctgggtgacagagtgaagctctgtctaaaaaaaaaaagtatgtacatgtgtgtgtctatgtggtatacacacatcactctgttcactgaaaacaccaaaagcaatagctaagtagtgatcagcatagctagcatgcagattatagtctttataaccatttcttactaaatggagaaatggctgactgcaggttttaggtcaggaattgtaccagagggacctggaacatcttgtcgtaatggacagctggaaaggtatctgttaaatctggaaagatttaacttgaccactagggtcaagttaaaaggactcaggagcaaacttgatgagactcccactggacagagatgaggcaattcaagcttcaatgagcagagtacgtcgcaatagactgaaaccaccaaatgtgtttaaatgcctgagttcataatgataataataaactagcaatcacctttgggagatgataaggaaccaattcattatcttgaaaattgataaaggaaaaaaattaagcatttatcctctcttgcctatttgaatagtatgactggatatcaaataccagatgagaggatacatctctttataaaataattccaactaacaaatgaaaaaaattatataattagaatatcaccattctaatgtataaaagacatgaaaaatatcatagaagttcagaggatagactttctttctttttaggatcttgctctgttgttcaggttggagtgcagtggtgtgatctcagctcactgcaacctccatctcctgggctcaagtgatcctccccacctcagcctcccaagtagctgggaacacaggcacatgctactacacttcactaattttttgtattttttttttttgtagagacagggtttcaccatgttacccaggctggtctcgaactcttggactcaagcaatctccccacccacctcggcctcccaaagtgctgggattacagatgtaagccaccatgcttggtcctagaggatagactttcaactccttaataaatttattccagccatactacgcccagctgtgtgactttgagcaacatgcacccttggtgcttcagtctcctcctctgtaaagaggcgtactgaacttgtcctcagagagctgctgtgagattaagttcattacatgtgttgacacagtgccagccacacagtaaatattaggtgttttctggcacctgataacgctcttgcttttgaaagctctcttgcagtctgtccctgctcaagccaggctcccatcactcacatgtggattccacacatggaaggatgacgtgatgcaacaggaagggcacaaatgttggagtcggacccgagttccccttctggctccatgacgtccttcctcagacaagacacagcaccctctgagctcaatcccctcacctctagaatggggaaaacacagagcctgcctggtcacattgggagaaggaagtgaaatattcacgtagggcccttagcacttggcctggcacaggacgggtcctgaggacacggtggtcccctcctcttcctgctttcccctcctcaccaactccaggtgaatcctcccgagcttctgcttctatcatctcactgtcctgctaaagaactctgaacgattcccatctatgttcgaagatggtggatctgcttccattgtcagatttctctggattcgctgtggctgcctgggcttccaaattgagaatgatcccatcgggaaaagtgtgaccatttggccaagcgcggtggcttacgcctgtaatcccaacactttgggaggctgaggtgggtggatcacctgagctcaggagttcgagaccagcgtgggcaacatggagaaacctcgtctgtattaaaaatacaaaaattagccagatgtggtggcatatgcctgtaatcccagctactctggaggctgaggcaggagaatcacttgaacccaggaggtggaggttgcagtgagccgagatcaagccactgcactccagcttgggtgacagaccaagactctgtctcaaaaaaaaaaaaaaaagagaaaaaaagtgtgatcattgagggatgcctaattgcccaggtaacagctcctctgctgtgtacctagttgcctcactgatcagctgggacagctccaagcacctcatccagccacttgagaatttcatcctctggcccccacagctacatccatgccccacaccaactttcctcaaagacttacccccgccccggcagactggtcacctgtacactgctcttcattcaacatcttccccacctccagacctttatcaaaagcccctctccaaatgccggccacatgccatctcccgtagggcccagagagctagccagtgctgcccacactgggtgcagctgtcccagagaagcccctccagcccccacccaccccctcagtcttcccatccaccagccgagagagtcccctctacctctgataggccacaaaataggtcacatcctgggggttgccaagccctgggagccatgtcaggtacacgctgaagttctgggagagcagcgtcacattctggggaggggccagacggggcctccctgggggaaagaaaggggtcatgaagcctggagctcctggctggtcttgactcaggccatcccaagctgaggggcagcacgaagggcaagcaggtgctcactgagtttgaggaaccaggagccactgactggctgtactgcagcccttgtgccatgagagaagaccctttgccaggaggggaggctcctgcacactctgggaccggagggttccagcagaacaccatggaacaggaacctaatggcctccaggagggagcatccttgaggatatcaaggaccaggggctctgtcctgttctcagccacatccccagagcctgcctgccatggcctcagcacatagtaggtgcacaataaacatctgttgagtaaatgaatgaatattacaataacatgggttacaccaaaggcttcctgaccggtctccttgcttccaaccttgtgtaagggagatgacacagcaaaggttgctgcctaggcattagaagtagatgccacactcagatggtccaagccagtggccagagataagaacttcgaggcatctctccctcccggcaaactgggctccccacttcccacccattcctttaaagggatcattcaagcatttgccctcaaacttaacctgacccacaccctagtcccttacataatatacttctcattgccacaagctctcactttctttttgcctgactcttcattcccgcttcatgtagcccaggatggaggatgaccctccctactcattgcaccttccctgctcaggatctgtaagtaataagcctttgaacttgttttgcattgaggtggtgtactgaatttgcaccttccatctcaggaacccaggcccagcccaggcctggttttccctgggttgctgggaacacagtctggctcccagcgccagagcaatggtcagacaggcataaacttggacatggatcagacaagagtcacagggacgtctgccagtataaacaagtgtgaaggacccccagccatgggttagacagctaggctattaggctgtccgccaggtaagaagtatttcatgggccgggcgcagtggctcaagcctgtaatcccagcactttgggaggtcaaggtgggcagatcacctgaggtcaggaattcaagaccagtcttggccaacttggtgaaacctcgtctctactaaaaatgcaaaaattagcagaacatgatggcacagggctgtaatctcagctacctgggaggctgaggcacgagaattgcttgaacccaggaggacgaggttgcagtgagctgagattgtgccactgcattccagcctgggcaacagggcgagactccattccaaaaaaaaaaaaaaaaaagtgttccatgaagggcacactgtaagtacccacgcccagttcgctggcattattcattagggcaggcttgccagccactctgctactggaaccctaatttagctggaggcgatcaaaagcccttgtcccaaggtggatgatcactaaatccacatttggaggcatgttactatggaagtttaggtgacacctatattcattatttatttcacaatttcatttttgtattcacatttcagatttgtgaatgcagtttttttcctgaaaattcattttaacttgaaagtatgtttttaattcccctgatgtaattaatggactatgtgcatatttatacctaggtgtgcttacatgttaataatgtatttgcatagttgtgagaatttcatattggactccatagtggtaaaaaaataaatacaggccgggcgtggtggctcatgcctgtaatcccagtactttgggaggctgatgtgggcagatcccgaggtcaggagttcgagaccagcctgaccaacatggtgaaaccctgtctctactaaaaacacaaaaattagccaggcgtggtggtgcacgcctgtaatcccagctactcaggaggctgaggcaggagaatcgcttgaatccgggaggtggaggttgcagtgagcagagatcacaccactgtactccagcctggtgacacagtgagactccatctcaaataaataaataaataaataaataaataagtaaacacaacatctgtcatatacatttcttttctgttggtttaagaaaatatctgacagctttacctacttctgcaggttcatccaagcccagatattactgaacgaatatattgatgtagagtatgtgttattttgttttcagttctgctctagatcataactatgtaaaaaacactgtcataatcagttatactaaaattcatgagcccaaatgtaagatgaaaagtctgcactgtagtctaaggtcattgctctatcaataattacattctcattttgatttacagaagagctttatggtagaaacaccagaaaacacctcatactattaaaaggctttttccccattaaaaaaaaaaatacaggtcgggcatggcagctgacacctgtaatcccagcactttgggacatcgaggcaggagaatcatttgagaccaggaatttaagacttgcctaggcaacatagtgagaccacatctctacaaaataaattttttaaaaaattagcagggcacaatggtgagagtaaggaggctgaggtgggagtttcgcctgagcccaggagttcaaggctgccgtgattgtgccactgcacttcagtctggccaacagagcaagaccctgtctctacgaaacagacaaatatacaaaacaccttgccttcagtccattctccacatagcaggaaggattaaaaatgaaaatcagatcatgttcatcttctgcttaagccctctaaaggcttccatctcactccaggtaaactcaaaagtctttattatttttattttattttgaggcagagtcttatgctgccacccaggctggagtacagtggcacaatctcagctcactgcaacctccacctcccgggttcaagcgattctcctgcctcagcctccagagtagctgggattacaggcatgtgccaccacacctggctaatttttgtatttttagttgagacgaggtttcaccatgttggctaggctggtctcgaactcctgacctcaggtgatccgcccaccttggcctctcaaagtgctgggattacaggcctgagccactgtgcctggtctaaactccagagtctttacaatcaccaccaaggccctacccaatctgacccaccactcctcccttgctcccatatctccatccacacaggactttttgcccttcctggagcaccccagccacactcccaactccaggcctttgcacacgctgttccctcatgctgttccctctgccttaacagttctgcccctggatatccacctggctcactcctttgctgttttcacattcctttgatgtcactgtctcgaggacactttccctgactccctttaactgacctctattcccctctgtggcacattttccttctcactgttaatcttcatcttctgaaatacgcatctgattacaccactccccagtttcatgccctttccttggcctcagaataaagtccacatttgttattgaggtttgtgaggccctgcctgacgtggcctggcctggcctggccaggccgtcttgctgctctctccccaacagctaccctacaggctcatcaggcaatcttcctgctcgatgttgccaagccactgcattcttctggatgtttttaaacccaggtgtctttgactgcctggtattcaccatctagtctttgaaatacttgattcaaatgtcacttcctccagggaatcttccttgacatatctacgaggtgatgatgatgatgataacgatgatgataataatagcagctaaggccgggcatggtaactcacccctgtgatcccagcattttgggaggcagaggtaggcaaatcacctgaggtcaggagtttgagaccagcctggccaacatggtgaaaccacgtctcttctaaaaatacaaaaattagttgggcatggtggcacacgcctgtcatctcagctacttgggaggctgagacacgagaattgcttgaacccgataggtggaggttgcagtgagccgagattgcgccactgcactccagcctgggtgacagagtgagactctgtctcaaaataaataaataaaataataataataataatagcagctaatgtgtattgtgttctgtgagccaggttctgtgctaaacagtttacctgcactttctcttttaatcctcattacatccctaggaggtaggtattcattataataattataatcgttacagatgggaaaaccaaggccctctcagctattaagttgtagaatcagattcagtccaggcctagccaactccaaagtccgagctcttgactgtactttgtcttctaggttctcatggggtctattgagctttatgattccaactattccatctattgaccactacgagtcaaacaagatctgttgaccacggtgtgccaggggtttcaaagaagaacacaacttcattcctgccctataggagctcatggtcccatggagaattcagggtcctgaagtgtcccatgtgccatgatggaaatccatacgggttgcaaaatggcatcagggagggagggtccagttctgtggatggctgtccccagcctcggctgcctacccatcaccttctagacccaaaagtgggtgcctgcttccacctcatcctgtgtcctctagctgggactgtatcaccacgaggctagtgctattactactcccagcttctggacttcctaacgggtgaccagcaggagaccaggctgtctgcaagccacttgtaaggtatcctatgggcaggacagtccccagattcgagctaggtcacatgagaaaaacagcagttagagcaactttcctctatgaagccttcaaaggatgccaggcactagtttggctctttacatgtaaaacctcaatcacccttgggacagaccaccctatggggtaggtgtcattcattctgcttccatggaaagggcgctaggctcagagacagatgctaactaacttgcctgaggctacacagtcagtttgtgtgggagccagtatttgaacttagatctggctgtacttactcctaaatcatcacaccatagttagtgttgtgtatattaaatacttatcaggtgaaagtacaagaaggtctgggtttgacagtgaaaggggaacagaagaccccaccctccctccacacacaggtacacggtccctcatcagccacagagaacgctgctgtgggcactgggggctggagcatccctggctggcctagtgacccagtggatggacagcctgtcccacgtgcctaccctggaggcaaaagctagccaggcttgctttagcccctcttctctcttctgtgtgcctcacctctgccatccttcttgaggaattccctgaattgctctgagcctcagttttcccatcggaaaagtaaaaataatatctacctccgaggatggctgggtcgtgaggcttccagaataatgcggtgcctggcacaaagaagttgctgaataaatataggcttttatgatgattggattatgcccagggacctttacagctctttaaactgtgagtccaagactaggaaaatatcctgggggcgatttctggaccttctcttccctgcttcggttggagtcgtgggcggtgaggtttggtggttgggtcctacggcgaggaattttgtacctgacaccttactcatcagtagaggtgggaaaacaacaacaacaacaacaacaacaaaacaacaacaaaacaacaaccaccaccaaaagaaagccgtcttgttagaaagcagggcacaggcgaccagagctccgtcccaccagaggcctggcaggaacgggaagggacatcaatcggtcccactttccctgctgtccacactttagggtcaagtgtggttttcacgcagggatcagtgctttctttaggaaacattaaaaagcactttattaaaaaatatgcagtatcaaactgccgctgtcttttttctccagttctcctgaagctggaagcattaggaaactggattcgtttcctgcgggagaggaatatcaaagacccggttctgttcagtcctgggaagaagcaaactgggggcgcgtaggcagggccgattcgcacccggctcgggtggctgcggaccccgtgcctgtcccaggagctccgggtccgagggtaggcgcggcccggcccggggagccctcttccccctccctcccgcggccccgcgcccttacctggagcggcctgcagcaggcacaggagcagggggccccagcgctcgggccccgccatggccttcctgccgcggcgtccccgcccgggcccaggtccccgcctcccgcctcccgcctcccgtctcctagcccaccgcgggcaggtgacgcagtcggcagccaatggcccgcagagccgcgggcccgtccctgccgcctaggattcactgagaaggtccctggggacagccccgccgcggggggaggggggggggggagcgcgccggtccccgcgctcgaaactcgcccgtacctctgcttcatctgcacttagttttgttttactcaattcccggaaaaaaaaatcagtaaatccgtgcacgggggaagggcaggggaggggaagaaaccggctgatgatcaataacccacggccagtccagtgctccaggacgggccattttggcaggattagggagagttcaaggccggtttggctacgcggcctcaatgccattggcgggatccgagcgcgtttctgagccggatgctgagctccgcgccttacacacgcgattccctttaatgcccccggggatcccggcggatccgtgctgcccttctccacgtacttctctcccggggagcggcaggccccagagcttcaggtgcttgttctggggaaagctgtctttctgaccccgaaggctgtggtgttcacctggacagcagtagcttcccagtaaggcacacgccacgacgcgcaatattatgcggccctttaggaggacgttgccgaatggtgtgtatcgacaccgaggtgtttgcaacacactgagaaacagaaaagcgagtgctaaaacataggcccattaaaaaagtgtgtgtgtagccgggcgcggtggctcacgcctgtaatcccagcactttgggagggtgaggcgggtggatcgcctgaggtcaggagttggagacaagcctggccaacatggtgaaaccccgtctctactaaaaatacagaaaatcagccgggcgtggtggcattcacctgtaatcccagctatcagggaggctgaggcaggagaatcgcttgaacccaggaggcggaggttgcagtgagccgagatcgcgccactgcactccagcctgggcgacagagtgaaactcagtttcaaaaaaaaaaaaaaaagtgtgtgtgtgtgtgtgtgtgtgtgtgtgtgagtctgtctgtatgcatagaaagatatttggaataataattaccaaaatattaatggttgttgtctttgggtgatgaggattttctttttcaactttcttcttttctgatcatatttcgtttccaattttttgataattatttgaaactgggatcagctttggtcccatcagtttttggaagagaaaatgattttcacagagcttggtgggtccaaaagttgctctgagtttaaccgcgggggaaatttcttttggaaatttcaggatgcttctgggactagcatcaaggcttctgcttaatcaggattttttttctttttttttttttagacaaaagctctgtcgcccaggctggaatgcaatagtgtgatcttggctcactgcaaccccgcctcctgggttcaagctattttctcacttcagcctcccaagtagttgggattacaggcacctgccatcatgctcagctaatttttgtagagatggggtttcaccatgttgggcaggctggtcttgaactcctgacctcaggtgacctcagcctcccaaagtgctgggattacaggcatgagccactgtgcctggccttaattaggatctcttaacaaagccctgctcacagaggacgcaattccacctcaaaggcgcagggtggaggaggatggaagagcagcaggcacggtcagtgttggtatcttgggatctctgaaatgttgactgttgactttcttttctccttccttccttcctttctctctctttctttctttctttctttctttctttctttctttctttctttctttccttccttccttccttccttccttccttccttccttcttttttctctctctttccttctttcttgctttcttattttcttgctttctttttttttgacaagagtctcactctgtcacccaggctggagtgcagtagcgtgatcatggttcactgcaacctctacctactggttcaagcgattctcatgccgcagcctgccaagtagctgggactacaggcgtaagccaccatgcccagctaatttgtgtatttttagtaaagacggggtttcgccatgttggccaggctaatctcgaactcctggcctcaagtgatctgcccacctcggccttccaaagtgctgggattataggcatgagccatgcacccggccctgaaatgttgactttcatttccacccagcaactgcaactcttttagacccggaatcccactgtgcttggagcggttcaacagcaggtacagaaatatcttcatttgccacctgctccacccatgggctcctgtgctatgcatctgaaactggcacttgctcttttttgacaatttgtttgtcacatgtttgttctcttgttcctcttcccccacctccccgcccacgcatagcttcgagttagaaaattgtgtgttcagatgccttgatccttcaagagacattttgtgactatgagcttggccaagttggatctttcaaaaccttaaaaaaaatgtcatctatagatgccggtcagaaaatctcagccagttaccacgaccttgcttctacttaggtcctaaatacactgcttcaatttctttcaggtatctcaaatacaatccatccattctggaataaaatgaatatatctctattgatatctctttatcccaaacagctgactgcacgaatctttattgagtctttgttatatagtggcactgcagtttacatacagtatttaatcttcacaacaaccctatgaggtggatattattaatatcccctttcaacagatgaaactcggagaggttacatccttgcttaggtcacacagctaattatagtgatagggctgcaatttggaactcagtctgtctgtcctcaaagcttgtggttttaaaacttctgctacccagcctcttgcttgcttaagggcaaacaagaacaaacctccccagtcttaatcacttcctgatttgcaaagatcatggcgctaacctctcaactctcatgagtggaacggtgggcactgaagagccagcttcctctttgggttggaatattaggtatgaagcagtggtgctgataaatgtttcacaactggttgggggtttaggggacaggggtaaaagtcctgctttcttgtgtttcccaaccttcgtggtgtgaatatccccactgtggctgactttaagctagcaaatgtgaggtcactgaacacagagataagaagaaatgtggccgggcacagtggctcatgcctgtaatcccagcactttgggaggctgaggggggcggatcacgaggtcaggagatcaagaccatcctagctaacatggtgaaaccccatctttactaaaaatacaaaaaaattagccgggtgcggtggcgggtgcctgtagtcccagctactcgggaggctgaggcaggagaatggcgtgaacccaggaggaggagcttgcagtgagccaagatcacgctactgcactccagcctgggcggcagagaaagactccatctcaaaacaaaaacaaaaacaaaaaaaaaacaaaacagaagaaatgtgcacaattggctcctgagcctgtaggagccagctccagcacaccactgggtggacgaagccaatttccctcactgttggaggacccaacatctgtggcaccacagctgagcttttctatgtttagaacaaaccacatcccaacccctaagggcctatggggctcatgttaaaagtctctggtccatgacttgaggctcaaaatctcttatgcagctgttgaaggttttcacaatgtggcctccatccaccttttgaagttccccactagttctctgtgttccggccacagaggcttccagttcccttctttctcttgccccctggccttttcaaacactggtccctgtggtgggaatttccttcccaggcttatcttccgctagtcttccaacaggcccctattcttgattcagtctcagctcacatgccacttcctcagggaggctttcttaaccactgtctttgatttgctcccaatccccatgtatgtctctgacttagcccattttgcgctgctgtaacaaaataccacagagtgagttatttacaaagaacagaaatttatttctcacagctctggaggctgggaagttcaagttcaagatgccttcaggttatgacccagtctctctgcttccaagatggcaccctgaatgttttgtcgtctgaaggggaggacaccgtgtcctcacatgacagaagaggagagagagagagagagagagagaacccattctcacaagccctttttatggactcattaatccattgatgatggcagagccctcacgacctacacaccttccatcaggccctacttcccaacactgtcgcattggggattgagtttccagcacatgaattttgaaggccacattcaaaccatagcagtctctttgatatgaattaatcacaatatcatcatttttgtgcactgaatatcttacttcttggatacaactctaatgactcgctcagggcctggcacatagtaggtgctcaatgaactgtgagtaagcaaacctttgctgaatggggctcagtcaaacacaatttcatatgccctaaacaactcagcccctctcctggttcttatctgccacgccttagccactcactaagtgtt

SEQ ID NO: 7 - DNA, 71003 bp, Homo sapiens
ccttccataagcattaatgagtctagtagataaaaggatgattctgtagatgccagtggaatttgggattcagtgtctggcatagttatcttcacagggaactgcagaagctattacttaaattgttctgataaaatcatgttttatcttgggagaattaagaatgctattcttatgttaaaataagtgatggtagagaaagcagggaatataatcagtaaaatttgtatgggtttagtaaattttttgcatttacccaaagttctatttaagtctactttctttatataaatgcacaatttcttagaagaattttcaagaaagggagaggaaagctaatgagtgcttcaaagctaataaaaatatagttttttcaggaaaaatgatactaggcttagtattgcttaaagttcttgttcacgattgaacgaatgaataaaaactatactcattaaatatttaatatcaccatgttgggtggagtgattcaaaccttgaaaaacaggcttagaatattttatgagtatgacagtttggagtagcttgatgaaaacaggatgaagttgttattaccaccactttggatggatagtgtcatgttgacttatctgtgaggaacttggggagctttcacatacttattttcaaaactaccttgtgctgcaggaaaccaattttatcttttccataggtagggcaattagaacatgaagacattgtgactcattcaaggttgtaggccaggcgcagtggctcatgcctgtaatcccagcactttgggaggcagaggcgggtggatcacctgaggtcaggagttcaagaccagcctggccaacatggtgaaacgccatctctactaaaaatacaaaaaattagccgggcatggtggtaggcacctgtaatcccagctactcgggaggctgaagcaggagaattgcttgcacgtgggaagcagacgttgcagtgagctgagattgtgccactgcattgcagcctgagcaacaagagcaaaactccatctcaaaaaaaaagaagaaggttgtagttagtgaaagatagaaactgaacataggcttttcaactctcaggtccagacctctgttccttacagtagtgtttgcaaactggtgttctcctcaggatcacctagaaagcttatgataacagactgctggacactacccgtagagtttctgattttagtaagcctgggatgggcttgagaatttgcctttctaataggttcccagatgacactgatgctgctctccagggagcacacattaagagcctctgctctacaccagtggcataccacccttttcaagttaaggcaacatataaaatgataatttgtgtatgataccctggactaaactgcagagctcattcttagcttgaggtaaatagcccaaaacaatagaccttgtaactgaggaatcagtattagtccatgaggggtcctcaacaaaagaagaaaaatagaacagttcacagagcatttcttagagctaaatagatttaatttaaaggactctcttttattctaaaattacaaccttcctaatcctttggtgttaaaatgccatttctttcacaaaaggattatgatcataaatggtttacttaatatcaagccttatttggaaatcttagaaaatgacaacctcaaaaaaacactagaaaaaaaaccaacaatctgaggttgatcaagatttttgttattgttttggtcactgaaatccaaaagtttggaaatcattgcttcagaagtactactgtcttctcatccatataacatggagtattacgactaaggaaaaaccaccagcaatagctgaacgggtgaaagggaattattacccatcccagaaacactctgaaatttttccacagaactacagccagatgctgttgtcagggtatatataccagaatttacttccttaacatatatgccttcctcaaattaccaaatagaatttattttattaattcaaaagtaaaaatattcatttatggtctcatcaggaatgagttttgttgtagatggaatagctaacagctatttttagagaatcagcaaaaatccaatctttccaaaaatatctctttcactgctcctaaaattcacatttttagaatctttttgtgtgtgtatgcagtgtttttctagaaagccttttttaaaatttatttatggggccaggcatggtggctcatgcctgtaatcccagcacttcgggaggccgaggtgggcagatcgcttgaggcccagagtttgagaccagcctgggcaacatggtgaaaccccatctctactaaaaatacaaaaaatgatctgggtatgatggtgcatgcctataatcccagctactcaggaggctgaggcaggagagaatcacttgaacccgggaagtggcggttgcagtgagccaaaattgcaccactgtactccaacctaggcaacagagcgagactctgtctcaaaaaaaaaaaaattatttatgatgagagacattaaaacattacaaaattaggccaggcacagtggctcaatgcctataatcccagcatttggggaggccgaggtgggaagatcacttgaggccaggagttcaagaccagcctgagcaacgtagcaagaccccatctctataaaatatttaaaaattagctgggcatggtgacatgtgcctgtaattctagctacttgggagattgaggtaagaggattgggtaagcacaggagttcaaggctgcagtgagttatgattgcaccactgcactctagcctgggtaacagagcaacatcctgtctctaaaaaaaaagaaaaggctaggtacagtggctcacacctgtagtaccaacactttgggaggctgaggcaggtagattacctgagcccaggagtttgagaccagcctaggcaacatggagaaacccatctctacaaaaaataccccccccaaaaattagccgggcatggtggcacatgcctatggtcccagctacttgggaggctgaggtgggaggatcacctgagcccagggaggtcaaaattgcagtgagccgtgactgcgccactgcactccagtgacacagtgtgagaccctgtctaaaataaattaatttaatttaaaaataaaaataaatttaaaaagaaaagaggctgggtgtggtggctcacatccataatcccagcactttgggaggctgagataggtgtatcactggagcccaggacctcaagaccagcctgggcagcatagtgagaccttgtctctactaaaaattaaaaaaattagtcaggcatgggggcatgggcctgtagtcctagctacttgggaggctgtagcaagaggatcacttgaacccaggagatcgaggctgcagtgagctattgttcatgccactgcactccagtctgggcaacagagggagaccttgtctcaaaagaaaaaaaaaaaaagaattataaaattagctagccttggccgggcaaagcggacatgcctgtaatcccagcactttgggaggccgaggcgggtggatcacctgaggtcgggagttcaagaccagcctgaccaacatggagaaaccccatctctactaaaaatacaaaaaattagccgggcgtggtggcacatgcctgtaatcccagctactcaggaggctgaggtaggagaatcacttgaacccaggaggtggaggttgcagttagccgagatggcgccattgcactccagcctgggcaacgagtgaaactccatctcaaaaaagaaaaaaataattagctagccttttactttgaacatctccaattttggagatttaggacaaatacagttttatttaagggaagtttttgagagtgtttgagaatactgagtgggatgaaactaaagggtttgagtagaaggttagaggttggtgatcaaaagaactactttttttttttttttcctgtcagcagggaaaaaataactaccctttaattactttaccagttttactcctgtgtgatctgatgatccacttcttacaggtcatctggagccctccaaagggactttgctgaaacaacaccaacacctttgctgagtcattgtgggctttggtgaaactataggaatatatactgtcatgatacagggtgaaggcttctcatctaataaacatatattgagggtccactagatgccaggtactgtgcacagccctgtggatgatatgttgatggagacaaggttgccctgccatcaaggagcccatgatatagtggagagtgaacatgggaagctgaggtgcaaagggaacataagaggtgtgcataccaataaaaattagagacagtaggccgggcgcggtggctcacgactgtaatcccagcactttgggaggccgaggcgggcggatcacgaggtcaggagattgagaccatcctggctaacatgatgaaaccccgtctttactaaaaatacacaaaaaattagccgggagtggtggtgggcgcctgtagtcccagctacttgggaggctgaggcaggcgaatggtgtgaacccgggaggcagagcttgcagtgagccgagatggcaccactgcactccagcctgggcgacaagactccgtctcaaaaaaaaaaaaaaattagagacagtaggatgcagtcaaatagtcagagacttggataccagctgagtccatgccagtttgtagtatgatcttgggcaaagtcacctagcttctgtggccttgccttttccttctgaaaaatggtaaagatgctatattttttcccctgtcacctcaggtggtataaggagaatatgacttcaaggacaaaaaacactttgatttcttcaaaggactttgcaattgctataaaaattcaagatgtcagtattgacagttttataacacagagctaagatatctagataccattatcaggatatggtaacaatacccactaatacttattttatgctatctgaatgtttaaattttttaatggagtactgttatacaaaataacttttttttttttgagtcagagtcttgtgctgtccagcctggagtgcagtggcatgaccttgactcactgcagcctccgcctcccaggttcaagagattctcgtgcctcagcctctcctgagtagctgggattataggtgcccaccaccacacctagctaatttttgtaattttttttttttttttttagtagagacggggtttcaccatgttggccaggctggtctcgaactcctgacctcaagtaatctgcccacctcggcctcccaaagtattgggattacaggtgtgagccaccgtgccagccacaagataactttttatcagattttttttgtctctattcatattaactacaccaagatcaagttacaaaaagttgtcagccgggtgccatggctcacgcctgtaatcccaacactttgagaggccaaggcaggtggatcatttgaggtcaggagttcgagaccagcctggccaacatggtgaaagcccgcctctactaaaaatacaaaaattagccgggccgtagtggcgtgcgcctgtaatctcagctacttggtagactgaggcaggagtatcgcttgagcccgggaggcagaggttgcggtaagccaagatcgcgccactgcactccagtctgggcgagagagtgagaccctgtctcaaaaaaaaaaaaaaaaaaaaaattgtcatatctgttgccatagcaatgaagtaagctactcatcagtcttcctacacctctgtacatttattaagccttctatttgaataaatataaacttcatttcaggataaaatatatagggaatggcaaaactatgaaattatttaacttgcttaaaagattaaaactgaactcaactttaattctaggccctgggccggcccttcaaagcattggaaagtcgtgaaattgatgtgttgctctctcttttccagctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagtgtaagtgcctttaaagcttgcctcttatttctcctttactctagatagccctgcttggaaaaaattacttataaaaagaaaatgtgggccgggcctagtggcccacacctgtaagcccagcactttgggaagctgaggcaaatggaccgatcacctgaggtcaggagttcaagaccagcctggccaatacagtaaaaccctgtctcgatgaaaataacaaaaattggccaggcgtggtggcacatacctgtaatcccagctactcgggaggctgaggcaggagaatcgctttaacagggaggtggaggttgcagtgagccaagactgtgccactgtactccagcctgggcgacaaagcgagtctctgtctcacagaaaaaaagaaaatgtgaataatttttttttttccgagatggagtcctgctctgtcacccgggctggagtgcagtggcacgatctccgctcactgtaacctctgccgcccaggttcaagcgattctcctgcctcagcctcccgagtagctgagactacaggcatgtgccaccacattcggctgatttttgtatttttagtggagatggggtttcaacatgttggccaggctggtctcgaactcctgacctcaggtgatccacctgcatcggtctcacaaagtgctgggattgcaagtgtgagccaccgcgcccagcattgtgaataaatttaaagtacaaagaatactctgccaaaagaataagttatagaatttggactctttctttttttaatcttaccttaaaactttatttttatttatttatttatttatttatgtttgagacaggttctcactctctcactcaagctggagtcagtggtgcagtcttggctcactgcaacctccatctcctgggctcaagcaattctccctcctcagcctcccgagtaactgtgactacaggcgcatgccatcacacccagctaatttttatattttttgttagagatgggattttgccatgttgcccaggctcaccctgaactcctgggctcaagcagtctgcctgcctcaacctcccagaatgctgggatcatgggtgtgagccactgcgcctggccaaattttgattttttactcttgtgattttttttttttcatggagatttttgtgatgacacaaaatttacaaaattatgtacatgaaaaattacaaccgctagttttatatactacagggaaggcattgtataatgttgtgcttaagagcattcaccttggagtgagatagccctgggttcaaattgcagcactaccactcttagcttatagtagtgttaagttactgaagccttctgctctttagttatatcatctctaaatgggaataatatttactctgtaggcttgtgagaatgacattagacaaattctggaaagcaccagtgcctaataagtggtaaagctgggatctgaacccttagattaatacctgctaaaaagtttcttagtaagattgttaaagttaagggagagaattaattataagttacttcatccatagatttttttgtatttatggttatttcagtcctttgtcttttttttttttttgagatagaatctcactcttgtcacccaggctggaatgtagtggcacaatctcggttcacttcaacctctgcctcctgggttcaagagattctcctgcctcagcctctcaagtagctgggattacaggcacctgccaccatgccaggctaatttttgtatttttagtagacacagggtttcaccatgttggccaggctggtctcaaactcctgacctcaggtgaatttgcccacctccatctcccaaagtgctgggattacagccatgagccaccacgcccagtctttatttcagtcctttgtcttaaaagtcagttatcctcttcatttctaaaaggaaaatataattatgttaatttgttagtccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtaagaaagggagggaaaagcaaaacagagaattcttttccagataaaactatttgctgatcttagcaagtgtcaaaagagatatggaaacaggtaccttctcccattaagtcatctggctaactgatgttggaagccactgtgaaggactccttgtccctattatcacccctctgttaaaacaagccaagacagggatccaagtagattgagtcactcaggttttaggttttttgtttttttttgttttaatttttttttttttttttggacaaggttttgatctgtcacccagctggagtacagtggtgcaatcgtcgctcactgtagcctccaactcctggacttaagtgatccttacgcctcaacctcccaaatagctaggacagatgtgtgccacaactggttaggtttctttgattttttgttttgttttttgtttttgtagagacagggtctcgttaggttgcctagcctgttctttttttttttttttgagacggagttttgctcttgttgcccaggctggagtgcaatggtgcgatctcggctcagtttaacctccacctcccaggttcaagcaattctcctgtctcagcctcccaagtagctgggattacaggcatgtgccaccacacctggctaattttgtatttttagtagagatggggcttcaccatgttggtcagactggtctcaaactcccgacctcaggtgatctgcctgcctcggcctcccaaagtgctgggattataggtgtcagccaccgtgcctggccataaaagatatatatataattttttttttttttttagacagagtcttgctctgtcatccagactggagtgcaggggcacgatctcaactcactgcaacctccacctcccgggttcaagcaattctcctgcctcagcctcccaagtagctgggattacaggcgtctgccactaggcccagctaatttttttttatttttagtagaggcggcgcttcactgtgttggccaggctggtctcgaactcgacctcgtgatccgcccacctcccacagtgctgagattataggtgtgagccactgtgcccagctgcccaggctgttattgaactcctgacctcatgtgatccccctgccttgacctcccaaagctctaggattacaggcatgagccaccgtgcctagcctatttttaatttttatagatatataatagtaatatatatttatggggtacatgagatattttgatataagcatgtgtgtatgggtaattaggctatccatctcaagcacttatcatttgtttgtattgggattattccaaatctacctttctggttatcttgaaatatacaatgaattattgttaactatagtcaccctattgtgccaccgaacactagatcttattcctttttttttgagacagtgtctcactctgcaggctagagtgcagtggcacaatctcagctcaatggaacctccacttcctggctcaagcaatgctccaacctcagcctcccaagtagctgagaacacaggtgtgagccaccacgcccagctcatttttgtatttttttatagagacagcgtttcaccatgttgcccaggctggtctcgaacttgtgagctcaaagtgatctgcccacctcagctcccaaagtgctgcgattacaggcatgagccaccacgcccggcctagatcttatttcttctatctaattctgtttttatacccattaaccagtctctctctcccccatcccctctacccttccctgcctctggtaaccaccattttatttattacctccatgagatcaacttttttagctcccacgtaagagtgagaacatacaacatttatctttctgtgcctggcttatttcacttaacgtaattgtcctccagttccatccattttgttgcacataacaggatttctttctttttcatggcagaataatcttcaattgtgtatatacaccacgttttctttatcccttcatttattgatggacatttagtctgattccatatcttggggattataaatagtactgcaataagcatgactgattgatttgctgatttcctttcttttggatatgtacccaacagtgggattgctggatcgtatggtagttctattttttttttaatagacggaggctcactctgtcaccaggcaggagtgcagaggcacgatctcagctcactgtaacctccgcctcccaggttcaagcgattctcctgcctcagcctcccaagtagctgggattacaggtgtgtatcaccatgcccagctcattttagtttttgtttttgtttttgtttttgtttttttagtggagacagggtttcaccatattggctgggatggtcttgatctcttgacctcatgatccacctgccttggcctcccaaagtgctgggattacaggcatgagccaccgtgactggcccggtagttctatttttaagggtgttttgtttgttttgttttgttttttaagtagagacacagtcttgctgtgttgctcagactgatctgaaactcccagcctcaagcaatcctcctgccttggcctcccaatgtgctgcattacaagcatgagccacctcatttggcctattttcagttttttaaggaacctccatagtgttttccacaatggctgtactaatttcaggtttttgtttgcccccaattttaaaactattcacctaagtgcctctaatcccagcactttgggaggccgaggccggtgaggtcaggagcttgagaccagcctggccaacatggtgaaaccccatctcttctaaagatagaaaaaattagccaggcatggctggccacggtggctcacacctataatcccaacactttgggaggccgaggcaggcggatcacctgaggtcaggagttcgagatcagcctggccaatgtggtgaaaccccatctctactaaaaataaaaaattggctgagcatggtagcaggcgcctgtaatcccagctactcaggaggctgaggcaggagaattgcttgaacccaggagacggaagtcgcagtgagccaagactgtgccactacactccagccggggtcacagagcgagactctgtcgcaaaaaaaaaaaaaaaaagccaggcatggtgacaggcacctgtaaccccagctactcaggaggctgaggcaggagaattgcttgagcctgggaggcggaggttgcagtgagccgagatcttgccactgcactgcaacctgggcaacagagcaagactccgcctcagaaaaaaaaaaaaaaaaagaggccaggcgtggtggctcacgcctataatccctgcactttgggaggccgaggtgggtggatcacctgaggtcaggagttcaaaccagcctggccaacataacgaaacccgaaacccggtgtctactaaaaatacaaaaaattagctgggcgtggtgacccacgcctataatctcagctactcaggaggctaaggcaggagaatcacttgaacctgggaggcggaggttgcaatgagctgaaatcgtgacactgcactccagcctgggcaacaagagcaaaagctctgtctcaaacaaacaaacaaacaaaaaaaccaacaacaatatggagtagaggaaaggtggcacatgggctaaggtgaaaagataaaagtgatgttttccctttggtctaatgaacttattgccacagggcagagaaaaataaacattttcataccctcacatctttgcaaataattgagtcctgattaattgaagtagaaaggcagctttaaaaacagatagactatgaggtgttagtatgaaagcctttatgttttaattcagagggctgtcccatgcttagattctctctcctgtagcaactcttaccaaggaggaaaaatgtagaggcctgatagaagagaaaagataccttttaaccatcttagtccacctggctaaaaagatttttaggtgtctttagctttacccccacctcagtgttcagctggatcatttgaggccaggtgggaactgggaattaaatattgtatttgttcagactcttgactagctccaggtaaggttgaacctttggctttaagcctcaagttctacatttttttcttccccgtgtgcaaaggtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggtaggcctttgcttagatttgcttgattgatttggttatgccagtatttgtgttagatgttgttagatgtgttgtttttttgtgtgtgttttgtttcgttttctgagacagggtcttgctctgtcacccaggctggagtagtggcgcgatctcggctcactgtaacctccacctcccaggttcgagcaattctcctgcatcagtctcctgagtagctggcgttataggcacctgccaccacgccaggctaatttttgtattcttagcaaagacagcgtttcgccatgttggccgggctggtctcgaactgctggcctcaagtgatcacccaccttggcctccacaagtgctgggattacaggcatgagcccctatacctagtctatatgtttactttgttgtggagtattcatttatcttttttagtgtgatttttttttcttttcagacagagtcttgatctgtcacccaggctggagtgcagtggttcaatcatggctcaccacctccaactcttgggttcaaggcaccctcccacctcagcctcttgactagctgggtcctcaggcatgcgccaccatgcactgctaatttttgtaattttttgtagagacagggtctctctgtgtttcccaggctggtctcaaactcatggcctcaaacattcctcccacgttgccctccgaaagtcctgggattataggtgtaagccaccacacccatcactttgagtataattttaaaaaatacatattgggttttgcatgaaaggagagaaggttagcactccacttgacaaggatggaagaggccctttgggcctgacaacacacatacaaggcattgccacctactacgtggcatctaactatctttacaaaaaaagaaaaagaaaagaaaagaggctgggtgcagtggctcatgcctgtaatcctagaacttcgggaggctgaggtaggcagatcatctgaggtcaggagttcaagaccagcctgaccaatatgatgaaaccccatctctactaaaaatacaaaaattagccaggcatggtggcatgcgcctatagtcccagctactcgggaggctgagatcggagaattgcttgaacccaagaggcagaggctgcagtgagctgagatcgcgccactgtactgcagcctgggcaacagagtgagactccatctaaaaaaaaaaaaaagaaaagaaaagaaacaaaaaaatatatattggacacagttgggtatcctctaagaatttggaaattgaagatgtagctgcctgtgagagttttattttatttattttatttttgagatggagcctcgctctgtcacccaggctggagtgcaatggtgcaatctcggcttactgcaacctctgcctcccgggttcaagtgcttctcctgcctcagcctcctgagtagctgggactacaagctcataccaccacacctggctaatttttgtatttttagtaaagatggggtttcaccatgttggccaggctggtctcgatctcctgactcaggtgatctgcccgccttcgactcacaaagtgctgggattacaggtgtgagccaccacacctggccagcctgtgagagctttaaaccatgagatagacatatggttttgcaaaagtttctacataaatcagaatggttcccagaacagaaaggctcctctgtcactttttttatctggttgcttaaccataagatgccaacccaattaacagtcacacccatatttgcattatatctgtttcatatgttccgtgtaactgcctcctttcaaagtgttggtatatttttcaagtcaactggaaccaaaagtatagagaaactgaatgcaagccagctttctgcatatgtaacagtgtaagaatccaggttgtatagatgggtttttgtttgacacagatgtttctcccagtaaagagaggataaggagctggaactcgtggcacagttccctacaaaataattaattgatcatgtctactaattaaaatttctttttctgtactattgcagatacctggttttggctgggcaaggtggctcacacctataatcccaacattttgggaggctcacttgaggtgggaggctcacttgagcccaggagtttcagagcaacccgggcaacaaagtgagatcccatctgtacaaaaaattaaaaaattagctgggcatggtggcacatacctctagtccagctattctggaagcttaggtagaaggatcacttgagcctgagagatcaaggccgcagtatgctgtaattgcaccactgcactccaccctgggtgacagagcaaaaccctgtctcaaaaaaaaaaaaaaagagacacctggctttactgtgtatgctgtacctcagggcaagttttccctttgtcttctaatagacactttttggatccagaaattgttctctgcaatttctttacttaaacataattatcagcctgtatgacctctgtggtctgactactttgaaattaagggagaaggctgggcacggtggctcactcctgtaatcccagcactttgggaggctgaggtgggcggatcacttgagcccaggagttcgaggcaacatgacaagaccctgtctcgacaaaaaaacaaaaaacttagccagacatggtgacacacgtttatggtcccagctactcaagaggctgaggcagggggattgcttgagcccaggaggggctcaaggtcggcccaggaggtcaagacccaggcgatcaaggcccaggaggtcaagactgcagtgagctgtgctcatgccccactgcactccagcccagtcatcagagcaaaaccttgtctcaaaaaaaagtaaagaaagacatgtttattatatggtagtttgaaaaattacaaaaaaaagagataaatcatggccggacgcggtggctcacgcctgtaatctcagcactttgggaggccgaggcgggtggatcatgaggtcaggagatcaaggccatcctggctaacacgatgaaaccccgtctctactaaaaatacaaaaaaattagctgggtgtggtgctgggcctgtagcccagctactcgggaggctgaggcaggagaatggcatgaacctgggaggtggagcttgcagtgagctgacatcgtgccactgcactccagcctgggtgacagagcaagactccgtctcaaaaaaaaaaaaaaaaaaaaagagagagataaatcagccataatcctataccctataagccaggatttggcaaacttcttctgtaaagaaccaaatagtaaatattttaggatagggtgcagtggctcatgcctataatctccgtactttgggaggccagtgtggaagaattgcttgaggccaggagtttgagaccagcctgggtaacatagtaagactctatcactacaaaaataaaaataggtcaggcacagtggctcacacctgtaatcccagcacgtttgaaggccgaggcaggtggatcacatgagatcaggagttccagaccagcctggccaacatggtgaaaccccatctactaaaaatacaaaaattagccaggcgtggtggcgcccacctgtaatcccagctactcaggacactgaggcaagagaatcacttgaacccaggaggcagaggtttcagtgagctgagatcacaccatggcactccagtctggacgacagagtaagactccatctcaaaaaataataaataaaatagccaggcatggtagcatgcccctgtagtcctagctacgtgggaggctgtggcagcagaactacttaagcccagtagtctatatactagacagggcataaatatagttatatttaatatatttaatatatgtgtgtatgtgtatatatatgtgtgtatgtgtatatatatgtgtgtatgtgtatatatgtgtgtatgtgtatatatatgtgtgtatgtaatatatatgtgtgtatgtaatatatatgtgtacgtgtgtgtatatatgtccatatatatatatggatttgatggccatataaactctctctttttttttttcctacctttaaaaatataaaaacatgggtcgggcgcagtggctcatgcctgtaatcccagcactttgggaggccgaggcgggtggatcacgaggtcaggagacagagaccatcctggctaacacggtgaaaccccatctctactaaaattacaaaaaatttagccgggtggtggcaggcacctgtagtcccagctactcgggaggctgaggcaggagaatcgcttgaacccaggggacagaggttgcagtgagctgagttcacaccactgcactccagcctgggcaacaagagcaaaagaaactccgtttcaaaagaaaatatagtttatacatacagtggaatattatttaatcttaaaaaagaaggaaatcctccaatatgctaacaacatagtcaaaccttgaggacattaatatgagtaagccagtcacagaacaataaatactgcatgattccacttctgcgaggtatctgaaatagtcacatttatagaagcagagagtagaaagatagttgtcaggggctcgggattgaaggcaggggtgatagggagttgctaataaataagtataaagttttagttatgcatgatgagtaagttctagagatccactgtacaacattgtgtttatagttaatactgtagactgggcgcggtggctcacgcctgtaatcccaacactttgggacaccgaggcaggcagatcacgaggtcaggaggtcaagaccagcctggccaacgtgatgaaaccccatctctactaaaaatacaaaaattagccgggtgttgtggcaggcacctgtaatcccagctagtcaggaggctgaggcaggagaattgcttgaacccgggaggcagaggtttcagtgagccgggatcccgtgccactgcactccagcctgggcaacagagtgagactctgtctcaatcaatcagtcaatagttaatactgtattggccaggtgtggtggctcatgcctataatcccaatactttgggaggccgaggcaggcgtatcacgaggtcaggagttccagaccagcctgaccaacatggtgaaaccccatctctactaaaaatacaaaaattagccgggtgtggtggcgcatgcctgtaatcccagctactcaggaggctgaggcaggagaatcgcttgaacctgggaggcagaggttgcaatgagccaagatcacgccactgcactccagcctgggcaacagagtgagactctccatctcaaaaaaaataataataatactgtattgtacacttaaaagtctgttcaaaaggtagatctcatagtaagtgttatcactataaaataagattgaaatttaaaaaaacacacacaataagagaccaccacgagtacactaggatggctaaagttatgcaatttaaaagactgacaaggccgggtgtggtggctcacccctgtaatcccagcactttgggaggccgaggcaggcagatcacctgaggttgggagttcgagaccagcctgatcaacatggagaaacttcatctctactaaaaatacaaaattagctgggcgtggtagcacatgcctgtaatcccagctacttgggaggctgaggcaggagaatcacttgaaccggggaggcagaggttacagtgagccaagatcgggccactgcactccagcttgggcaacagtgcaaaactctgtctcaaaaagaaaggaaaggaaataaatacaggagtgatatgttcattcttgcaattgtgatgatgatttcacaggtgatatatggcaaaagtggccaaattgtacatgttaagtatgtacacagttgtacatatttacagtattattgtgtcagttatatcgtattaaagctggtttgttttttgttttttgttttttgtttttccgaagaacatttaaaaaggaaggcccaggccaggcatggtggctcatgcctgtaatcccaacactttgggaggctgaggtaggaagatcacttaacgtctggagttcaagaccagcctgaccaacatgctgaaaccccatctctattaaaagttagctgggcctagtggtgcatgcctgtagtctcagctactcaggaggctgaggcagggcaatcacttgaacccaggaggctgaggttgcagtgagccaaggtggcgccagtgcactccagcctgggcgacagagtgagactctgtctcaaaaaaaaaaacaggaaggtccagctgggtgtggtggctaacatctctaattccagccctttgggaggctgagctgggggaatcacttgagcccaggaatttgagaccagcctgggcaatatggcaaaactccatcactaccaaaaataaaaaaattagccagcccagtctctaaataaataaatacatacatacatacatacgtactttttaaaaaataaaatggggcggggcacagtggctcacgcctgtaatcccagcactttgggaggccgaggcaggcggatcacaaggtcaggagattgagaccatcctggctaacacggtgaaacgccatctctactaaaactacaaaaacttagccgggcatggtggcacgcgcctatagtcccagctactcgggaggctgcggcaggagaatctcttgaacctgggaggcggaggttgcagtgagccgagatcaagccactgtattccagcctgggcggcagagcaagattctgcctaaaaaaaaataaaaataaaataaaaataaataaataaaatggaagatccttgaggtaggaggatcatttgagcctaggaggtggagctgcagtgagctgtgatcgcaccactgcactctagcctgggtacagagtgagaccctgacacacacacaaaaaaaaaaaaaaaaaaaggaaggtcttgttcagaaagaaaagttgtatatagaatgggactggaagttccttatgcaagcaacagaagagttgaaaattttgcaagtactagctaattagcccaaatactgtctgagaagtataaattaaaagtaagaaatgaataactttctgatttcaaaaatgacaaattgtagttttttgttgttttttttttttttttttttttttttgagatggaatctcactctgtcgcccaagcaggagtgcagtagcatgagcttcagctcactgcaacctccatctcccaggttcaagcattctcctgcctcagcctcccgagtagctgggactacaggagcacgccacaacatccggctaatttttgtatttttcagtagagacagggtttcaccatgttggccaggctggttttgagttcctgacctcaggtgatccacctgcttcagcttcccaaagtgctggggattacatgcatgagccaccacacctggccaacaaattgttattggtgaataacatctcagaactgtgatgaggtgagataactttatcaaatgcttcacagagaagactgagatttaaatcatagaattatagaatatcacacagaaagagacaaacttaaattccagtggttcctaaaccactgatttaaaaacctagctgggcatggccaggcgtggtggctcacgcctgtaatcccagcactttgggaggccgaggcaggcggatcacaaggtcaggagatcgagaccatcctggctaacacggtgaaaccccgtctctactaaaaatacaaaaaattagccaggcgtggtggcaggcgcctgtagtcccagctacttggaaggctgaggcaggagaatgtcatgaacccgggaggcggagcttgtagtgagccgagattgcaccactgcactccagcctaggtgacagagcaagactccatctcaaaaataacctagctggacataatggcttgcgcctataatcccagcagtttggggggccaaggcgggaagatagcttgagcccaggaggagttcaagactatcctgggcaacagagtgagaccctcatctctattttcaaaaaattgtaaaaaaaaaaaatctaaagaggggcatctgagtcatagaagaagttttgtgaaaaaaaaaatctatatatagatatatgtaatttcatttttcatcctgattttctgaatcagaatttctgttaacgtttcttgggaatctgtgttttctaaaaagtctctaatgcttctgaaggagcaaatttgtttaggagccaccagttcggtccaaaccttcgcttcacggatgaggacactcaaggtctaactgaacttttttgtgctaatagctcttatcaaggtctagaactagaatcctggccacttgtttgcatatacagttcctttttataatgtgatatctgtgttaacacttttaatgtgaaattgttttataaacaatcataaataaatgaaatatatcagtttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactgtatcctggaactgccttgggcatttgggaggctttgacagtatatgggagatgtgcccaatttttctgttttcagggagctaaggaggtagctgtgcatatggagaccttcctattcctagaatgtgagggctggggcccaaagcaagtcccaaatgcagcagcttttctcttggtttaatcccttaagactttcttacctctgtagttaccaaatgggaccatatatttaatttgctgtctgtgtacataattaatttcctgaaatagcattctaatctagtacatatttcatttgtttttccagaatatagagtgaaatttggccttaaaagtctcctcactgagaaggtttgggcttccttggggctatttgtgagcatgttcagtctgaccaatccatcccctgttctctcagcactacttgggtatacacaacttaataacttagtacattttctagtgtgggagcccttataacgtatcacacaaaactcagtgtgatcaccattgtccattcttagcagttactcttgagcaagaatctgcaggcttttccttaaagcatacatagtaaacattttgggttttgcaggccaaaaagcaaatgaacaactatacgtaataggtccttacaaaaccatttaaaaatgtgaagactattcttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatctgggccgaggcgagtggatcacaaggtcaggagatcgagaccatcctggctaacatggtgaaaccccgtctctactaaaaatacaaaaaaattagccgggcatggtggcgggcgcctgtagtcccagctactcgggaggctgaggcaggagaatggcgtgaacccgggaagcggagcttgcagtgagccgagattgcgccactgcactccagcatgggcgacaaagcaagactccatctcaaaaaaaaaaaagaaaaaaaaagaaatatctgggctgggcacggtggctcacgcctgtaatcccagcactttggaaggccgaggcgggtggatcacctgaggtcaggagtttgagaccagcctgaccaatatgatgaaactctgtctctactaaaaatacaaaaatcagctgtgcatggcatgtgcctgtaatcccagctactcgggaggctgagacaggagaatcgcttgaactcgggaggccgaggttgcagtgagccaagattgtaccattgcactccagcctgggcaacaagagcaaaactccgtctcaaaaaaaaaaaacaaaaaagaaatatctgtaatgtaattactaaaacgtttgatatgcaaattgtcatttgtgagtaatattccttccttctgattgtcaactgtagctaaaaatgaagctgatcgtcaggcagaaaaacgagaaattaaacgtcggctcactagaaaggtactactgcctgtgtgttcagttaactatatgtgttatatttggatggcctatttgattggaaatgaattcacagctgggcacagtggcttgcgcctgtaatcccagcactttggaaggccatggcaggaggattgcttgagcccaggagttcaagaccagcctggggaaaacagtgaaaccttgtgtctacattaaaaaaaaaaaaaagaagaagaaagaaaagaaaaagaaaaaaatgaatttgcagcctgggcaacatggcaagaccccacctctacaaaaaaaaatatatattagccaggcatggtggtatgcgcctgtaatatcagctacttgggaggctgaggtaggaggatcatttgagcttgggaggttgaggctgcagtgagctgtgattgtgccactgcactccagcctgggtgacagggcaagaccctgtctcaaaaaaaaaaacaaaacaaaaaaccacctgataaccataatcactgggggtgggacctccagggatcaatagtgtctaaagctcccccaggtgattccaatgaagattgaagcactgggttagaggcaatttgaatgcatgattgatgcctaattattggcttggtgaactaagaggctccgtttccttcagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggtacctggaaagcactctcttgctttttttctctttctctttttctctttatttggaggatccaagatactaactagaagggagaaccataaacaaaacttctagttttaatataatattaaatttcaaatcaagatacaaaatgccaagttgaacaagtcaaaatgttatactaactcagtatgttttggtaactccaccaccaatactgaaagaaagaaaatccctgctatctcacagagtaaaaatactggaaggaataaatacatttcaaacagtggttgtttggttagagggagtttgggctatatattttagtaattaccaatatttcatttttataatgctgtgaaaaactataaaagctggccaggcgtggtggcttatgcctgtaatcctagcactttgggaggccaatgcagagggatcactcgaggtaaggagttcgagaccagcctggccaacatggtgaaaccccatctctactaaaaatacaaaaattagctgggtgtgatggcatgcacctgtaataccagctacttggaaggctgaagcaggagaattgcttgaacctaggaggtggaggttgcagtgagccaagatcatgccaatgcactccagcctgggcagcagagtgagactccacctcaaaaataaaaataaaaaattaaaattaaaaaaaaaacaaaactagccaggtgcagtggctcacacctgtaatcccagcactttgggaggccgaagcaggtagatctcttgaggtcaggagttcaagaccagcctggccaacatggtgaaaccctgtctgtactaaaaatacaaaatagccggacgtggtagtgcgcacctgtaatcccagctattcgggaggctgaggcaggagaatcgcctgaacccaggagctgaaggttgcagtgagctgagattgcaccactgcactccagccccagcaacggagcgagattccatctcagggaaaaacaaaaataaaaacaaaactataaaagctacaatatatctttcaagattttcaagtattttgattaaactaaaaattttaggtttattatgagacagatgggtatcattgtgttgacctggtgtctgggttgcctgtgaggggttgcagtgacttacaaagttaaacacagtacagaaaaatgacaagttacactgctgtgcaaagcagccagaagaagctgaaacatttttgtctctactccacaggctgccataagaaaagaattaaatgaatttaaaagctccgagatggaggttcatgaagagagcaaacattttacacggtaagacccaaaagacccaatcatatatgtgctaggtagagttttccaaaaaattgttcagatatgaagggctctaatgacatcagtaaaaaggaaaacactcagtgttgattgcaagactgcattcaaagggatgaaaagtaagaagcaatagtaaatgcctaggccaggtgcggtggctcacgcctgtaatcccagtactttgggaggctgaggcaggtggatcacctgaggtcaggagtttgagaccagccggaccaacatggcaaaaccccatctctactaaaaatacaaaaattagctgggcctggtagcaggcgcctgtaatcccaactattagggaggatgatgcgggagaatcacttgaacccgggagatggaggttgtagtgagctgagatcatgccattgcactccagcctgggtgacaagagcaaaactccatctcaaaaaaaaaaaaaaaataagtaaatgtgtattctgattatggcatttcatgtatattatttaatccttgtaataaacatgcaagatgtgttaacatccccattttatcactgaggaaatggaggctcacaatggttaagtaacttggttgacttgctagtaaattgcagaaccaggattcggagaaagaaatcaatgacttcaaggatgtgaggtgctctcttccttgtaccttactctctcaggttataaatgaggagactgtgctaagttagacaagatcttgccctctctggttcagttctgtctagcacagttgatcttaccaacttaatgtataaacaacattttaattagctgtcttcatgaaacaagccaagaaatccaacaaagccaacaagccaacaaatcaagtgttttgatttggaattacggttgtgattaaggacccacccatatccaaagaatcagctagccacaaatggaatcagtgaaagtatctttacatgattcttagaacatttacaaaaagaggcaaatgaggctgagtgcagtggttcatgcctgtaatctcgacactttgagtggctgaggcgggaggatcgcttgagcacaggagtttgacaccagcctgagcaacatagtaagactccatccctacaaaaaaaaaaaaaatctattttttgatttaggcaggggcctggtgcagtggtacacacctgtaatcctagcactttgggaggccgaggtgggaggatcactttgagaccagcctgggaaacacggtgagccccatctctacaaaaaataaacttaaaaaaaaaataagcaaggtgcagccaggcgcagtggctcacacctgtaatcccagcactttgggaggctgaggcaggtggatcacttgaggccagttggagaccagcctggtcaacatggtgaaaccctgtctctactaaaaatacaaaaattagccgggcatggtggcatgcctgtagtcccagatacttgggaggctgaagcaggagaatcacttgaaccccggaagcagaggttgcagtgagccgagatcgcgcaactgcgctccaacctgggcaacagagcaagactgtctctcaaaaaaagaaaaagaaggaccagcttaagcaagacgatgggagagaggaaaacacatggtgtttctgggtaacagaaaatgtagctggatcagaggatgtttggggcagtgtggtgaaaataaactagaaaatgggttgcagtccctcgcaatgctttgactgttatgctaggatgttggaaccattggcagttcataagcaggaaattctgtgtatttcagaacaagctctgatgcaaacaacaaagatgatatggaaggatgaagagactagcagcaaggaaaacaggaagtatctgaaataatcttagtgagcatagtggtagctcacaccagagatagtgagaatgcaaaggtgatagatttgtaagacatttcaagcatagaatcaacaagatgtggcaatttgttggattccagagatgaaataaaggagtagtcaaaatgactctgatatttttaacttgtattttttgaggtctttgaaggtgataagtttagctgaacagtttagtttattcaacaaatactgagcacctaccacgataggtatagtgctaggtccttgggctacagcaggaaataagataaagtctctgtcctcaatgaggctttattctttttttttctttttttaatagagatggggtctcactatgtttcccaggctggtcttgaattcctggcctcaagtgatcctcccatcttggcctcccgaagtgttgggattacaagtgtgagccactatgcctggccaagcttttattctaaaagaagaaggcagacaatgaacaagctagaaaataaattgcatgtgtttagtttgaggagcctatgacacatggagatacctagaagaccattagatatgcagcctagaatccagaaagaaagcaaagtctcaagatacaaatgaaagaagatagtggacctttaggggggattttatttttatttatttattttttttttttttattttttgagacaaggtctcactctgtcacccaggctggagtgcagtggcatgatcgtggctcactgcagcctcaacctctcatgttcaagccatcctcccacctcagcctcctcagtagctgtgactacaggcacaggccaccacacctggctaactttttgatcatttgtagagacagggtctccgtatgttgcccaggctgctctcaaactcctggtctcaaatgatcttctcaccttggcctcccaaagtgttgggattgattacaggcatgagccaccgtgactggccaaggaaagttgttttttatttaaagggtagacagaggaaaatgaaccaggacagcatactgagaaagatcaattgaagaagagagaaaattatggaaaagatagtgttacagaagccaagagaagagttcttttttttttttttttttttttttgagacggagtctcgctgtgtcacccaggctggagtgcagtggcgcgatctcggctcactgcaaactccacctcccaggttcacgccattctcctgcctcagcctcgcgagtagctgggactacaggtgcgcgccaccacgcccagctaattttttgtatttttagtagagacagggtttcaccgtgttagccaggatggtctcaatctcctgacctcttgatccgcccgcctcggcctcccaaagtgctgggattacaggtgtgaaccattgcgcccagccgagaagagttttaagaaggaagcagatgaggagtatcagatgcaacagaaaggtcaggtcgaattagagcagaggaaaggcagtgttaattaggtataacatttcattactactgatacattaatagcaaagcaatgtacatcatgtggtaacttgtctcttttttaatctcttttagctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaaaaaaaaaaagccttagccagattcagtggctcacgcctgtaatcccaacactttgggaggctgaggcgggtggatcacctgagttcaggagttcaagaccagcctggccaacatggcaaaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatcaaaaaaaaaaaaaaaaaagaaggaaggaaggaaagcaagccctgaatccacatctccttgaagttttttttgttttattttgtttttgagacagaattttgctcttgttgcccaggccggagtgcaatggtgcaatctcagctcactgcaacctccgcctcccgggttgaggcgattctcctacctcagcctcccaagtagctaggattacaggcatgagccaccacgcctggctaattttatatttctagtagagatgaggtttctccatgttggtcaggctggtctcaaactcccgacctcaggtgatccacccacctcagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaataccaactatactattctggtgtgaggtattttcttttacattacactctatcccaaaagattaaatccagcttaaaaatgatatgtaagccaggtgtagtggctcacacctgtaatcccagcgctttgggaggacaaggcaggcggatcacctgaggtcaggactttgagaccagcctgaccgacagggagaaaccccatctctactaaaaatacaaaattagctaggcgtggtgacacatgcctgtaatcccagctactcgggaggctgaggcaggagaatcacttgaacccaagaggcggaggttgcagtgagctgagatcgcgccactgcactccagcctgggcaacaagagcaaaactccgtctcaaaaaaaaaaaaaaaagaatttatattaaccacatataattggacccccaagatgacattacaaaaggacacttagtactttttcttttttttttttttccccaggacggagccttgctctgtcacccaggctggagtgcagtggcatgatctcggctcactgcaacctctgcctcccggattcaagcaattctcctgcctcagcctcctgtgtagctgggagtacaggcgtctgccaccacccacggctaattttttgtatttttagtagagacggggtttcaccatgttggccaggctggtctggaactcctgacttcaggtgatccgcctgcctcagcctcccaaagtgctaggactacagacatgagccactgcacccggcccaggacacttagtacttcatgttatcttttccagcaagcagcccagtttcagtccaggtggcctcagcaatgactcacttctatttgtcacttaagagactggccttgtttagtgcaccaccctttaccaagagttaaaagaaaccatgagtcagaactccttgtgtccacctgcttccagattgtccttctactagccctccaaagaagcctcaaattgctattgcccttttgaggttaaattgtctccagaaagctgttttgaagatgaagattgcccagtgtttgccaaaacaatgaatgaattttgggtctctgtggatttatataactgtaccccaggaaaaggcaggtccagcccggtgcagtgatgcacacctgtagtcccagcagcttgggaagctgaggtggaaggatcagttgagcccaggagttcaataccagcctgggcaacatagaccttgtctcttgaaaaaagaggagcaggtccaatggacactgaataggcaaaggatgaaataataagcataaaaagatgacaatgtgcaacaaagaaaatcctatccttgaagccaaaatacagccagcaccactgtttcaacgttctattccatttcagccctaggaggcatgaagggaaaaccaggaatgaccagcaacccagacctcttgctccatctgtcattttgtgtggatattgttaatttcttccccaaagaattttgcctcctatgtagagcatagaggtcatctgacaggaacaaacagctttaatgttccttcatttggcactgaggacacacagtcctcagtgaggattgtgggagggggagcattaaataaattatttaatgcttacctccttcctaccctcacccgcaacaaagacacaatcttcccgtgaccccaatttctcttcaatctattaccctctctcctgcttttcctatactcccttcacacaatctattccaatgttaaacaacccaagttctcaggccaggcagctgggctaaatgattgacagaggaagaactagtgatggagatgtaaactgaacaggcttcttggccttgcttcataacctctggtctgtgcacattgttttccctacctaaggccatattcactcagctcattaaaatctaaacgaaatccaaaccaatatggctttcctgtggtcaccagggatttctcagccttcggttattgcacttggctgctttgcaacatttggtgctttggacaatgttctagtcctcaaaactcttcttccttggcttctgaggcaccgctgtcttctggttctccttccctgactgacctttctctgtgctgctggcttcttcctcgaacaccatttaaatgctgggttttcggccaggtgcgatggttcacgcctgtaatcccagtactttgggaggccgaggcaggtggttcacctgaggtcaggagttcgagaccaacctggccaacatggtgaaaccccatctctactaaaactacaaaaaaattagctgggtgtggtggcatgtgcctgtagtcccaggtacttgggaggctgaggcacgagaattgcttgaacccgggaggcagaggttgcagtgagccaagatcacaacactgcactccagcctgggtgacaagagtgagactccatccaaaaataaatgaataaaataaaataaatgaatgctgtgttttaccgggtgtggtggctcatgcctgtgatcccagcactttcggaggccaagattggcagatcgcttcaggccaggagttcaagaccagcccgggcagtatagtgagaggccatctctaccaaaaatttaaaaaattagctgagcatggtggtgcatgcctctagttcccgttactcagaagaggctgaggtgagagaatcgtttcagccctggtggtccaggctgcagtagtcctgatcacaccactgcattccaacctcaacaacagagcgagatcttgtctcaaaataaaataaatgctggggtttcatgtcttcccatcactctcctcattcttccaagacgactttagccaccatgctaattcttacaacttctaaatattttatcaccaactcagatttcttacaggaagcccaaccccatatatctaattgctctttggacttatatacaaccagatgttactcaggtaactcgtatatactccaatgtggacattactcctcccccactgcctgcatttccacttatcaaggttagagaccatagtatgttcagcctcctaagcctgaaactctggtatcctcaagttcttctcttaccttgcaattccagtgggacgacaaaccctacatcagaaatgtcttttttttttttttttttttttttttttgagataggttcttgctctgttgcccaggctggagtgcagtggcatgatcacgactcactgcagcctccatctcctgggctcaggtgatcctcacacctcataagtagctaggattacaggaatgtgccactacactcagctaacattttttttaaaattttgtaggccggggtcgggcgcagtggctcaagcctgtaatcccagcactttgggaggccgaggcaggtggatcatgaggtcaggggttcaagaccagcctgaccaacatgctgaaaacccgtctctactaaaaatacaaaaattagctgggcatggtggcgggcgcctgtaatcccagctactcaggaggctgaggcaggagaattgcttgaacctgagaggcggaggttgcagtgagccgagatcgcaccactacactccagcctgggggacagagtgagacttcatctaaaaaaaaaaaaaaatttgtaggccgggcacggtggctcatgcctgtaatcccagcactttgggaggtcaaggcgggcagatcacgtggtcaggagttcaagaccaccctggccaatatggtgaaaccccgtctctactgaaaatacaaaaattggtggggcatggtgacacttgcttgcagtcccagctactcgggaggctgaggcaggagaattgcttgaacccaggaggcagagaatgcagtgagccaagatcgagccactgcactccagcctgggcaacagagcaagactccatctcaaaaaaaaaaaaaaaaagaattgctgcgatagtaaataatgtacgtaataaagcattcagaacaaaatctaatatgtaggaggaacaccataaacgttactactcaagatagcccagctgtgatagctctgtctctctagccaacgtttttccaccttacaccacactaaaaattccatcatatttgcaacatttcttatgtatatatatcgtaagcattctttacttgcctacttcatattcagagggttttgtgtgtggtaaaatatacataaaacttgccatttttaactagtttaaaatgtatagggggccaggtgtggtggctcaggcctgtaatcccagtactttgggaggccaaggcgggcatcacttgaggtgaggagttcgagagcagcctggccaacatggtgaaacccggtctctactaaaaatacaaaaattagccgggcatggtggcatgcctatagtcccagctactcgggaggctgaggcaggagaactggttgaacctgggaggtggaggttgcagtgagccgagatcacaccacttccttccagcctgggcgacagagcgagactccgtctcaaaaaaaaaaaaaaaaaaaaagtccaggtgcgctggctcatgcctgtaatctcagcactttggaggccgaggcgggtggattgcttgaggtcaggagttcgagaccagcctggccaagatggtgaaaccccgtcttgctaaaaatacaaaaattagccaggcacggtggcgggcgcctgtaatcccagctactggggaggccgaggcaggagaatcgcttgaacccgggaggccggggttgcagtgagccgagaccgcgccattccactctagcctgggtgacagagcaaaactccatctcgaaaaaaaaagaaagagtatagggcagtgcttttaattacattcattcacactgttgtgcaatggagttttttattttttatttttatttatttttatccgggccaggcctggagtttttaaacttttatctgattcgtctaggggcactttcatcttatttaccttcacatttatcaaattatttctttcacaggtgacagagcagattcaattccttttgatactccgtatttctctatatgtatttttttcattctgcattcttattattccaacgttttacttatttatttggagagagagtttcgctctgtcgaccaggatggagtgcatcggcgcgatctcggctcactgcaaccaccgcctcccaggttcaaacgattctcatgcttcagcctcccgagtagctgggactggaggtgcgcggcaccatgcctggcttatgttctgtattttttgtagagacggggtttcgccatgatgcccaggccggtctcgaactcctggcctcaagcgatccgcccctcacggccttcagagctgctgtaatcacaggcgtgagccaccgcgttcgactcttccaaaaactttttggccagtttatctaagggcatatcctacagactgagtccagtgattgcacagaagtaaacgtcctctgcagctacatacctacaaacctatttctgtaacgtacattccccagcaaggtcccgcgggaaggatccactaccgcgagaggcctcccagccaggaaggggtggggctcaatctgcagtagattcccagaagcctcagtgagtttctgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggtaagtgtgatccttggtaagtgtgatcagatgcttgccaccggagttgtgggtctaatgctatagatcagtagccgagcttccctaggaagatcatatagtattttatttatttactttttttttttttttgagacggagtcggtttgtcactcaggctggactgcagtgctcgttgcaacctccgcctgccgggttcaagcgattctcgtgcctcagcctctccagcagctgggattacaggcacgtgccaccacgcccggccaatttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagttttattctggatcctcatttgcctttaagaattttctcaatttttctttttatttgatcgcaccactgcaacctccgcctgctgggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggtgagtaaatctgctaattgttttttgcttatcagctctttgtcaatgatttctgtaatggaaataggattgaagagacttttattctagttggtcaggatttacctctgaggcatttaatcattctcagagcaatagccaaatatcgactttgctgcatttttgtaggcatgttgacataacttcaacatatgctctgttctgtaaaaattgctttttttagtcagctcattaaaagtgcaaagtagtaaaagctgccctagtgaactgtaggaagcctaattggctttatctacatgtgtagcctgagctgagaaagatactagcccttgaaaatactgtgggtgattagcaatattggatttgtcggttactccaattcctcactaatgagcattccaacgtggataccctgggaggtcactctccccaggctctgtccaagtggcataggggagcttagggctctgccccatgatgtacagtccctttccacaacgttgaagatgaagctgggcctcgtgtctgcgcctgcatattcctacagcttcccagagtcctgtggacaatgactggggagacaaaccatgcaggaaacatatctagtatactagattttaagttgaagtaggatcttcaggagtctaatcattatttcttttcttttaggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaaccagtggttttagtatgttttcaatccatatactcaggtgggtttgggtaactgcagtgctgggcaggaaatgaatgaatttctattgacttgcaaggtagaggtgaagcaaagctgtcagtaggtgttcaggtcccactctgctaaacttcagcttgcaataccccttttttagactttccaaacaggcacttctggccttgttctttgtgtaggcagacagtattggttgcctatcttaggagtactagactgggtttgaatcctgatcccaccacttgctgttcatgagactttgggtgagttactcagcccctctgcctcaatttcatgttcacaaaataagtgataaactacctcatagagttgtaataaggacaaaggagttggtatttgtgaaaagattcttagggtctctagatggagtgcagcagcatgatcacttattaaataacattcttttgtgacttctcagaaaccaaggatacagtatccaattttttgttttttgtttttttttttttttgagagggagtctcgctctgtcgcccaggctggagtgcagtggcacaatctcagctcactgcaagctcagcctccccagcagctgggactacaggtgcacgccgccacacccggctaatttttttgtatttttagtagagaaggggtttcaccatgttagccaggaaggtctccatctcctgacctcgtgatccgcccacctcggcctcccaaagtgctgggtttacaggcgtcagccaccatgcccagcttttttttttttgagatctaatctcactctgtctccaggagggagtgcaatggagccatcttggcttgctgcaacctccacctcccgggttccagcaattctcccacctcagcctcccaagtagctgggattacaggcgcacgccaccatgcccggctaattttttttgcattttttagtagagacgggtttcaccatgttagccaggctggtctcgaactcctgacctcaagtgatccacctgcctcagcatcccaaagtgttgggattacaggcgtaagccactgcgcctagcctcaagcctgatccttttttttttttttttttttgagatggagtctttgcctcccaggctggagtgcagtggcgtgatctcagctcactgctacctctgcttcctgggttcaagcgattctcctgcctcaacctcccaagtagctgggattacaagcgcctgcaccgcacccggctaatttttgtgttttttttttcagtagagacagggtttcgccatgttggccaggctggtctcaaaactcctgacctcaggtgatccaccacgcccggcagagccttgatctcttaaccactatcctcacctcccctttccctaaggatccacaatggcctcactggctcttgaaggcaggctggcaccttgatcattcttcctggtcattagtattctgatctggttattttccattttatgtccatctaacctacttggaggatcctcaagagactgcatatgtaaactcagtacttattcttgtactgtgcctgccatatagcaagcactggctgatttaatttttctgtgttcttttttattgatttgtttttatctttattattttctttgcttattttggggttagtttgctcatctattcctagtttcttaagctagtagctgagctcattgattggagacctttctttttttctaatgtaggcatttagtgctataaatttcctccagatactgttaacaacacacaaattctggtatgttttgttttcattttaattcatttcaaaatatttttgagttccttttctattctttgatctatgggctacttgaaagtgtattattgttgttgtattagtgttgttcaaatctatccttgctagtttctttttttttggagactgcgtctccaaaggctggagtgcagtggcacaatcttggctcactgcaagctccgcctcctgggttcacaccattctcctgcctcagcgtccccagcagctgggactacaggtgcctgccaccatgccctgctaattttttgtagagatggggtttcaccatggtctcaatctcctgaccttgtgatccacccgcctcggcctcccaaagtgctgggattacaggtgtgagccaccgcgcccagcctcttttttttttttagacaagagtctcactctgttgccaaagccagagtgcagtggcacaatctcagctcactgcaacttctgcctccggagtagctggaattacagtcacgcaccaccacgcccagctaatttttttgtatttttagtagagatggggtttgcgcggctgaagtgcagtgatgcgatctcagctcactgcaacctctgcctcccaggttcaagcaattttcatgcctcagcctctggagcagctggtactacagcatgcaccaccatgcctggctaatttttttgtattttagtagagatggggtttcaccatgttgcccaggctggtctcaaactcctgagctcaggcagtccgcctgccctgacctcccaaagtgctagaattacaggcatgagccaccgtgcctggccttattttaaaattttatttcttgtaggtaacatgttgggtttttcagtatgacagtctatgtcttttaattggagtgtttaggctatttactttttttttttaagacagggtctcactctgtcacccaggccagagttcagtggcaagattatgactcactgcagccttaaactggaactcctgggctcaagccatcctcccagctcggtctcctgagtagtgaagaccacaggcatgtgccactatggctggctaaattttgtattttttgtagagacaaggtctcatgatgttgtcccagctggtcttgacctccagggctcaagcaatcctcccaccttggcctcccaaagtgctaggaatacaggcatgagtcaccatgcccagccatattatacatttttaacttacaatagtccacattcaattgatattaaaccagttcacttgtagtataagaatcttccccagcctggccaatatggtgaaaccccgcctctactaaaaatacaaaaaaaaaaaaattagccaggtgtggtggtgctcgcctgtagtctcagctacttgggaggctgaggcagaagattgcttgaacctggaagcagaggttgcagtgagctgagatcgtgccagcctaggcaacagagcaagactccgtctcaaaaaaaaaaaaggcggggcccggtggctcacgcctgttatcccagcattttgggaggccgaggcgggcggatcacgagatcaggagatcaagaccgtcttggctaacacggtgaaaccccatctctactaaaaatacaaaaaattagccgggcgtggtggcgggtgcctgtagtcccagctactagggaggctgaggcaggagaatggcatgaacccaggaggtggagcttgcagtgagccaagatcgcgccactgcactccagcctgggcgacagagcgagactccgtctcaaaaaaaaaacaaaaaaaaaaccttctggcggcctggtgtggtggctcacacttgtaatcccagcactttgggaggctgagactggcggatcacctgaggtcgggagtacaagaccagcctgaccaacatggagaaaccccgtctctactaaaaatacaaaattagccgggcatggtggcacatgcctataatcccagcaactcgggatgctgaggcaggagaattgcttgaacctgggaggcagaggttgcagtgagccgagatcatgccattgcactccagcctgggcaacaagagcaaaactccatctcaaaaaaaaaaaacaatcttccggctgggcacagtggctcacgcctgtaatccatcccagcactttgggaagccaaggcaggcagatcacgaggtcagagcgagactccgtctcgaaaaaataaataaatatttcttccatttctcactatatagtctttgatattgtcatgtgtcttacttttatatatgttataaaacccacagtacattattacagccagaacctccatatcagccagttgcgatggctcactcctgtaattccaacactttgggatgccaaggcaggctgactgctgaggctcagaagttcaagaccagcctggccaacatagtgaaaccctgtctctaccaaaaatacaaaaattagatgggcaattagctggacgtggtggtgcacgcctgtaatcccagctactcgggaggctgaaacaggagaattgcttgaacccaggaggcagagattgcagtgaactgagatcacgccattacactccagcctaggcaacagagtgagactccgtctcaaaaaaaaaaattagctgggcatggtggtgcacatctgtggtcccagctactcgggaggctgaggcagaggttgcagtgagccgagatcctgccactgcactccagcctggatgacagagtgagactcttgagacaaacaactggggctgggcgcagtagttcacacgtgtaatcccagcactttgggaggccgagatgggtggatcacttgaggtcaagagctcaagaccggcctggccaacatggtgaaaccctgtctctattaaaaatacaaaaatgagccgggcatggtggtgcgtgtctgtaatcccagctactctggagactgaggcaggaaaattgcttgaacccagggggcagaggttgcagtgagccgagattgcaccactgcactccagcctgggcaacagaatgagactccatctcaaaataaaataaaaaatacaaatacaaaactaaaaaaataaaaataaaggccaggtgcagttgctcatgcctgtaatcccagcactttgggaggccaagatgggcaggtcacctgaggtcgggagttccagaccagcctggcaaaaatggtgaaacccggtctctactaaaaatacacaaaatggccaggcgcggtggctcacgcctgtaatcccagcactttggtaggctgaggcgggtggatcacctgacgtttaggagttcaagtccaggctggccaacatggtaaaaccccgtctctactaaaaatacaaaaattagctgggcatggtggcaggcgcctgtaatcccagctactcaggaggctgaagcaggagaattgcttgaacccaggaggaagaggttgcagtgagctgaaatcgtgccattgcactctagcctgggcgggtcaggagttcgagatcagcctggccaacatggagaaaccccatctctactaaaagtacaaaaattaaggctgggcgcggaggctcacgcctgtaagcccagcactttgggaggatgaggtgggtggctcatgagatcaggaattcaagaccagcctggccaagatggtgaaaccctgtctctactaaaaatacaaaaattagctgggtgtggtggcaggcacctgtaatcccagctacctgggaggctgaggcaggagaattgcttgaacctggctgcagtgagccgagatcgcaccactgcactccagcctgggcaacagagtgagaccccatctcaaaaaaaaaaaaaaaaagagttgaggtctccttccaccacttgtgtgaagaccccagaaaacttgctttacctctttaaacttcagttttcttatcttccaactgccatgaggtttttgtgaggaacaaatgagctgacatggatgtttctgtagttaacaaaataaagggtcttacaaaataggcaataataataataatcacttattattattacatgaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggtaagaaaccctgaagacaggggagtgctttgtggcaggctctgcatataagaattcagcctggccaacatggcgaaacccagtctctactaaaaatacgaaaattagccaggctttgtggcaggcacctgtaatcccagctatttgggaggctgaggcaggagaatcgcttgaacctgggaggcagaggttgcagtgagccgagatctcaccattgcactccagcccgggtgacaagagcaagactcgatctcaaaaaaaaaaaaagttcagttcagttggtaagaactcatcaaaagtgtccatctagactttgggtgccgtagaatgactcagagtctgaatcaacatgaaatcgagaaaacgtcctttgcaagggtttcagggaacacctgaaatcctgaagaactgtttgtatccatcctgaagaatgggtgttaataagagacagccttttcttggtacctgttttccatctctaacccaaccccaactcacacccttctattttatctggtctctctcattcctcttgctcctccccacttggctcccgttttccccaagtccattctctattttgttctataagatctgatcatattaggatgctcttgtagctcataagaagatgactgggtgttcacacgcatatgagatgtgcctccctcaaaccttgttaagacatgggcacatacccatctgatgttaactcacggggaaaaaaatctgatcatgccattcccgtgcccaaattcccatatatccctactgcctcaggatagaggctggaccccttagacacacaagaccctgtatccatgatctgtcactcccacaggcaccctctactcccatctacttggcagtttcccacaacctccctgggttctcgtggttccctgtcattgcaaacgtcgcttctcctaggatgtcctgcccccctagacttaacttggaaagctgttcttaagccccggactgagtcagatgcccctctgggtatccctgtcatagcgttgtgtggttgttgatagtctgatttttcaaccttctccatgccctcttgagggtagggaagatgagtatcttttttctccgtacagaccctaccgcacaagattttcctaaacagaccgaactcaaggagtctttctggttgttagtccacgtgtcccgatttggggtttccaaaatacacgcccactggaaccgggccaggggagccagcctggccaagggctcccccagcccggccaagggctcccccagcccgggagcgcgccacatgcagatcctgggatggccgccaggggccgccgggctctttgttttcctttctcacccgggtcggggccagaggcctgcagagcgcatgctctggggcagttcgcggcccggcggggagcgccggagttccttgtggccgacgtgcaccaaggtaggtctcgcctgggacgcgcggagggtccgggcagagggcggtaagcggagcggccacagccggagcacgggccggtccacgcgggcctaagtcgctgcccgctctcgcccgtgtcgcgcggcgccggccccacgtgaagcccggaggcaggaaggcgcggtgcgggctcgcgattccccggccccgcggggcgctccagcagcggctgggcgctgcctcgctggagctagggccgcgcggcccctccgccgccgcgcctctcacgcccgcaccgcggcgcccgcgcaggcgggagattcaaactgcgcgagcgcggcgggccgggtgcgcgcggccgcccgggcgggggatgggtctctgccgcgaggaggatggttttgtccggcatgcgcttggagaaggcggtttgcagatcggggagggagccctgcccgggagagggtgggtcgtaggagctcgagggtctcccgctgtggacctttgggagccgtgtgtcttgaactccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggcaagtcattcatacgtcacatattgacctaacttcgaccacgtgtgacttgtgtgccctagcagaagttgagtgtgtggggtgttacggggagccctcagggggatcccccaccctgcccaggaggctcagggatggctttccaggtgaagtgactcttgaatggggttttgaaggaacagagtttttcaggcagtctgagggtagtgggattagggtgatacaggcagagggattgcacgtgcaacggcatgaaggtataggtattgtggtcagggataccacaggtcttgaggtgactggaggaggagagtaacaagatgatacagcaggggctgggtcacgaagcgtcttgtgtgcaagactaaggaactctgcggggtggaggaggcagggaagatttcccccaagaagggtatcagagtgaaacctggacagatgaattaggagttcacgaggctcctgtttcaaagacatcccaagagcaggaatcctgttctgttcatcgttacaactttctcatcagatgcccttgggcaacccacccagtcccccagagcattggtttccttatctgtaaagcaatggtagggggcatgtggtgaggatataatttttttttttttgagacggagtttccactcttattacccaggctggagtgcagtggcgcgatctcagctcactgcaacctccacctcctaggttcaagcaattctgcctcagcctgctgagcagctgagactacaggaacacaccaccaggcccagctaatttttgtatttttttttttttagtagagacggggtttcaccatgttggccaggctggtcttgaactcctgacctcaggtgatccacctgcctcagcctcccaaagtgctggaattacaggtgtgagccaccgcacccggccaattttttttttttttctgatacagaatcttggtctatcgcccaggctgtagtatagtgtcgtgctctcagtcgctgcagcctccacctcccgggttcaagcgattctcctgtctcagcctcccgaatagtaatatcctataattttcataaagcagtgaagttgtgtgtcccttcccccaggaaaaatgaacacataggcccaggcacaggttgtatagaacggggatcccaggtgagaaactcctagtgtgaaatataccacctgtgtgcctggcataacagcagctcaccaaatgtatattgttgacacatgagccctctcctcccttccctcctggggaccttacacacagagatttttcagccttagtctggcaggcaagttcttcctcctggtgtgggggacggagggcacagctgcagtggcctgggagggctctgtctccttttacagaaatcgaggctgtggtgaggtcactggaggtcagggcaggagcaccaggctccgggcagactgtctagactggcgtgcctacccactttcttcaataaataaggaaggtgaggtgggggtagggcagctccagctctggtggagcatggtcatgagactgggatttcattccacctctctgtgacctgggtcacctttccctgagcctcatcttccccttagctgtaaaactgggatgagtctgctcacctcaaagggcagctgtgggcattcaggagtgcctgatggtggaagctgactctgtagccgacttatctgtgactgtctcactcttctcccagagactgtatgctccttgaagatggaagctgtgttgtgtggggcggggtggggaagcatgatgccaaaagccaactccttattcccagcccagacactcactgcctggttaagaaaacagccagagaggccgggctcggtggctcacgactgtaaccccagcaatttgggaggccaaggtgggcagatcacctgaggtcaggagttcaagaccagcctggccgacatggtgaaaccccgtctttactaaaaataccaagcagttagccaggcgtggtggcttgcgcctgtagtcccagcactagggaggctgaggcgggagaatcgcttgaacctgggaggcggaggttgcagtgagctgagatcgtgagtctgaactccagcttgggcaacagagtgaggctccatctcaaaaagaagaaaagaaaagcaaataaaggaaaacacacccagagcagtgagagaagtctgtatacaagacccatttgtgcagtagaggctgtgcaggcaggtaccgggaacagggctccaccttttagaaggtggtcctctggccgggagcagtggctcacgcctgtaatcccagcactttgggaggccgaggtgggtggatcatgaggtcaggagatcgagaccatcctggctaacacggtgaaaccccgtctctactaaaaatacaaaaaattagctgggtgtggtggcaggcgcctgtagtcccagctactcgggaggctgaggcaggagaatggcgtgaacctgggaggcggagcttgcagtgagccgatatcgcgccattgcctccagactgggcgacagagcgagactccacctcagaaaaaaaaaaaaaaaaaaaaaagaaggtggccctccatcccctgcccttccctggcgattgccagcccagtgcagggcctcaagtcttccattttggagaggaagcctctgggactcaaagagcactcaggtgccgtctccaccgcagcagggagttgtcgccactgtccttccccacatctgtgggtggatctgtcaccacccaccccaccttccctcaggctctagctgcctcattgtctcctctctggtctcaccatcctctcctcagctggcttctgctctctgcttcttggacttggccaagtgcataggggatactggggaggcctgcccagactgccttagcccctgcctggaccaaggtctgccttcagaatcagtcagataggcctgggttgcttttctaggctgccctttacttgctctgtgaacttaggccgataaagttatctttctgagcctcagttccttaactgtgaaataggagtgacagtgctgccttcttcagcttcctgtgaggaataaaagggttttgcatatggaagatacagtgagttagccggtgcccccaggggctcatattttaggaagttgattggtatggtggacaggcatgtaaattaaagtgattgtgatccaaaagtctgtcccagtttctcagagagaatgactagttcaggatggaggagggatcagaggaggtgactttgagacaccagtagatgttcttccagtgggataagggatgggaaggcgttccaggtaaagagatgcaaatagtatggagaggacagttagcattctggcctggtgggtctggcaaggagattgtgtgggaagagaagggaggatgtgatagataggaaatgaagctaaaggttctgtcagtacccgatgttggagacctctaatacccagctaagaaatgtgggctttatcttccaggaaaaggggaccactaaggagtccaagcaggccagcagcttgcttcaggtttgaggtttggaaagatcatgaatgaggccgggcatggtacctcacgcctataatcccagtactttgggaggtcgaggtgggaggatcacttgagcccgggagtttgagaccagcctgggcaacatagtgagaccttgtctctacaagaaaaaaaaaaattacaaattagccaagcgtggtggtacatgcctgtagtcccagctactctggaggctgaggcaggagggtcgcttgagcctaggaggtggaggttgcagtgagccgtgtacgtgctgctgcactacagcctgggcaacagagtgaaaccctgtctcaaaaaaaaataaatatatatatgtatatatatacacacacacatatttattgatcacgaatgacttggagaatgagaggaggggatgagggtggggaccggaagaccagtgaaaagttgctgtctttcctagggaaaggaggaggagacacagttccaggcaagctgagagactactagggagcatggggaggaaggaggcagaagaaatttcttttttttttttttttttttttgagacggagtcttgctctgtcacccaggctggagtgcagtggcgtgatctcgactcactgcaagctctgcctcccgggttcacgccattttcctgcctcagcctcccgagtagctaggactacaagcgcccgccaccacgcctgtctaattttttgtatttttagtagagacggggtttcaccgtggtctcgatctcctgacctcatgatccgcccgcctcggcctcccaaagtgctgggattacaggcgtgagccaccgcgcccggccagaagaaatttctaataacactcaaggacgccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttcactcttgttgcccaggctggagtgcaatggtgcaaactcggcttaccacaacctccacttcctgggttcaagcgattctcctgcctcagcctcccgagtagctgggattacagcacgcgtcaccacgcctggctaattttgtatttttagtagagatggggttcctccacgttggtcaggctggtctcgaactcctgacctcaggtgatccacccgccttggcctcccaatctgctgggattacaggcgtgagccaccgtgcccggccacaaagatgcctcttatatcccacatccctaccccatctaactttgcctgcctgacatcctttctgggatggctcccaagcacttcagattgaatgaaaacacctagcaacatggagcttcacgtctcttctctcctgtttgttcaacagtgttctctatctcactacatggaagtctaccatctacctggtcatttaagcccaagcctgggagtctttgtgtttggccaagctcatagggggatcttgggcaggcctgccaagaatcctctggacttttttaggatgaacaaatcaagccaagtgctgtggcacgtgcccatgatcccaggctcttgggaagctgaggtgggaagatcgcttgagtccatgagttcgaggctgcaataagctaattgcaccactgcactccagcctaggtgacagagtgagaccccctctcttaaaaaaataaaataaaaggccaggcatggtggcttacacctataatcccagcactttgggagtccaaggctagagaatcgcttgagcccaggagttcgggaccagcctgggcaacatggcaagacgttgtttctgcaaaatatacaaaaattagccgggcgtggtggtgcacacctgtagtcccagctatccaggatggctcaagcccgggtggttgaggctgcagtgagccatgaccatgccactgcactcaagtctgggcaggaccctgtctcaaaaataaatacaaaggatgaacaaattatgagagtaaaaaagggttagtctcctttatccttgctacacctcctcacccaaagccaagcagtagtgtagcaggataagccgcagacaaaaccccccagacacccagttaaagaaggaagggctttattcagctgggagctttggcaagattcacgtctccaaaaactgagctccccgagtgagcagttcctgtcccttttaagggcttacaactctaagggggtctgcatgaagaggtcgtgattgattgagcaagcaggggatatgtgactgggggctgcatgcactggttatcagaacggaacagaacaggacagggattttcacagtgcttttccatacgatgtctggaatctatagataacataaccggttaggtcaggggtcgatctttaaccagacacaggtcgcggcgccaggctgtctgcctgtggatttcatttctgccttttagtttttacttctttggaggcagaaattgggcataagacaatatgaggggtggtctcctcccttagtagtaaagcactataaatatttgtggatttacaaccatttcattcagtcttgatgacagccctgagaagtagtcattgcatccccttttatagatgaggatacagttcagagaggttaaggcaactggccagccacaagctctggaaggtgaacccagttccctctaatcccaaagaatgtgcactttttagtgtgggacaaggggtctcaaaagacaggtgggaggattctcagccctgggagaataaaagttgggtgaagttcagaactgccacctcatcagtcagaactgggccagtgacaacctgcagaagctcagcctgcaaaggcttatcaggattctagacctttggttactttcccatctttagtatttagttctccttccccaggataatcagcagaaaagtgcctggccttgtgtccatataccatggaggggagagctagagaggcgaggttctcgggaaccactagaaggaaggaatgagggggctgctggttaggcccagagctgagaccgagaagggctcttggagttctccttcccttcgtaacattaggtagaggcttagacaacttgattgtttttcatgaccttaaagactgtggctccggccgggcatggtggctcacagctgttgtaatcccagcactttgggaggctgaggcgggtagatcgcttgagcccaggagttctagaccagcctgggcaacttggcaaaaccctgtctctacaaaatatataaaaattagctggacactgtgatgcgcacttgtagtcccagctattctagaggctgaggtgggaggatcacctgagctcaagaggtcaaacctgcaatgagccgtgattgtgccactgcacttgagcctgggcaacagagagtgagatgctgtctcaaaaaaacaaacaaacaaacaaacaaaaacaagtacttgatgactccattggggtcaattatgaagagacctcttagtgcaagaccaggaccttctaacagcacaccgaagtctcgagaaattcgcttagttaaatctgacaagggtgcgatgtttatgtggcccaaagcaccattctttcttggtgtatttatccaggcaagacggctaaagtgggaatccactgagactgcaacaacttcaaagttcacatcgtgaaattccttagctttgtcactagaagcaacaatttctgtaggacacacaaaggtgaaatccaaaggatagggctgggcgcggtggctcacacctgtaatcccagcactttgggaggctgaggtgggtggatcacctgagttcaggagttcaagaccagcctcaccaacatggtgaaatcccatctctactaaaaatacaaaaattagccaggcgtcgtggcaggcgcctgtaattccaggtactcaggaggctgaggcaggagaattggcttgaacccaggagggggaggttgcagtgagccgagatcgtgccactgcactccagcctgggtgacacagcaagactccgtctcggaaaaaaaaaaaaaaagaaagaaatccaaaggatagaagaaaagcaccaaatatttcccctcaaagtcatcaaggcttaggtctttgaactctccattgaccacggctgtacccttaaaatagggcgcatgctgggtgacatcaggtgcatggtatgaggaactggtaccagaattttgcttgaccggaaccagaccacaatatgtttgtcaaacttgttcttccagaagcagcaggcctgagggctgcagtggcagaaatgcccccaaggaatggcactcacatgccgggcaactgatgctcagagtaaccttcccacagcagccgcgatcttcagtgcatgtgtgtttttgtttttttgagacagtgtctgtctctttcgcccaggctaaagtacagtggcacaatctcagctcaatttagcctcagcctcccaggctcacgccatcctcccacctcagcctcctgagtagccaggacttcaggcgtgcaccaccatgcccggctaatttttgtaattttttggatagaaatggggtttcgccatgttgcccacgctggtcttgaactcctgggctcaagcgatcctcctgcctcgacttcccaaagtgctaggattacaggtgtggtggcaccttgtctctaaaaaaaatcaatcaattaaataagaaaagaaaatagctcttctccccctctgattataacaacacattaccaaagttactggtgcttacatggggttgaatggagttatgatggatatttcatttaatgttgttcttcaatgttttaattttttacaacagacttaaaaattttttaaatacatgtggccaggcacgatggctcacgcctgtaatcccgcactttgggaggccaaggtgggtggatcatctgaggtcaggagttcaagaccagcgggaccaacatggagaaaccccatctctactaaaaatacaaaataagccgggcgtggtggcacatgcctgtaatcctagctactccagaggctgaggcaggagaatcacttgaacctgggaggtagaggttgtggtgagccgagattgcgccatggcactccagcctgggcaataagaacaaaactctgcttcaaaaaaaaaaaaaaaaaaacatgtaatcggctgtacgcagtggctcacgcctgtaatcccaggacttcgggaggctgaggcaggtggattacttgagattaggagtttgggaccagcctggccaacatggtgaaaccccgtctctactaaaaatacaaaatttgggctgggcacagtggctcacgcctataattccagcactttgggaggccaaggcggggtggatcactgagatcaggagttcgagaccagcctggccaaactggtgaaacctcgtctctactaaaaatacaaaaattagctgggtgtggtggtgggtgcctgtaatcccagctactcgagaggctgaggcaggagaatcacttgaacccaggaggcagaggttgcatgagccgagatcgcaccattgcactctagcctgggtgacagaacgagactccatttcaaaaaaacaaaaacaaaacaaaacttagcagggcatggtgatgcacacctgtaatctcagctactcggaaggctgaggcacaagaattgcttcaacccgggaggtggaggttgcagtgagctgagatcatgcctgtgcgctccagcctggcgacagagtgagactccgtctcaaaaaacagaaaaatacatgtaatgctccttgttaaacatcttagataatataggaagataaaacgaaacaagtaatgattatctataataccattttccgaggttaccattgttaatatgggatatattttcttccccacatttttctcacatattttttgtgtatgcattttttttccaaaaaaaaaaaaaatggatgataggctgtttttcttccttttttttttttttttttttggttggggggtggagtttcactactctttctcccaggctggagtgctgagtgcaatggcatgatcttggctcaccgcaacctccacctcctaggttcaagcaattctcctgcctcagcctcccaagtagctgggattacagtcgcacaccaccatgcctggctaatttttgtatttttttttttttttttggtggcgacggggtttcaccatgttggccaggctggtctcgaactcctgacctcaagtgatccacccaccttggcctccgaaagtgccaaagtactgggattacaggcgtgagccaccgcgcccaggctttttttttttttttttttttgagacagtctggctctgttgcccaggctggagtgcagtggctcgatcttggctcaccacaacctccacctcgcgggttcaagcgattctcctgcctcagcctcctgagtagctgggattacaggtgcccatcactgtgcctggctaatttttgtatttttagtagagacggggttttgccatgttggccaggctggtttggaactcctgatctcaggtaatccgcccgccccggcctcccacagtgttgggattacagatgtgagccaccacacctggccgtctgtttttcattctgcttgttttacttggcaatggggaacatctttctattcaatagattgatctctgaaaacatcacttttgatggcttcatactgttctatcatgaatataccacatatttagttcactactattgaacattcgggttctgtttttgttgtttttaaaatgttatgaaggatacagtagagaatatttgtgtaattaatctgtgggtgcatccattattctgttcttgggatacattttgagaagtggaattgttgggcaattcctcttaacgtatttctagagtgtttgataaatattgtctgattggcccaggaaaatgtttgccatttctcatatgtagtatttgactgactttcaggacaggaagatgtcacccaagcgcatagctaaaagaaggtcccccccagcagatgccatccccaaaagcaagaaggtgaagggtaagttggccttggcctctttgtgggtacaggtggccccttgaaaccctaagaacccgggactgggctcctttcttcctgaggcttgaagctgaagggtgtggatgtgcagagaccccacccagctggaaggtttcctgtagctcattgaatcctaccctctgggaatcacaaagtgggcagaaactcctctcaaagcactcaggcagcactggcacaaaaaaaaaaaaaaaaaaactagaccctagggcttcaccccaggcagtgatgcattatggttaggaccactgactttccgacatgggttcaagtccttgctctgccactttctagctgctgggcaagtcacttaatcccgcagtttggattatcaacttcttaaaatggcggcagccagagcagcgtcaccctctctgggctgtgtgaggatgagatgagataatggcctggcagcatttgagggaggtggctgtggtttcctctgtcctgggaccccggagggggacagggaggagagaaaagccagcaccaaactgggaggggaagtgtggacccacgctcagacagtgtctgtcttttgcagacacgagggccgctgcctcccgccgcgttcctggcgcccgctcctgccaaggtgcctgcgggccgagccctcctgaccagaaaacccgaccaggtggctccgcgcccggggcgccctctgtgctgccagcgcgggctcctcagcggtggccacatcctcgggggaggggctgggcgccattggctgcccggggctgcgggttggggggccgcctttggcccacagagagccccgggcgcgcacctcccgcaaatgccgctgtccgctcttcctcccgcccctcctgcctctccactggatggtggagggaagagtccgtttctgcagtggatttgcccgggagctgaacttattcactggcggacggcttgggcatggaggagggcttggatggagactggggattgttctctgacccacgtagtctcccttgctttcggtgcagattctgctattataattagctttctgcggggcaaggtggctcacgcctgtcagaagatcgagaccatcctggctaacacggtgaaaccccgtctctactaaaatacaaaaaattagccttgcgcggtggcgcgcgcctgtagtcccagctactcaggaggctgaggcagaggaatcgcttgaacccgggaggcagaggttgcaattagccaagatccaccactgcactccagactggcgacaaagggagactccgtctcaaaataacaataacaataattagctttcttttctttttctttttttttttttttttgagatcaagtatcactctgtcgcccagactggaggcggcagtggcacgatcttggctcactgccacctccgcctcccaggttcaagtgattctcctgcctcagcctcctgagtagctgagattacaggctactgttggcaaggctggtctcttaactcctgacctcaagtgatccgcccgccttggcctcccacagtgctaggattacaggtgtgagccaccgcacccagcccttcttgccctctccaccaagattcatttcacagtatccagtgtctccttgtttccctttctcccctttcacgtgaataatgtgctcagttcttaatctccacaaaaatcctgtgagagaggtacttttgttgtccccatttcacagatgacaaaacttagaaagttcatactaacagtctgtggcagagcaggggcttctgcacaggtttgtctgatcccagagcctgtgacctctcctcgctgtcgtcatcctctacactcagggtctatcttcttcacccttcagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtaggtgttggggactggcacagggttggacaaggcctggggttgggtggcttggggcagggcttttgaaccacgcatgttcactgtggaaatggagctggctagtcaagtggggagtggcctacatgagaatggactgcgaggccagacgttgcattaatgagggcatcctgggcacaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggtaaggctgggtctgaaagtctgcatggtccctgaaagacagaattaattggcggggccccaaagataatccacttccatgcccccatggtacttactggtggggagatgaaagcccacaggtagagctgaggcccagacccaggactctagcttcctcatgtgggcctgtccacgccactggctgcttccttgaatccgatgtcatcaagtgtctgtcctgggaagtgagtgggtcaaggatgtccctgggttgaggctgatccaggaggcctgctgtcttcacccatctccctgacttctgtctccccctcaccttgccagcactgcctcttccacacttcccagaggcttggatggggcaaggaggtgtggaggcagggattgtcgcatctcagagtttccaaggtacagaggagtgtagttgaaaaaacagattgtgggtttttgttgttgttgttgttgttgtttttgtattgttttgagatggagtttcactcttgttgcccaggctggagtgcaatagcgcaatcttggctcactgcaacctctgcctcccaagtttaagtgattctcctgcctcagcctcccaagtagctgggattacaggcatgcgccaccacgcctggctaattttgtatttttagtagagacggggtttcccctgttggtcaggctggtctcgaactcccgaccccaggtgatccacccgcctcagcctcccaaagtgctaggattacaggcgtgggccaccacacccggcctgatgggtgtttccttatcacatctattttgaaattttcatggagaatttcaaacacatgaaagtaatcagaattgggctgggcgcggtggctcatgcctgtaatcccagcactttgggatgccaagatgggcagatcacgacgtcaggagatcgagaccatactggctaacatggtgaaaccccgtctctactaaaaatacaaaaaattagccaagcgtggtggcgggtgcctgtagtcccagctactcgggaggctgaggcaggagaatggcttgaacccgggaggcggagcttgcagtgagccaagatcgcgccactgcactccagcctaggggacagagcgagactccatctcaaaaaaaaaaaaagaagtccgggcgcagtagctcatgcttgtaatcccagcactttgggaggccgaagcaggctgatcacctgaggggtcgggagttcgagaccggcctgaccaacatggagaaaccctgtctctattaaaattacaaaattagctggacatggtggtgcatgcctgtaatcccagctactcgggaggctgaggcaggagaattgtttgaacctgggaggcggaggttgcagtgagccgagatcgcgccattgcactccagcctgggcaacaagagcgaaactctgtctcaaaaaaaaaaaaaaaaaaaaaaaaaggaagtaatcagaatatcagaattatatttttttcttttcttttcttttcttttttttttttttttttttttttttttttttttttttttttttttttttgagacagagtcttgctctatcacccaggttggagtgcaatgacacaatctcggctcagtgcaacctctgcctctcgggctcaagcaattctccttcctcagcctcccgagtagctgggattacaggcatgcgccaccacacctggttaatttttgtatttttagtagagacggggtttcaccatgttggccaggctggttgtgaatttctgatctcaggtgatccgcccgtctgggcctcccagagtgctggattgcaggcttgagccgccacgtctggcctcttttcttttttctttgttttgagacggagtctcgctttgtcgcccaggctggagtgcagtggcgcgatctcggctcactgcaagctctgcctccctgattcacgccattctcctgcctctgtctcccgagtagctgggactacaggcgcccgctacaacgcccggctaattttttgtattttttggtagagacggcatttcaccgtgttagccggaatggtctcgatctcctgacctcgtgatcgcccgccttggcctcccaaagtgctgggattacaggcatgagccaccgcgcccggcctcttttcttttttaattagagacgagatcctgctctgtcacccaggccagagtgcaatggcatcgtcttagctcattacagcctcaacttcctgggctcaggtgatttcttccacctcagcctcgcaagtagctggtactagaggcttgtgccaccacgcccagctaatttttgtattttttgtagggacggggtttcaccgtgttgcccaagctggtcctgagctcaagcgatctgcccacctgggcctaccaaagtgctaggattactggcatgaattaccatgcctggcccagaatagtatattgagtgcccatttacttgccacacagtttcaatgattatcagcttgtggccagacttgtttatctctatttgcatccgctctctgactccttgattattttaatgcaagtcgcagaccataaatgatttcattcataagtatttgagtatgtggcctggctcctgcccacttctccatccccatctggtgccactgcccttctggatttcactggcacggggcaggcaggactggctgataagtgccctgtccctcccttctaggacaataacggtgtgattggactgttggagcccatgaagaagagcatggtgcctgtgcaggtgcagctggatgtgcctgtggtaaaggtggcctcaggtgggtctgggggcacttgctcagggcaggagttggaggaccttgttctggggctggcctagccttgggccttacagttgtggcctgcatcccttaccttttcatccttaggaaacgaccacttggtgatgctgacagctgatggtgacctctacaccttgggctgcggggaacagggccagctaggccgtgtgcctgagttatttgccaaccgtggtggccggcaaggcctcggtaagtggccttggtacctccagcagggcaaattggcaggccacccccacagtgaaggccaaaggcaggaaggatttgctgtggtcaggcttgcatcagatgggcttgtggtgttggttaggactttggagacagactgctctggtagttttgccacctactgtctatgggactctgaacatagtttcttcatcactaagtctacctacctgtaaacctacttcattaggttgctgtgaagttaaatgagttaatgagaagaatatcaggcagatggtaagttccacgtaaatgatacccgtaatgactgtgggaatctgagcaaggcacttgtattctcttgatctcagtttccttttctataaaatagggataagagtccctacttagcctctcaagggcttttataatggaggagaattaaactcggggcagagagaagccatgtgtgtctgtctgtcactgaccgtggctttccctttgcctgcagaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggtgagccccgagcccagcttcaggcatgacccagtggcctgcgttcctgtcctggctctgccactcattcattgtgcatcctttgcggggtcgtctaacccctccaagccagttttgtcatctgtaaagtgagaatgtccatatcctgatgggaggtggcctcactgtgggaggagattgagaagggcagctctcagaacaccttcacccctgatggctccggcctttcccccaggaactccgggcacagaatcttgcttcataccccagaacctaacatccttcaagaattccaccaagtcctgggtgggcttctctggtggccagcaccatacagtctgcatggattcggaaggtagggcctttacgtccttctctagtttgggggtggagtgttccctggcctaggcctagccagattcctgagaccatggtccttggagcctgggtctgttccatgggttgtaccatacatgggtccatgagagtcactctcatcctcctagagtcctggtgttcttccaagtgtgagttcaatgggggcccatgtagattctcctaggcctcctccaaaactgggaagagacactgcagatctccttctgatcgctctgggagcagggacacactcccatggacaggtggactcacctagcctgccacccattttgcctgtagcacgccctctgctattgctcatctctctccctcctcccataggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtgagtggggctgcctacactctgtctagttgggacctgggggtcatggttcttacccaattccccaataggctgtgatgtccactctcgggggagccgaggtacagagagcagtgtttgtgatggcactttgttcctgcttctcagaagctctggcattgatgaatatgaaatgagtacacaaattattttagtaaaggtgacttattatgcagaggagagaaatagcaaagagtgagatatcactgaggcctaaggaggcaatgggactggaacccaagtctccagactcctaacccaggctgctctctcccctcagggtgaccccttcatatatcaccttgtatgttcccgctttccagggacttttacttagaatctaaatcaagaaaaaaaaaggcttagtagtcagagttgtagcaactatagcagaggagggtgtgaacaagtgaccaccaaagcctgagtgggtgagggggatagccatggaggtcctgtagaagcctggagctggcagaggtgcttgacctgaggttatctgggaagacttcctcaggaagtggggcttgcactgtaccttgaaggttccattccttgtgaaaagcaaagaatgccattccaggcagaggaacatcagggcagtctcaaaggtggctggtcctgggaacagagggtggggtaggaccttgaatgccacgcctaggagcagcctttggcagtgtgtagggactgtgctctctggtttacagagttcttttttatccatcatctccttgggttctcccaacttccctgaactcccagagtctggtaccttgccaagctgctattggccaaggccacagtccacgcccatgtcccaggtttctcctgctacagaaaggtgggctggggatcctggagacagctgtacccatttctctctcttgcaggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggaca

SEQ ID NO: 8 - DNA, 8035 bp, Homo sapiens
aggtgatgtataagagcaatacttagaaacaatgtaaatgaataaaaagaatgcatttctttcaaataagtatgtatgtatatgatgtgcatctgtataccaatacatatgtatatatgtgtatattctaatacatatatatatatatgtatcgggcgaaccagcccccaatatttcaacagaggttcttttctattttccctaagtgtcagccattctaagaaattaagggaaagagtccaaaagagagaaattttaaagctggatgtctgggggagacatcacatgtcggcaggttccatcatgtcccctgagccgtaaaaccaataagtttttattagcaattttcaaagggaagggagtgtacgaatagggtgtggatcacagagatcacacatttcaagggcaacaaaagatcacaaggcagaaggtcagggcgagaccacgaggtcagggtgaaactagaattactaatgaagttccatgtaccactgtgcacacattgtcattgataaacatcttaacagggttcaagagcagagaaccggtctgactagaatttgccaggctggaatttcctaatcctagcaagcctgggggcactgcaggagactagggcgtgttttctccctatctacaactgcataaggcagacactcccagagcagccattttggagggcccccccccccccaccccaggaatgcattcttttcccagggctgttcattattaatattccttactggggaaagaattcagtgatatttctcttacctgtttttggcaataagagaaatatggctctgtcctgcctggctcccaggcagtcagacctaatggttatctcccttgttccctgaacgttgctgttatcctgttcttttttgaaggtgcccagatttcatattgttcaaacacacatgctttatgaacaattcgtgcagttaacgcaatcatcacagggtcctgaggtgacatacatcctcagcttacaaagatgatgggattaagagattaaagtaaagacagtcatagaaattataagagtattgattggggaagtgataaatgtccatgaaattttcacaatttatgttcttctgtcacggcttcagcaggtccctccgtttggggtccctgacttcccacaacatatatgtatatgtgtgcatacatatatacatatgaaggtacgtatacatatatagtatacatatattgtatgcattcttttcccagggctgttcattattaatattccttactggggaaataactcagtggtatttctcttacctgtttttggcaataagagaaatatggctctgtcctgcctggctcgcaggcagtcagacctaatggtatagatataggtatacaatatatgtatatgatgaaatatttgttgtcattaaaattatatttttgaaaactataatgatatataaaatgtttgtgggttattgctatatgaaaaaattgttttaaaaaacagcaaaaacccagagtatttttataatctaaattttatagtaaaagatatatgtgcaaacatgcatatacacaatatatgcatgtacactgctgagaccagttcagtctgggagaccctgacccagcagtgctagaggaattaaagacacacacacagaaatatagaggtgtgaagtgggaaatcaggggtctcacagccttcagagctgagagccctgaacagagatttacccacatgtttattaacagcaaaccagtcattagcattgtttctacagatattaaattaactaaaagtatcacttaatgggaaatgaagagatgggctgaattaaaggaataggttgggctagttaactgcagcaggagcatgtccttaaggcacagatcgctcatgctattgtttgtggcttaagaatgcctttaagtggttttccgccctgggcggcccagtgttccttgccctcattcctgtaaacccacaaccttccagcttgggcgttagggacattatgaacatgttacagtgctgcagagattttgtttatggccagttttggtgccagtttacggccagattttgggaggcctgctcccaacagtacacaaaatgagtaagtgtaatacatcatcatgttaacagtgattgtaactgaattgtgagaccacaggtgattttgttttctcctgtaggcttttctatattctctaaacttttttcagtcaatatatactactataaccagataaattaacagtaattgtgaaaaatatggcatccaaaactgtaaagaaatatgtttattgcaaggcaattaaaaacaagatcccaagtttaaactttcatatgctgtctcattgagctgcacatggaaaacacaactacaacaacagaaaatcttctgtgttaaaagtaagaaaatcttgtctcactgataaacataaatgtagataatttgaaaaggaacgtttactaggtgctggtcatttcactggcttcaattcatttgggacaattatcctgaaaacaaagtcttattagtcccattttactgacaaggaatgtgttcaagagattaaggaatttgcctaaagctgaattcaaatatagacccttctgaccttcaagatgcaccttgtccactacatgttgctgttcccatagttgacaggcaacatattaaataattatatttctaaatattaccagaggctatttgaaatctctaaaataaggcatcaggaaaaatggttctgtaaaactattttagatttcttgctggaaaattacaactacaggctcttactaagaaaatggcaccaaattacaaattcttttcaataagccagtctttaatagctctaagcactagactctttaatttgaatttggctgttatgacaaatacaataaattaagttgtgaaattaatcattttgtttttaatgaaaaaacataaatacagaagctttgctgtgtctatacatatggctggcaaggataatggtttatgttgaaaaatactactctgcaggaattcccactgctgtttatactgtaattcaatttgttctatttagctacaaaaatatgctagtctttcagataatcagtccactgttgaggttcacagcaggttaaaactgaaaccctttccacttaataaaaatgaaatctatgatctaatttttgttcccccattagttcgtaacataagaagcagagaatgctttatgaactggaccaattcaatgaaattgaatttacaaatacttactgagtaacttgatatgtatccagcagtctgccagatgttttacatttttcatttcattttttcctaataaagtttctatgctatagatcataaaattaaggatcagagacattacataatcttaaccaaggtcacatagccaagaaacagcagcaaaagaatttgaaccctcatcttcctgaaactaaatcctatgctattaacatgacacaaaaccatttctgatgttatcgtataatagaagactgattgtatacgaaaataaaatgatggaggtttgtacaagatgatgttgatgtggaagtggaagatgctggtgtgggaacactaggaagaatccttacaggggatgacatttaaatagctggtgtaatcattggtttcagaaggattttattgttaccctcttctaaagtagagactgtaatcctcatttgcataagatgaatgatactcaggttaatatgcatgatactgatattgatactaatacttatgatctgccaataaatcaagaaccccaaacctggttctttattcttaggccagtggagtgggtggggagagtccttataggctaccgagtagtcaaatgacatagtgagtgagtggatggataatgtcataattgggcatcttcaaaacaattgctaataagagaataacacagaatctcaatacttcagaaattacctctgtaacttctttgctaagaggtcatccaacatcttctcagacatttaaatcaagacctacaaaaccatttatgctactcttggacaagccgaaaataataattacaataaggaaaaaatagagaatatgatctaattcctcagttgagggaggggagattgaagctgcctgaaagaaatgacatttgagcagaagcttaaacaaggaagatttacatacacgaagatagggagcaggcagggattctgggcaaaatgaagaatatatttaaagacatgaaagaatgaaagtgaaaaattctggaactgggaaacaatcaagtagtttgagcttagcttatatgggagagtatgggaggaagaaacttgtactagtataccagagccagacgttagagagccttgaatgccaggtgagacttttataagttgtccctgccaggtgagtaaacaacgtccaaagagaaaaatactgcaaacagagcctttaaggagacggtagaggaaaaagaaccaaaggaggaacaggtagggatagactttgcagaagctaatggagaaaagtatgtcaagaaatatgtagtggtcaatagtaccacaacaatccacttaaaacatcgtttcttcttcctaaactcctcccttttctctttccctccactaccaaaatactgagtaatccacatttactattgcacttctttgatgccaatttgttccttaacccactgctttctccatcacatggagtctggcttctttctccatcacatcactgaaatgactgaaaatgtcacctgtaattttggttgtcaaaggcaatgctgtcctcatcctatttgatctttctgtggctctgttggccaaacttatatctctggttcaaacctcctgccacatttccagactcatatatccaactgccacctcaacatttccatgtggattcaaataaacttggccaaaaggaatggtttctcaaatatacccaggcaagttagatcagagcagatagtatccagggagaaacttgttgtcagcactggattagaggaatcaggagttcaggcactgtattagtccattctcacattgctataaagaactacctgagactaggtaatttatgaagaaaagaggttgaactgattcacagttctgcaggctgtacagaacgaatggctggggaggcctcaggaaacttacaatgatggcaaaaaaggggaagcaagcacctttcttcacatgtcagcagtagagagagagcaaagggggaagtgctgcacacttttaaacaaccagatctcatgagaactcgctatcccaagaacagcaaggggcaaatccaccctcatgatccagtcacctcctaccaggccactcctccaacacttaaaatcataactcaacatgagatttgggtggagacacagaaccaaaccatatcaggcatagccatatttgttggcatgcaacttacagaaacactttttaagtgcaataattcaggcaaacctcacaatcaccttggaatccaggggtcattatttccattttataggtgagcaaactgaggctcaatgaggtagagtggcaccattcatttattcattcatccatctaccaatccattcatccattctcttactatttatgagagcttgctatgtgctaggccctataacttagtcaaagttcctcggccagtcctggtagagtgggaattcaaaccccaggctgctcacctttaagtccaaggatcatttcctttccatacagttgtatggaggccatccaatcaggaccttttcagatttgcttgtggataaatgacacatatttataactggacagcagttacagcactgtatgtataataattggtactggataaatgtgtcaagtgaacaaatggatggatgaatatgaggataacaataatactgttcgtcctatcccataggattattatgagggccaaatgagattttagtggaaagggtcttgacaagcggctattttaatattcttttttattgtttgttgcctcaaatcctgtttggaaatagcaatgatgcaacaatctggtttgaatccccttctctatggaacaacagcatttggttataggttataaccttgtctgtttttgcttactgtctccttctcaagatataaacacctatatttttcatatccacatactaccaggtccacaaaaagggggctcaaaatctgtttcttgaataaatttatgatttccagttttatagattagggaatcaaagttcagaaggctaaatgaatagcataaagtcacctggtaattaagtggcagaactaaaatttgtactcaggtcttctgactctaatactttttacaatatacttttttgactgagtgttaggcctcactagcaatttagataataataaaacaataaaagttaggtacaacttgatcatttatgaggtacattcccatacattttctagctgactctcaaaacaacactgcaaacacaaattatagataaggaaatctaggcctgaagccctcaagatatgtaaaattgcctaggggcaaagaactaacaaattcagaagccaggcccttctccaggttcaacatctctggcttcttcaccttcatattcacacctttcttccatcaggctgccctgccccaggaaaacaacccaatctttttaagacagtgtattcacaactgtactcattgtgccaggacaggccagcacagaagaatatggcctttcaacttgcacagatttccagaagaagatattttgtcatctaaaaatgctgccaaggttccaggtacatgattggtgaggaaccaggccagttgacaaaatatttgacaaaattccaattgctggtgattctcaagttacaggagataaggacttcttggatgtgcccattggcctgcatgcagtataattgaaatagaatgtgcaggtgctgtcagggtaatatgacatgtatccagatctttttccttttcttttatttttaggcttaaagtctagtcctctttctttggcagtttttggagccatgtgactggcacaactctggcaaatactataaatgcaatgggattgtgatgaagggaaaattgccatcatgcaaaactagaattaaatatctgtactccttcttggggcttttaaaggtgggtgccatttcttagcattaagaaactgctttaattactgagatataaaatcaagagggaaactcagttttaatggaatttatatttaaacacaacaggaatgagcaggaacattaattggtactaaaaaaagaagatattattaatttcaccctactttgagttatattcagtgtaacaaacattgcaaatacaaagtaaattgtatttcttaagtgtaaatatccttaaatataaatattttgaattcaaatgaattagagactgaaaagtaatattttatgcattcattcattcatttatttatttattcaaaaaatatttattgaccatggactctggaaccaaagtctaggtgtaaatcaggtatctgccacttaatacccctattctattattttaaatcactatcattattgctaacacatgtcaggccctattctaaaaactaaatactaaatgagaatctgagtatgctctggaggaccccagaggagaagacatggtgcttatccttgcagaacttgaggtgacacccttgtaaattgtccctttattaaattatcctcaaattcctgccaagactctgacataagacataaggatagaatatataagaaaactgaagaggctagatataagaaaactgaagaggctagtgtggctagagtttatgagaaataagaagggaaagaaagataaagttggagagacaggcagagatcaaattatgcacagccttatagattatggtaacaagtttgaatgttactttaagtataataagaagtcactggaaatagagaaataaggagtagtatctgcatcagaatgtaacacgatgactatgaaaactgtgcagc

SEQ ID NO: 9 - DNA, 11540 bp, Homo sapiens
gcactgatttagttctgaacgagttcaatccttagactaggtcgacataatcttaagcatctgtggttctcgcctgtaatcccagcactttgggaggccgaggcaggcagatcacttgaggttgaggagtttgagaccagactggccaaaatggtgaaacctcgtctctactaaaaatacaaaaattagccaggcgtggtggtgtgtctgtaatcccagctacttgggaggctgaggcaagagaatttcttgaacccgggaggcagaggttgcagtgagccgagatcgggccactgccctccagcctgggcaacagagcaagagtccatctcaaaaagaaaaaaaaaaaaaaaagaatctgttattctctctgggtatagtggctcgcacatgtaatcccaactactcgtgaggctgaagggagaggttgcatggccagcggtttgaaaccagccttggtaacataatgagaccctgactctaagaaaaaaaaaaaaaagggccgagtgtggtggctcacacccgtaatcccagcatgttgggagatggaggcaggacgatcccttgtgcccaggagtttgagaccagactgggcaacatagtaagaccctgccctgtctctacaaaaataataaaaataaattagccaggcgtggtggtgtgcacctgtggtcccagttacttgggaggctgaggtgaaaggatcatttcggcctgagagttcgaggttgcagtgagccgtgatcacgccactgcactgaagttttagcacatagtctttgggatacctttctaaatttggcacaggctgtttctgacttccttctgaagttacatttggcctgtctaggcaagaatactctttttgttgtttgtttaaagaaagataatttggccaggtgcggtggctcacgcctgtaatcccagcactttgggaggccgaggtgggcggattgcctgagctgaggagttcaaaaccaccctgggcaacatggtgaaaccccatctctactaaacaccaaaaaattagccaagtgtggtggcatgcatctgtactcgggaggctgaggcaggagaattgcttgagcccaggaggcagaggttgcagtgagccaagattgtgccactgcactccacttgggtaacagagtgagactctgtctcaaaaaaaaaaaaaaaaaaaaagggagagagaactctaatactctaacactacctaaacagtttcatcagagtagcggcagagttttacacacaatagtgtgtaagaatctgtggtttcttacagattattacaaatacaaaaaaatgtctttttacatgcatttggaaaagcttcaaaagactaaggcaactatttgggatttgtttatctacattttattttgttttttaattgtttttaagagacgcagtcttgctatcttgccaggctggtcttgaactcctgggctcaagtgatccttatacctcggcctcccaaagtgtgggcattataggtgtgagtcacctcatccagccattatctacattttaaataaagactgtggttggaagcagaactcttttgtcttggaatacttgaggcagataatggggaaaagctcagaatgatggcagttgaaaaatattggagaagtattttattttactttatattttattattattattattttgagacagagtctcactctgtcgaccaggctggagtgcggtggtgtgatctcagcccacttcaacctcctcttgaacctgggagggttcaagcagttctcatgcctcaatctcccaagtagctgggattataggcatgtcccacctcgcccatctaatttttgtatttttagtagagatggggtttcgccatgttgaccagtactcctgacctcaagtgatcttcctgcctcagcctcccaaagtactgggattacaggcgtgagccactgcgcccggcatggagaagtatattaatgacatttttgagaattttgtttgttttggcttcctattaggctggagataattatcattcatctttaatttttaccataatttttttttttttgagatgtagtcttgctctgtcacccaggctggagtgcagtggcgcgatcttggctcactacaacctccgcatccccggtgcaagcgattctcctgcctcagccttccgagtagctgggactacaggtgtgcaccaccatgtctggctttttttttttttttgagtcggaatttcgctcttgttgcccaggctggagtgcaatggcatgatctcggctcaccgcaacctccacctcctgagttcaatcattttttgtatttttagtagagacagagtttcaccatgttagccaaggtggtctcgatctcctgatctcatgatcgcccgcctcggcctcccaaagtgctgggattacaggcgtgagccaccacgcccggccaaccatcagtcatttctcataggaaacctgtcccttacctaccgtccagttacaagcaaaatgtttaacttgtgttctgcagagaagtgttcaaatgacatgaaaagactgaaaacagaaatcagtacgcaatttttcatagtattagtggcattcagccttatcttgcagagtcctgatttgtatataccctggaaaatagaataagcaaacattcctctcttttgtgttgatttggcttgttgataggatttctctgcttatagattttttgtttgtttgttttttgagacagagtctcattctgtcgccaggctggagtgcagtggcacgatctcggctcactgcagcctctgcctcccgggttcaagcaattctctgcctcagcctccctagtagctgggattacaaggtgcccacaacaacacccagctaattttttgtatttttagtagagacggggtttcaccatcttggccaggctgatcttgaactcctgaccccgtgatccacctgcctcggcctcccaaagtgctggtattacaggcatgagccaccgcgcccggccggcttataggtattttaaaatattttgaaatgtgatttagtctaggttgtctgctttagggtgagacttttgagatttctttctctccttacccacctacctgcaactttgtttttgttttgttttttgtttttgtggaggcaggatctcactctgttgcccaggctggagtgcgctggtcactgcagccttgaactcctgggctcaagtgatcctcccttctcagcctcccaagtagctgagactacaggcacagaccaccatgcctggcaaattaaaaaaaaaaaaaaattgtagagttgcagtgtggccacgttgccgaggctgatctccaactcctggcctcaaatgattttttccggcctgggcttcccaaagtgctagaattatagatgtgtgccactgcacctggtccttccccttcttcttaaagtatcttgttattcccatatagaaggtatatcttttttttttttttttttacttgaaaactagtgagggccaggcatagtggctcacacctgcaatcccagcactttgggaagccaaggcaggaagatcacttgaggccaggagttagagaccagcctaggcaacatagccagaccccatctctataaaaataaaatatagccacgaggtggttgcacgtgcctgtagtcccagctgctcaggaggctgaggcaggaggattgcttgagcctaggagttagaggctgcagtgagctatgatcgccactgcactccagcctgggcaacagactgagacccgatctcacaaaataataaagtagtgaggaaatactgaagaattttaagcaaggcttcagtggagaaaatgtttaagtctggatgctggtagatcatttattttaatttgggttcaagatgatagtgtcctggaacagaagctgattacacgttctgaccgtcatttctcatagtgtctataacataggcaaaataatagctccagtgtccacaggcacgcctatggaaagaagggcatctggaccatgtcacacactccttcctctccagtacccagcctgcttcctagtccacagctcttccagtagtggttgtgccggggagcattgagaagatctggggagcacagtggggcaggtcaaatactattggagtgacattgcactctagaaaaggagccctgaaatcccacaagtaaaaaggcaggcaggccagtagagaccaccccagtcttattcaccactatagactctgtgtagtgtgggcgtgtggaagcatgtcatatgcttcttgaatgactgagtttaggagtgctttggcgtcttcattaagtagtatggctgtgcaggtggctcacgcttgtaatcccaatactttgggaggccaaggcgggaggatcacttgagcccaggaaagaccagctctggcaacatagcgagaccctgtctctacaaaatataaaagccaggtactgtggcttgcacctgtaatcccaactacttgggaggctgaagtgggaggatcgcttgaatacgggaggttgaggctgcaatgagctgtgattgtgccactgtactccagcctaggtggcagagcaagaccctgtctcaagaaaaataaaaaataacaaacttgaggcagagcatggtggctcacacttgtaatcctggcatttgggaggctgagacaggaagatcgcttgagcccaggagttcaagaccagcctgggcaccataggaaggcttatctctaccaataaaataatttctttttttaattaaccaggcaatgggcatgtatggtcccagctgcttggaaggctgaggcaggaggatcacatgaggccaaaagttcaaggctgcagtgagctgtgatcttgccattgcactccagcctgggcaacagagtgagagcttgtctcaaaaaaaaaaaaaaaaaaaaaaaagaaagaaagaggaaataaaatttaaaggaatttatatgagtctgtacctctctctctctttttttagacaatatctcactgtatcacccaggctggagtgcagtggtgcgatcatagctccctgcagccttgaacacctgggctcaagtgatcctttcgcctcagcctcctatgtggctaggactacaggcatgtgccacagtgccaggtttttttttttgttttgtttgtttgtttgtttgtttgtttgtggaggtggtctcactgtgtcatctaagctggtctcaaactcctgggctcaagcagtcttcccacctcagcctccaaaagtgctgatattacaggcatgagccaccatatccagcctatgtgattctcttgactgtactttaagttccttgattataaggtcagggactataacagtttgttcaccattgtattcacagggcctggtacatagtaggtgctcactaactattcggttaaatgggtgcaactctgttgttgctttaaagattttggttgcaagaaaagtgaaaatgagggacgggcgtggtagctcacgcctgtaatcccagcactttgggaggccaaggcgggcggatcacgaggtcaggagatcgataccatccttgctaacacggtgaaaccccgtctctactaaaaatacaaaaaattagccaggcgtggtggcgggcacctatagttccagctgcttgggaggctgaggcaggagaattgcttgaacccgggaggcggaggttgcagtgagctgagatcgcgccactgcactccagcctgggtgacagagcgagactccgtctcaaaaaaaaaaaaaaaaaagaaaagtgaaaatgatagccaaaatgaactaatcaattacatagacatttaacttaagttattctataactactggatattgagagttacatttaagtatttttaaatctcttttagctccaaaagattcaggctttttaagtattttcagcatgcaaaataattaatataatacacatgttataaaaataataaaacaaatactcatgtatccattatccagtgttagttaatagcttattatcagtttccttgtgtgcctgcccccatctttttcctttctccctaagagtaaccattattctatttgttgttcttatcattctcttgcctttttgtttcagttttcctatatatatatcccccaaataatcaatgaagttttttggttttttattttacatgtcatactatgctagatgtagtgttcactcagtatgcatttttgagatccatattgatgaatgtaatggtaatttgttctttgtattgctttccagtattccattctatgactgtatctatccaatgttctgtcaatggacatacggacatttgttttttttacagtctttttataatttgtactctgctaatatgagcatctttatttctatttctcagtgtacatgtagaagtttttttctttctctctctctctgtcttttttttttttttttttgttagagacagggtttcaccatgttggccaggctggtctcgaaatcctgacctcaggtgatccacccgcctcggcctccctaagtgctgggattacaggcgtgagccaccatgcctggccctgatttttttatttttgtaataaggtggcttcaaatggtatctcattttcatggttttaattagcattaccctgatttgtaatgaggttgaaaaatattttcatgggtttgctagccatttgtgtttcttttctgtgaaatgcttgtttgtgtcttttgctcattgttctttattaggctgtaggcatgctttatatgttctagatattactccatattattaacccataataatccattgtcagtttcccatgttgcaaatattttttcccatttgtgctttacctttcactttttttttttaagagtacaaggacaatgctgaaaggaataacaaggcttatctctaggatccataaggtgagtctggactgacggctgatctgaacactttgtgcatactgccttttattattatttttttaactcagtcttgctctgtcaccctggctggagcgcagtggcgcaatctcggcttgctgcaacctctgccttccaggttcaagcaattctcatgcctcagcctcccaagtagctgggattacagatgaacactatcatacctgtcaaatctttgtatttttaggagagatggggttttgccatattgggcaggctggtctcaaactcctggcctcaagttatccacctgcctcagtcccccaaagtgctgggattacaagcatgagccactatacccagccttgaatactgtctttaagtagatttcttctttttagatggattcatggtatctagagtcaaatgctctggagaactttgtctataacaagtttcagtagaataactgtgtttggccgggcgccgtggctcacgcttgtaatcccagcactttgagagggtgaggcgggaggatcacctgaggtaggagttcgagaccagcatagccaacatggggaaaccccgtctctactaaaaatacaaaattagccgggcgtggtggcacgcgctggtaatcccaactactccagaggctgaagcaggagaatccgttcaacccgggaggtggaggttgcggtgagccgaaattgtgctgctgcactgaagcctggacaacaaagtgagactacgtctcaaaaaaaaaaaaaaaaaaaaaaggccgggcgtggtggctcacgcctgtaatcccagcactttgggaggccgaggcgggtggatcacgaggtcaggagatcgagaccatcctggctaacacggtgaaaccccgtctctactgaaaatacaaaaaaattagccgggcgtggtggcgggcgcctatagtcccagctacttgggaggctgaggcaggagaatggcgtgaacccgggaggcggagcttgcagtgagccgagatcgcgccactgcactccagcctgggcgacagagcgagactccgtctcagaaaaaaaaaaaaaaaaaaaggaataactgtgcttgagaatttaccatgggataggataattaatatttttccataacacataactaagattgactgtaatttttattaactttatttctctagttgaattaatgataattctcctttaatgaagtatcgaaaataacaactagttgccaggtgggcgcggtggctcacacctgtaatcccagcactttgggaggccgaggtgggtggatcacttgaggccaggagttcgagaccagcctggccaaaatggtgaaaccccgtctctactaaaaaaaatacaaacattagccaggcgtggtgccaggcgcctgtaatctcagctactcgggaggctgtggcaggagaatcgctttagcctgggaggcggaggttgcagtgagccgtgactgagccactgcactccagcctggcaacagagtgagactgtgtctcaaaaaaaaaaaaaaaaaaagttgccaatttacaattttagcatctaaaatgattaaaaaacaaaattgtacgtgaaaaagaccattctgctggtttacttcattttttcatttatttaccaaatagtttttcagtaccttctatatggcaggtactcagaattctaagatgcctcatttcactaataatagttattatttgttgggtattattatgtgccaggtactacactaagtgctttatttttttaatcctcatgatcaactcatgaacgagataatatccttgtttcacagatggagaaactaaagatgagactggctaggtaacttacctgaggaaatagcctgtgaggttgcaaagcccgcacgagatgccaggtctgtctgacttcaaagcctgtggcctaaacactgtgctctattgcattttatggtccatgttctccagaagcttacagtccagtagaatcatgaaaaaatgactatttcagtatggtgctcttacagcaccaaagaggagcacctgagcgggattagtcgagtcagcaggagatcctgaaaggctcagaactgagccagaaagacttggtcattttcagctgattatttaattacagattagatttcctagaaaaggagcccttcctcctatatggctctccctgcatgtgcccccttccctcaggcctatatattaatacataaaataacccattattataaaatgaaacgaaagcaaggatcagcagagggatggattctggactcaactgatcatattacaaggctaaaataaatttcctctcggccgggcacggtagctcatgcctgtaatcccagcactttgggaggccaaggcggacagatcacctgaggtcgggagtttgagaccagcctggccaacatagtgaaaccccgtctctactaaaaatacaaaaattagctgcgtgtggtggcacacacctgtaatcccagctactcgggaggctgaggtaagagaatcgcttgaacccaagaggtggaggttgcagtgagccgagatcatgccactgcactctagcctgggcaatagagcgagactccatctcaaaaaaaaaaaaatttactctttcttaataacagatgagaaagacctgaggccagactgctgttggtaagagaaagttttggtgtttttttttttattagtttggttcagggtgactgtattagtcagggttctctacagggatagcactaataggatagaagtatatatgaaggagagtttgttaaggagtattgagtcacaccatctggcgaagtcccacagtaggccgtgagcaagctgaggagcaagtaagccagtccaagtcccaaaacttcaaaagtagggaagctgacagtgcagccttcagtctgtggctaaaggcctgagagcccctggcaaatcactgttgtaagtccaagggtccaaaagctgaagaacttggagtccagtgttcgagggcgggaagcatctagctcaggagaaagatgaaggctggaagacccagcaagtcggctcatcctaccttcttctgcctgctttattctagctgccctggcaggtgattagatggtgtccacccacactgagggtgggtctgcgtctcccagtccactgactcaaatgttaatctcctttggcaacaccctcacagacacacccaggaacaatactttacagcctttaatccaatcaagttgacacttaatttttttttttttcactaacaaaacatgctttatttggtaaaaatgtgagtgtaaagggggtgaggcggggcgggcaggacagaagggtgcagtgttggaggtgggggcgggggtctacatagctgggacctgaccctgcaaggtggacatccaggacggaggagccagaggtcagaagttccggaggtaggcagtcctttgttaacagatcacttgcttttccatgggtgaagagaggagctccagaggcctgagtacgatggggggcagctgtccagcgacatctagggaaacccagcccccagcagcagcaggaactcttggggacagtctgtcttgttgcaaaggccagcacagcaagcagcctccacattagttccacagcttgactggcttctaaaatgggcatgtcaagatccagaatctcaaagcatcccctctttggctccatcatccaagggtgagaaacagcagaacctaagtgggagtctgagtcatcttcttggttcagtttttaaatgaattttaaataccctcagtcaaaagaaaaatagaaggaggcagaaacaaaagatatgaacccatcccaaagctgttgggcactgccacttctggatggctctagtgccagcggagcccccattcacttccatgtcagacgtaattcttggtagggtactcagaggtcccccgagagatggcaggggcagatgtccagtagcgggccatgtaatggctggggccccgtgaccccccggaggggcaagtgcagcacagcagcctgccacccagcaacaaaaggcctgaggccgcccagcccaagtagagggaggcccccagctcccacttttgggcctcagccaccagggggttatagaagtcccagatgatggcatgcgccgtccagcaaacggggattagtgtcaggacccctgaggtgacaaagacaatcccagaggtgagcaccaggcgggccttggaatccttctcctccacacaggtggtacacttggccccagcaaggtagaccagcaagccgaacagggccacaaggagggtgatgacacagacggcacgtgcagcctgcaggtcctgtggcagcgccagcagtgagtcgtacaccttgcactgcatctggctagtgctctgcaccactcaggacatccacaggccctcccacaccacctggccaccacgatgctgttgccgatgaaagtggtcactttccacatgggcaggacgcaggagaccaggccattcacccagcccagcagtgtcaggacgactcccaggatctgcattctggcagaggccatggtgagattgaaggagctgca

SEQ ID NO: 10 - DNA, 3087 bp, Homo sapiens
tgaaacatatatagtctgtcttcttggaaaagcatacaaacaatgagactccagatccagatttctttttttttttgagacagagtcttactctgtcacccaggcaggagtgtggtggtgtgatcttcgctcactgcaacctctgcctcctgagttcaagcaattctcctgcctcagccttcggagtagctgggattacaggcaagcaccactacgcctggctaatttttgtattcagatccagatttctaaatgtctttctccagttaaaaaaaaaatagggctcctgggagaaatggctgatttctgggctagggtagggaaagtaaaagatgaacctggaaatatcttgtggtatcacaaattaagtgttctgaaaataagtgctgaaaaaattattgtgacatgtcaaatggattcagaagccaacatgaacaagctcccactgaccaaatctgaaacaattacagcaaataaataaataaataacgatggcaatggatcatagcacatagaataaaataagaatttgagtccatactgatataattgaataataaagagaagaaagacaccttctttatagcaagattccaattacctacatgtagtaaaaatgatgcaattagaaagtcagcatttggcaaccatcacagtaataattatttcaggcaagaatcaatgaatgctaaatcagtaaaagtctgatgagaaataattatatactcttcaattttttctccacaaaatacttaattgcaaataataactttgcggaagaaaaacctgacagacactattttagccaagtgatcaaaactaacatcactgatattgggacaaataacacctagttcctcctgataggatacattgaaaagaactctgtcatttctgtgtgattgttgccaaaaatcataatctgaatcaaaatatgaggaagtatccgaaaaaagacaacttgaccgtcatcctacaaaatacctcttccagagtggaaaggtagtgaaaatcaagtagaagaagggaaatagaaatttaaaaaattaagaaatgaaataataaaggtaagtgtaaaaattaaaatagaaaacaaaaataatagtgaaaatgaaatcaaaagctgggtctttaaaaaaaataaaattgataaacttccatttagatgggtaaagaataaagagataagacagaaattgccacccatgaacttttagtaatgcaacagaatacatcactcactgcagagcataatcattggaagaaaaatatgagaatatggcaggcaactttatgccaataaattcaataaactggggatcacgattatgatcaacattcacttttgaaagggccatggaggaaaatgaaccaggaagatcctccctggggcagagctaccactggatgaaatgaacaattcattgaaagacacaaattaccaaaactaacccaataagcaatataaaacttgaattgccctattaattcaagaaattgcatttttaattaaaaatctttccaaaaagaaaaattcatgcctaaatggcttcacttgtaaactctagcatttaaggaagaaataaaaccaattgtacacaaactctttgagaaaatagaaaatacttccaaactcatttcatgaggccaaatatattaaaaaactacagacaaatatccctcatgaatatagacacaaatatacttaacaaaattttaacaaaacaaattagtatatgtaaaagaatacttactatacatcatgatggaatgaggtttatctggggagtgaaaggttggtttgacatccaaaaattaatcaatgtaattcaccatattagaataaagaagaaaatataatcatttcaataaatgcaggaaaagctttttgtaaagttcaacactaatttgtgatttcaaaaaatctatcagcaaactaagaataaaagaaacatttctcttaatctaattaagggcatcttcaaaaacctacatctttcactgtactcaatattgaaagcctcaatgctttctacctaagataaggaacaaggcagggatatctattctgccatttctgttcaacattatactggaagttttagccagtgcagtaaggcaagaaaaagaaatgacagtcaataaattggaaagggagaagaaagtcgtttttattggtagatgacatgaccaagtattaatacatagaaagcttaaagagtctactagaactaataagtgaatttattgaggtcagaatacaatgttaatgtataaaaattataattttatgtattagcaatgaacaattagaaaatgaatttcgaaaacaacttcatttccaacagcatccaaaaacatgttagagataaattttacaaaacatggaagatagtttcttttcctgtgcagaagcgctttagtttaattagatcccatttttcataaaaaaagaatgagatcatgtcctttgcagggacatgaatgaagctggaagccaacattctcagcaaactaacacaggaacggaaaaccaaacaccacatgttttcactcataagtgggagttcaacaatgagaacagatggacacagggaggggaacatcacacaccagggcctgtcagggagtggggggcaaggagaaggagagcattaggacaaatacctaatacatgcggggcttaaaacctagatgacaggttgatggctgcagcaaaccaccatggcacatatatgcctatgtaacaaacctgcatgttctgcacatgtatcccagaacttaaagtaacattttttaaaaacggaagaattctatttaaaaaaaaaaaactataaattttgctgagagaaattacagacttaagtaaatgttattaacatcattttcgtgggttggaacactcaatattgttaagatagcaattctccacacatcaatttataactccaatagatatttttaaaaagtgattccaaatttatattaaaatgaattgcctctcttaaacctcccttataatttttttaaaagatttcagaagactaaacactatattacacagactccattgaagctaggagtcta

SEQ ID NO: 11 - DNA, 1967 bp, Homo sapiens
gacttttaggaaaagactttgaactaggacctatatagtatcgactagtcatagccctcatgttatctaaattatagtatagtgggtgaaactgattatttttacctgttagtcaaggttaaagtaaaaattctatattgtttgttatgcttttacaatgcaattttaaatctttcttggaagggcttaagcatgaacaaactgacaaagaatgtgtaataatgatcacaaaagatatatcaaaaattaatataattagaaatatttctattgtcattaataataatatccttatttttatttgtttaaatttatttaagtgtatttacttatttgagacaaggtcttgttctgttgcccaagcgtgagtactcacaactcatagcttaatgacagctcactgcaccctcaaactcctgggctcaagcaattcccctgcctctgctgctggagcagctaggactacaggtgtgtaccaccatgcccagttacttcttaaaagtttgtatagagctggggtcctgctatgttgcatgcactggtcttgagcttccagcctcaagtaatcttcccacctcagcctccccaagtactgggattacaggcatgagctacagtgtccagccactcttgttctttatagcctaccttatggcttgcttttcataaacaatgtgcctagagtgaagaaacatcattattctcaaataatagtgaagaaactaacactcactgaggtgagggcacatgccctagactataggaatggaattaagctaactttgaaccaaaattgtccaatttaccacctagtactttttcccctacagggagactgcaaaaaaaaaaaaaaaagatgatatatcaaaacaaatgttttctgtatttggggatttgtcccaggagatgatggcctgaatctagaatacactctaggaaaatcttcagccaaggatactctagaccttgcctgtaacttctgggtagcatgcgggctattttaagtatatgcaatgcagggcatggcagcactaaacagggttaccagcacatattatagaaggactaacaagaataacaaacggctcccctactaatcattacagcaaaagaaggctaacatttacaaagtgtactggagaggagtaaacactccgcgatgagaatatgtgaaagaacttgggggaaaattagagaacttaggctatctttcctttgaaagcagacataaatctaaatacgtgattacatctttaaaccacaaaggttttgtttaaaaaaaaaatagccaaagataaaccatagagaagtacaaggcttgtctttctgttgaggatttgccttcctagaggaatccgtacacgtgtgttgcagggaagatgctaaccttacagctgccagcattgcattaagtagtgaataaagacatagacttcagttagtttcgaagcgatctcactatatttttaagtaagagcagcaaatatatttctctatgaaatgacagaatgaaaattatactgtttagaaatatatacatacacatatagttgtatgtatgacattagcaattatgtttttaacgtaaaactaaacaatataattgttttaaatcttcattgtaaacaattttttcctagttaaagccattctgcattgataattaagaatttagaattattggtctattagaataataatacttctaattattaaatacataaattctcatttctggtatacactactaataaaagatctaaatgctttcacaaaaaagattaatcactaaataattcaaaaacaaatacagcaacaacttttttcataccactccatggtaatactattttttttaagtaaagaactaaaaattaaccagctcagaatgatgcccaatagtgatagtaaagaatttcactttgccgtccagttttagtaacaagctgtgagtggcctctactggc

SEQ ID NO: 12 - DNA, 3164 bp, Homo sapiens
tcaataaccctaacactaaatgtcgacacttatgctagtttagaaaatccttgactcacctatttaaattattaatcaaaagtaaattttttctctctttttgaaaaaggtagggtgggatagggaagaattatcttattctgaaacatgtaaatgattaattacaactttacattaatattaggcaataaataggaaacaccattctctagggaaaaaaaaaaggctgggagaaaactacagagaacatgagcttagaaatcaaggctatgaatttggtagctaattccagttatattcattagctataggacattggacaaattacctatcttctgattctgtttattcatcataaaaatctgcataatttctaccttgaaaagatttttctgaggatgagtgggtacttaatgttcaaggtaagttatttcatgtttcaacgacctctacccacaaataagagaaactggtcaccaaaagatcccaaataattctgcttttaagatataaccatactgggaatcttgagggtattatagttaaaggccttcaatctttctgaggtcatgaagcactctgaatgtcgggaaaaggaaggctagcagacatatataaattgctgcatacaatttcagtaagttcatggactccttgaagactctatggagctaaaaaaaaattttaaatcccaaattaaaaaaaattaatgctatgtatctgacctatttccaccttaaaaatatacatatgtaaagttaaaaagattaaataatccttccccgttaaaactggaaaggaagcaaaagctccactaacttgtattcaatcacgggtgctcctggcagcttctactttgtcacctttgttaccataggaactttcaggaagttttctttcctctttaccatggtttgctcaaaatcaaaccgtgaatggctttaagaaaaaaaaagtctaaccctagtttccaaattagtgatttaataaggcaagctcatttattattaaatctgaagaccatgcttctgatttttttgctacttcatttaatgacttcatgagtcattcaaacttttccttacattctaattgctttcaaaatgtaaactattaaaaagctgcctataggaaataaagtcagtttaaaacaaaacaaaaaatttagaatctaataagtaattcattatagctcttgtcaatatgcatatattcaaatgcattaggcaaacagtaagtaggaaatgagtcttatttaatgtttatattaacatacagtaactgttcaataaaaatttactgaacatataacctgaattcctataacaggaatgagaatgaagacaactgaatattaattagaagcatactgcttgacacataacagattttaaaaaataatctgccagatgagcaaaccaatgaatgactaaatgactgaacaaaaaacaaaagaaaaacataatgactaaaacttttagacaatccatattccaaattttctgctacattaacaagccagacactctaggcttttagctaagtaaatgtgaagttaaggaaaaattatcaaagacaacgtaaaggcttccagcttgacataaatatggatgctaagaagctataacaaatttaatgaattacttgaacaaaatcatactgtttattgctttgattcttaattgttgaaacaaaaacctgactcaaacctgccagtatgcaactaagttcaagactaacaaactccaaaaaacaagcaattcaaaaaaatgcacaccatttactatgcagttttctggatttcaataaaatcaaaatacctaataggaatgaaaatgcagaaacaaaagtccagagtcaatatagtttattttaatggcttttttttaagcaaagccacataataaagttaaaaaaaaaaaaaaaagaataccatagttgaatacagaaattatccacatttacccatttggtgcctaaaaattgaaacagcaacgtccacactggagaagttgaaaaagtcaagatgggagctaaataagtcagaaaatccagactggttaacaaatttgggcatctaactgctaggttacatattccttgagatattatatctcattcagacacataggcaacatataaaagtggttaagaattttgggggggtatactggaatcatcctgcaaatatgatacttaggccagttacttaaaccatctttgcttctgtgtcaccttatctaaaatgcaaagaatgatacacctacctcaaaagatttacatgagatgacacatatttgtaaaacctggcacctaattaactgcttagtagcagtattcccagtgggactggaatttattactgggatcaaacatacttatatagtaaatatctgttcaattaatgaagaagaaaattccattaagaaatctggaatttttacattccagatagtcatacagatagtcatacagatagactagaaaataaagatccagttttctggaacatattcattctgacagaacaggaatgactttagaatttcattcaaaaatactaagtgctaccactttgttatactctggtgccataagaaatggtgagttgtatgacaagcgagcctttaaagagaattgaaggaggtttctctcagtacctaaccatgattttaaaggtaaaagaagttgagagaatcaatcacattctgatgtagtcacctaccctacaaatcaatagcaccctaggaagagcagaccaatctacataggacattttgtctccctgacttaaccaagataatgaacagtgaaacattaagacaggtatccttgagagggaactgtggggtgatggacaaatccattatcttgttttgtgtggtgtttacataagtatatgcaattgccaaaactaataaaattaagcctgtaaaaattgtgcatttcattctatgctagttataccattaaaaactggttcatttaaaaaatgctccctacttttctcactggaaaatgtaataatttacaaatagtataatcaaatctatattcactataaaattaactacaggatgatcaggtccaactagaaatattttggataaggtattcttttaacttttcagtgataggtgatggaaaagcaattatctgagatc

SEQ ID NO: 13 - DNA, 3416 bp, Homo sapiens
ctatatgtttcagggagaaattcacctactgttccttgcagggcacgtccttggcatatgcaccaggagctctagctcccagaacaggaaccatcatcagaagcagagctggaaaggcaggcagccttttccggttcaaactggtttgaagcagaggtcagagctgctgcttgtgtttggctttgggttttgtgttttagcatgagcgttctgcagccagccagactctgggctactcccctctctccactgacatggaaaagatgtctgtgtgttgtgcggagcccccggctggggcttctgacttccatgttggggcctgagctgccgctgatgtggcgtcccaacctgtactggacaaccatgtgtcatggcctcaggcttgcctccaccccactgtgtaaaccagcaagggcacagaagtccaacccaactctgtggagccactactgtcaccacaaaggggtcccaatccagaccctaagagcgggttcttggacctcgcacaagaaggaattgggagccagtccacagagtaaagtgaaagcaagtttatcaggaaagtaaaggaataaagaatggctactccataggcagagcgcaggggcatgggctgctcaactgattatacttatagttatttcttgattatatgctaaacaaggggtggattattcatgaacttcccaggaaagacatgggcaactcccagaactcagagctcttctcccttatagaccatatatggtaacttcctgatgttgccatggcatttgtaaactgtcgtggcactagtgggagtgtattttagccggctaacacattacaattagcatataatgagcagtgaggatgaccagaggtcactcttgtcgccatcttggttttggtgggttttgcccaggttcttcactgcaacctgttttattttttgtttttcatttattttttcttttctatgtcccccccattcacaatacagaccaggcacagggcctgggctgaggtgtatattaggtaggtttactctagctcctctttctgtacagccagtgtaagaacgcagcctgtgggtaagtaccaggaggcctaccgcaacgtgttttatcagcaaggtctttgtgacctgtaccttgtgtcgacctcctatctcatcctgtgacttagaatgcctaaccgccagagaatgcagtccagcaggtctcagccttattttacccagctcctcctcaagatggagtcactctggttcaaatgcctctgacactacttgaagatgtgtagtccaggagcacatttcacattttacaaagccatttcccattccttggtgccttggcctccctcccttgggtcatctgagagagagccctcagggggaaaggaactcagagaggttgggtgtctgctcaggtgatgccgatagcgtatgctgagctgggccagcaccggtgggctccgactgatggctgcgatggctttctttatttgtgtgggcagagtggtcagtcagtgggaggatgatgatgagggtgaggacatgacaacgaagtaacatgcccatcacttcttgaggagctacctcaccagaggccctttgcacacattgcctcttttaatccaagcgagacatgattcatatgcacattttacaaattagaaaattgggaccctggattggggcctaatcagggttgctaaagggaatgctttaagtttgctaatgaggaggagggaacagcgagtgggggaggaggaaagcagctgttttttgggtttttttgagacaaggtctggctctgtcacccaggctggagtacagtggcatgatctggactcactgcaacctccacctcccggattcaagccattctcccaccccagcctcccaagtagctgggactacaggcatgcgccaccaggcttggctaatttctgtaattttagtagagatggggtttcaccatgttgcccaggctggtctcaaactcctgggctcaagtgatccacctgcctcggcctcccaaagtggtggggttacaggcattgagttttcttttttttttttttttttttttttgagagcatccaatgttagctcatttaaggctctcgacccccccaagaggtagttcgtaggtcaagctgtctactttatagaagagcctgggagtccagggttatctgacttggagtcctgttcattttcctgggtacctccaaaggccgctcggtgagtggacagtgcagttctggagccctcccctggcaagtcccgctccggcccataccccgccctgttccccagcagccacggtcgggtagaggggtcagggaagcagggcaagagggtaaggcactgctcaagaaacaaaaccaggtccttaacgtccctagtcctgccgggcagtgtcccaggaccccggccttgagattagagagaggcagagggcatacggaatgggaaatagaagaaaatgtaccaggacatgcttcctgtcttatgcttagactgccatgacgaaataccacagactgggtggcttcaacaacagaaagttatttctcagagttccgaaggctggaagttcaagatcaaggcactgctggctgattccttttctggtaagggcccactttctggcttgtagacagtcacctttgtgctgtgttctcgcatggcctttccttggtgcatggagagggagaaagatttttctctcttcctttctaagaccaccaatcctatgacttacaactcctttaacgttaagtacctcctaaaagtcctatctccaaatacaattacattagaggttagggcttcaacaaaggaattggggtggtggtggtccacagcaggggaggggatattttagtttatcttgagcttgcaaggatgaaggggaaagagcgggggtgggggggtggcatcggaacctgcctctgagtcacacttcctggatgagccatgggccacagcatctgtatcaggagtggttacaaaacagcgtgcctcagggataaacaagctgacctaatgatccaattttcccagctctggtccatctacagatttgaggcaggatccagtgattctgctggctgactggtcatggtaaatttccaactctcccctttccaggcacggctttggtttcctgctgcagctgctgctggggagttatcagggcatttcctccgcctgtgagctcctggggtcaggggaaggttgggtggccagagatgctgcctctaccctaagtcagcgtcacccatgctattcccagcagctgcatttctccactctgtaattacaaatgaaactggggaatagaatcaaaagagtacctagaaacaagctagcctctacttcctcaaacattctggggcaggagtttgtgcgctggaacaat

SEQ ID NO: 14 - DNA, 5608 bp, Homo sapiens
tgtatcatcaaagttagttgtatgtgtgaaagagaaactttggattctaggtggacaacccactagatctttgagaaaatatctataaatggagaataagaacattagttactgttttgcaggctggaaatgtggccccattccctctctaatcttctgctaagccaggcaggacttcaagatcaaggcctaggtaaaaagtaggcctcccaggtactttaccctcagggtcacactttgattttaccctaggaagggtaaataaaaagaaagggaaaccaagagaaaaagagccctttatctataaatcctgaccaagagtttctcctcggctgaactttagtcatgctcctctgacggtcctctgcactaggccttggccctgtccttgctgggcctgcatagcccagtttcagtgagaatcctgctcagtgactgtagtgataccctcacacccttgatagctggcttcttcatcctccacccacagtgtctaagtccttgggttgcctttagcaacaatcctattaagtttgtttagcaagaatcctcttatctgctcttagtaattttccatccattgaccccctcactctgctccttggctaaaaattcccacttgtccttgttggattgagggttgagcccaacctctctccccaactcccagactccattgcagcagttccccagaataaagtctgtcttactgttctttagcacaggtcagaataattttttcttttttttcttgttttttgagacagagtcttgctttgttgcccaggctggagtgcagtggtgcagtctcagctcactgcaacctctgcctcctgggttcaagtgattctcttgcctcagcctcctgagtagctgggattacagacacacgcaaccaagcctggctaatttttgtatttttagtagagatggggtttccccatgttggccaggctgctctcgaactcctgacctcaggtgatccacccgcctcagcctcctaaagtgttgggattacagatgtgagccaccacacctggcctgaataattttttctttaacaaccctgacaaatccaccccaggctatctcagggctacctcagagaaccaccttttttttttttttttttttttgagatggagtctcactctgtcgcccaggctggagtgcagtgtcacagtctcagctcactgcaacctccgcctcctgggtcaagtgattcttctgcctcagcttctcaaatagctgggattacagccgcacgccaccatgcctggctaatttttgtatttttgtagagatgggatttcaccatggtggtcaggctggtcttgaactcctgaccgcaggtgatccacccgcctcagcctcccaaagtgctgaaattataggcgtgagccactgcacctggccagagaaccactttttaaaatccaaagatttatttaatcttatttatgtatttaaagacagggtctctttttgtcgcccaggctggagtgcagtggtgcgatctgggctcactgcaacctctaccttccgggttcaagtcatcctcctgcctcaacctcctgagtagctgggattacaggcgcccaccaccgcgcctggctaatttttgtatttttagtagagatggggtttcaccattttggccaggctggtctcgaactcctgacctcaagtgatctgccctcctcggcctcccaaggtgctggcatttcaggcgtgagccactgcgtccggccaaaatccaaagatttaaataggaacaagcaggaaaggaaagtccatgggtgagcaaatgcttccaatctcttaggtccttacattcttgttaaacttcacccttagcaataattaagccccaaagtctccttgacgtgtatatttttttcccacagcaaaggcgttagtgtgaggaaatccttgtgctccccctagaggttagagggcgcatccagcacgtcctggcaaagtgtgtgtggatggcgcagggtgggtggggtggggggatgcttgttgttttactattaaagtcaggaaatcaagggttttgcattctctctccagggagctttgcagagtaccagaaatgtcttgtctgcaccttcatgcggtttatttttcagtctttgcttgttctccacctgggactcatgaaatcggtagttctgcccctttacaagtgttcctttgatgtaatacccagggagccagagaactaggtcaggacattctatcaagtacaatccaagtatttttccaagtggaccacctgcataaaaatatcctgaagagtttgtttaagatgaagaattctgggccccaccccacaaccttctgaattggcatttctggaggtgaggcaattcttatgcacattaaggtttaagaaccactgctgtaccctacttgagaaggaatttctcccttctatatcttgtttaaaattatgctgtaggatgctataatcaaacccatcagacagggttacagatctaatgagcccaatagaaagataacataagatgctagtctttcactctgaaaacagaacccagcgggcaaatcacaaggtcacgagtttgagaccagcctggccaacattgtgaaaccctgtctctactaaaaatacaaaaaattatctgggcatactggcgggcacctgtaatcccagctacttgggaggctaaggcaggagaatcactcgaacctgggaagcagaggttgcagtgagctgagatcgcaccactgcattccagcctgggtggcagagcgagactctgtctcaaacaaaaacaaaaacaacaaaaaactcttcccaattcaatcccgtgaatctaaatcctcaaatatgtagaaaatgcttgtctctttttttttcctttttaaaaaaatttctcccatttttaaaatgttttcattgttgtgggtacttagtaggtatatattgggttacatgagaatttttttaaattttattattattatactttaagttttagggtacatgtgcacaatgtgcaggtttgttacatatgtatacatgtgccatgttggtatgctgcacccattaactcgtcatttaacattaggtatatctcctgatgctatccctcccccctccccccatcccacaacagtccccggagtgtgatgttccccttcctgtgtccatgtgttctcattgttcaattcccacctatgagtgagaatgttgcccaggctggagtgcagtggcgtgatcttggctcactgcaacctctcctcccaagtagctgggactatgggcagtgccaccacgcctggctaatttatgtgtttttaggagagacagggctttgccatgttggccaggctggcctcaagtgatccacctgcctgggcctcccaaagtgctgggattacaggcgtgagccaccgcaccaggcctaaaaattattattttaaaaagatgaccgtgcccagcctacatgagatgttttgatacaggcatgcaatgcataataatcacatcagggtaaattaagtattcgtcacctcaagcctttatcctttgtgttacaaacaatccaattatactcttttagttttttagattttattttattttttgagatggagtctcactgtgtcgcctgggctgcctgcaacctccgcctcctgggttcaagtgattctcatgcctcagtctcccgggtagctgggatcacaggcatgctccaccacacctggctaacttttctatttttagtagagacagggtttcgacacgttggcaagtctggtctcaaactcctgacctcaagccatacacccgccttccaaagtgctgggattacaggcgtaagccatcatgcccagcctcttttagttatttttaaatgtacaattaaattattttggggctgggtgcaggggctcatgcctgtaatcctagcagtttgggaggccaaggcagaaggatcacttgagcccaggagctcgagaccagcctgggcaacgtagcaagacctcgtctctacaaaaaaataaacacaattagctggatgtggtggtgtgtgcctgtagtcccagctacttgggaagctaaggtgggaggatcacttgagcccaggaggtagaggctgcagtgagctatgatcacacaccactccactccagcctgggtgacagagtgagaccctgttgaaatatatatatatatatatatttttttttttttttttaccatagtcatcctgttgtgccagcaaattctagctcatttattctttctaaacttttttttttttttgagatggagtttcactcttgtccaggctagactgcaaatggcatgatctcggctcactgcaatctccacctcccaggtttgagcgattctcctgcctcagcctcccaagtagctgggattacaggcacctgccaccacaccagctaatttttttttttttttttttttttggtatttttagtagagacagggtttcaccatgttggccaggctggtcttgaactcctgacctcaggtgatccaccctcctcgtcctcccagtgctaggattacaggcatgagccactgtgccctacgctttctaaacatttttgtaccccttaaccatcatctctttccctctgcccaccaaccctccagcctctggtaaccatccttctactctctatgtccatgagttcaattgtgttgatttttagatcccacaattggtccctgatgccttatttagttcatttggggaggtcacattttcctggatggtcttgatgtttatgggtgttcatttgtgtctgggcccaaaactattatttattgtagttttcacagtctgggcttgtttatacctgtccttcttggaaaggctttctaggtacttagaaggacttgagtgttgtaatctaagctgccttaggggacaccccaaacccagtaatgctgtggctcttgcagactcgtagaggtaccgccttgatgttcttggatgagatctggaagaattctctggattaccagcacagacacttctcttcccttaccttctcccaaagagacagagtcaatctctctctctctctctctctctctctctctctctctctctctgttctgagccacctggagctaaggatggggtgacacaagcactcctgtggctactaccactaggactactctgggtcggacctgaagccagtacagaactgggtctcacctaagacccactgtaactacgacttggctactgcctgtgttcactcaaggcccttgagttctacaatcagcaggtggcaggtccagccaggcctgtgtccttcccttcaggacggcaagttcccccaggccctggacaggtccagaggtgtcatccaagagcccggacctggaataaaaatccttagaagcctacctgatgttctattgtactgcagctgagctggctttcaaaccatgagatgccgtctttccaactctttcctctcctttccacagtcggaggagtctcacccagtggccactactaccacaggcccatggggagtactgccaggctattaaggcccaagggctcttaagctcactgta

SEQ ID NO: 15 - DNA, 3234 bp, Homo sapiens
gatctcagaagataaaatgagtgctgctccaatgtattcagtgtagtctgcttctcaaattcagagcgcaggttgctcggttgctggagaagcaatgtatgcctgccatcactactctgtggataccacactggggctgttacccattgcattgagtcacaaaggcattgcagggcctatgtgacttaggtggacccctaccctgcttttgttgcccagtgcaatgcctatgtgacttagcaaaattcctactctgctttgactctgcatattttcagaaaacaggggacaggcgcagtgactcaggtcggtaatcccagcactttgggaggccaaggcgggtggatcacaaggtcaggagttcaagaccagcctgaccagcatagtgaaaccccgtctctactaaaaaatacaaaaattagccgggcgtggtggcacacgcctgtaatcccagctactcaggaggctgaggcaggagaatcgcttgaacctgggaggcggaggttgcagtgagccgagatcgtgccactgcactccagcctgggtgacagagcaagactctgtctcaaaaaaaaaaaaaaaaaagaaaacaggatgtctgatgtctgtggtcagaggttccttcttaggcagcttaccccacctctgaagaacctctaacttcattataatccaatttccatactaaatgacactcccaggggcgccatgacagttgacaattaccatgacaacaaaaggaggaaaccaaaacaggacaaaagggaggcggctccttgattccaagtaaatctctgtcccttcccaagaaaaagcataaatacacctctccttgatcttaatgctcagccccttcatcaagaaaaccctacatgcggaacttcccagttcccaggagccgagaagttgatttgtgagctgtgctcccacttctcccattctgtggccatgaaatacagcctgcactgcttgacactcactttcagttttgtgtgcaccgagcaagaaagagcccctcttggggtaaccaggagacctggtagtagggttgtgctggcagcagcaacccaccccctccatctcgtacccattttctgctccattcgagaagcctctgcagcatctccagggcacgctctctcccagcacaaccatgtgttgcatatttttagaaataaccacacttgctatgggtaacccagagactggagcaacagggctccagattccaattctgaatttgtgataagaacccttgaaaatgtgtttaacctttatgtaccttcattaccacaaaactgaagggactgcaacataccagtatcatttataggcttgttgcatggttatttcttgagcaagtgttgatgttcatgtgattctccaacaccctctccatcagcatctgcttccctcagcactctcaagacagagccatatccttgctgctgctgacagtgcccataaagaaagccaggtctgtgcaaagcctgcagaccgctgatgctcctagagtctctggtccactgggtaccacagctgaggagaattctgtgcacagccatgctttgttcctaagcaattctgcttgtgcctaaagattcccaaagtctctcataaatagttttgcagtttcttgctctcacctcttgctgggaatgcctcaaagtctcatgaagccaactcctctgtttctggcctcactgttctaaccatgggtctctgacaccttccaagagggcaggcaaggaacagagactgtgcctctcccccaccattcacctctgaggccttgcttgcaatgaatcctacctgtcttccccacaggggcctggatgtttgaccaacccagcacaaaacaaggagacaacaacaggtgcaaattgacactgggaagagggaggcaggagctgaaagggacttgaaaaagaaatattgtcctcactagctatattttggccccagcttggtaggtcaaagttgccccatagcagatgtttataataatcatagttagtaatttcagcatagattaagtattttcctcctgttcttattttaagtagggagaaccaagaatatgcaggtccatatgggaaaacagcatttttagattctagttcacgggcatatttaaatctgaaggtcaagacctataccacccttgtatcccaaattagggctctctccttacatacgttcatgttttcctttatttcatccttaattgatggtgactgagaggattttatcacatacaggtcaatgacaaaaagctagaaggaattcaccatgtctgtaggttgggtacttgttctctacaagattggcaggttatttctctcataaaagttgcaattgtgtaaaagaacacagactctttcagtctaattctttgacaaggagaactactgttgagtggttttaatatcataatgcttatatgaaaactggagagctggtagccattctgcagggagccgaaagcagtggagattaagcactatattcagaagactgctacgtggctatttcccccaagtaaatcaggagagttccaggagaccactgcagttccaggtacacacccagacgctctcagaagggtggaagcaaaataacaggcctctgatgaaaagtcaggaagatgaatattatgggatgaaggagctccttgtgagcagttgagaatgggaaagagggactaagaggaagtcaggtttatgaaggtgtaactgaagcaaaggagtatccattgtgtgtccagtgggaggaaagagaaattaggcaccaaaaattctggaatgaaaaaaaaagaaataatggaatgtactcaagtccaatatgattctggagaatccgaacccaatcactagacaatggaggtcccaagccccacaagcaaggaatgaagaataacatcttactttctggtctatcctttccagcattcactaaagcaattccccaaagcagtaatttggccagctattcattccccgttgcggggctgggagaaggacgcagacaatgaaggtgggagggaaatagaaaggacaacagcagcaaatactttaatagaggagagatttatgaggtgctgctggggaaacagaaagaaatgtaggagctacagggggtggggatctggtagacccagcctgggggagcagtgtctgcactgggcttgcaaatagtgatcacagccaaaaggtactttgtaggattgagatc

SEQ ID NO: 16 - DNA, 8100 bp, Homo sapiens
ccatggcctctattgcattatccattgttcattcccataaaaacaaagggatatctttcaatatctaggcaatgcaaaaaccttgccttccaaataaggtctaacctctctgattcaacttatcaaatagctagctctacagccaagggtaaaacaaagagacctcagctttgggctgcaggattcagcttcccagatgggaggtgagagcttgctgggcaagttcctcctccatctcccactagttcactttgaccttcctttgatggtcaaacccatttctcccaaccaccagcatgattctgatcactgtttgggtcaacctgctgactccttctccacttggtcccctgcaagaaagcagtgtgaagcctctgggcttgttgattcaataatcatctttatactatacttacttaggaaaaaaatgtctttgtgagaaaagacagacaacagacaccatgcctgatacagcgtcagaaagaagcactgtttattcaactgacttgattagtgagtgccagacagctattagaacaaaaatcatgttttggggcaacaaaatcatgctttgggtctatttgtgtcatggcaagcctccacagagtacccagataatgcttgttatcgtcacccatattagccaaatgtttggataaataaagatgttgtatgaaattccctatctgttgctttaacataaattcacatggagtggtacactggtgagtcatgttccatttcatggctatatggtttccatggccaaaaaaatgagaagagggcttccttgggctgggaatctgtgtaagaatgtgcttgcttaatctgctgccctcctgtttgcctcctctgtgtacatacaccaggtccacccccaagcctatggttcattgcacattaggtgacctaatccttgagtggttgctggaattgtccacctggggctagtgtttactctaaatagacccactacacacacaggtcagaagccaacacaagtgagccttgggcatgcccatcccgttgacagccgctttcttagatcatctacctttgtttccactaggctctgactccttgctccattttggtgtctagctggcttgaaaccctttgggctttgtgtcttgttcccaggccctggttgagtatgatctaattctgtgtccttgcatttgactgtcagcagtgggctggtaccagccctgaagctcccttgtaaccataccccagcctatcagcatcagtgaggcccctccaactctcctactggacaagttctggtttccctcatggacgagggttgaacaaaaatgaaagataagtcagttgttatgactagaaaaagtgattaccaggccctccctagaatcccacctctttcagagatatccaagtacaacacagagaaccagaagtggccaattcattttgccaatcaggctacatagactcatgagtcacctaagatagacacaccttttgaaaaacagctgcaaacagacctggaacaaacactttcttttgctgagagcaaataaaaagattacgttagatggatctagaaacatttcttttatttttttgagatggagtctagctctgtcacccgggctggagtgcagtggcatgatctcagctcactgcaacctccacctcccaggttcaagcgattctcccccttcagacttccgagtagctgggattacaggtgcccaccaccacacccagctaatttttgtattttttttagtagagacagggttataccattttggtcaggctggtctcgaactctgacctcaggtgatccgcctgcctcagcctcccaaagtgctgagattacaggctgagtcatcactgacaatactaggaacatttctaagattcaaggaagaatcaaataatccagttcttaaaaaggcttggatgcagctgaaattcacaaacagctaaaaccaggagctacatctctgccagtctctgcttcttcctacaggaggtcaagttcctactcatctctaaagtccagctttctcttcacagttgaaaacctggccaccaacaactcctggctatttctttttttttcttttttttcttttcttttctttttttttttttttttttttttgagacggagtctcgctctgttgcccaggctagagtgcagtggcacaatcttggctcactgcaacctccacctcccaccttaaagcgattctcctccctcagcctcctgagtagctgggactacaggtgcctgccaccacgcccagctaatttttgtatttttagtaaagacagggtttcaccatgttggccaggctggtctcgatctcctgacctcatgatccactcacctcggtttcccaaagttctgagattacaggcgtaagccaccatgcccagcctagcttctggctatttcatcttgcaggttcatccaccggagagaggacctccacccccgctctcctctagtcagccatcctaaaccctcagaaggagccattggtccaccttgtaatacgactgcttctactgcagtcccttgatgggggcgaaggtgcagcacgacatgacagtcccaaaggaagggaactgctgcaaagggccagaataggtgagatttatcacctcatcttggttctcagttccaccaatcccagccccatccagcaaaacaagaattcccctgttgtgttcaagctatgtccaaagatgaaggctacagtctgttttccacaaaccacttttggaatccttaccaagtattggcttgcaatacaaaggatcccttctctattactatgtaactaaaaaaaaaaaaaaattgagctgccccatctgaaaagtccctgtgtcttagaaaaaggctttgttctgtattctggatgaggccaatcctcaacaaaaggcaatataacagagaggttaacttcacagcttctggagttaatttagggatcagttcaaatccctgctccaacagttataggtgtatgacacacagcctcggctttactctctataaatgaagataactgatagtcacttcctggtgttggtatgaggataatttggggcaaggcatgaagagcacttagcatggcacccgggacacaaaagacctttaatgacactggatagacttggtcttcagtgatgtcctctgcctttttctgccatcttccccctcctgccattccccagggaatccaaggctctgcctccaggaacagatgtttcccacctgttcctcttccatatgactttgcaatggatcttcatgaaacatacactcccaccccaatctaagacccttcatgtcttgttaaaacagtgaagataaagttaaacttccctagagtgggccccaaggctactttcaatttggaccctgcctgcctctcctaccttgcagtgtctccttaaaaaaatctcaccatgctagatcacttgctatttctcagatatgtcatgctcttttaccacaatgcatgactgcaaacactgtcccctcttcctggaaagccccttccctggctagctccaactagcctaaccagttttcatgatgtttgtgatcaggggattcccagaaacttttgctgaccccaacccccatttcgagttagacaagcttcctctggctccattcatgcccacgtttccctctatcagagtccttattacactgtatttgcttgtatgtctttgttattaaattctgctcttcttgagaacaagactacatttccagcatgaagcacagagcctggcataaaggtaatgttcaataaagtgtgattgtctgaaacaccaatgagtatatttaggaagccatgtgtcctggtaagaatgaagatgaaatgtacagtccttttcctcttgtagctaagtgagtcactgggtacaaaacccatgaccttgcccacaacactccaactggcactttcagctgcttcatgggaaacagaattcaacactgcatgtaaaatactggattttaaatccagaagcctacctgcaaagtccctctttcttgtgatcttggtcaaaatgcttagccttgtttgtcttgcctatgaacaattttttttaatacttggctatagaaaataaatacaattatgcctataaaattaaaaagtatctttgatgtttttttcctacatggcattgtcatggctgctattgaaaagatgacaattatcccaacctctaagccaaagttagtccttgttcctgaataccatcaagtcattgtctgttacaaggaaacactagacatattttgtgcttttctggtgtctgagtattgcatctcaagtggaggcctgggtcttttgtatatgtcttgtatctctcatgactttttatagtattcactagagcccgactgtggcccagagctgtcctcagaggctatgctgtgggacaaggccacaagcaaaactataatgagctcttcctggtgttgccagaaaaaagaactcttggataaggtcaacgaatctgtccttacaaagatctctgtgttttcacaggtcagcctctagtgaggtaagtaataaaaaggaaaagctgaaaataactgcaagaacaagggttgcattattcatctgtaaggattacatattgggttttaaggatgcatatattaaacattgctaagcttcatcctgtctataattattaacacgttgctgagggactcatggtaattatcatctgggaatcccactcagatactgcacaactctaaaaaggtggactaattcctaaggtaaggcaatgttgagcaggaatgtcaaagtgagcagcatataaaataataaggtgtctgggcgcggtggctcatgcctgtaatcccagcactttgggaggccgaggcgggtggatcacaaggtcaggagattgagaccatcctggctaatacggtgaaaccccgtctctactaaaaatacaaaaattagccgggcatggtggcgggtgcctatagtcccagctgctggggaggctgaggcaggagaatggcgtgaacccgggaggcagagctgacagtgagccgagattgcaccactgcactccagcctgggcgacagagcaagactccgtctcaaaaaaaataaaataaaataataaggtaaccatgagcaataaagccataaatacatctaagaggcttgaatgacccagcccaggaaggaggaacgatggccttgttaagattcacacatttcttaactttatactgttactaatggagcaatctgtggttagcgtcccctagataaccaacatatagaagccagaatgtaactgagacagaagtcagcaagcctttgttcattgcacaaacatttaggaagcactcactgagtgcctggcacagcagcaggtctattaagataagttcctggccccaagggggaggtagacgtgtaaaccagtgatgtgataagggcagcgttccgtgtgtacacagagcatcaggacagccccaagaaaggagtggctaattcttcctgggaacattgaaaaggatatcttcgaggacgtgggttttaaactaagtcttgagaagctcctttggctgagaagtgaggaaagggcatttcagatgaaagagtaaagcaagagctattgaacccctgctcaccaggagccaaaatggggccctccaaagcaagttggccaggagccttaaagccaggctgaacaggagtcgggagagccagagaggagtgccagtcaagccctttagagacctgggaggtcaacatagacaaatccaggtcagatggcaacagagtcaaaagatcagaagcaggtagagcaggaacaaagaggtgggctgcaggagacggaggctcctgtttattggtggcagccacttcgtgggtgggtctggtttaaaagcgcagggccagaatagacaagtttctaggcacagagctgggtgtttggggaaccgtaagcattcagcagaacaggagcaagtgttcttgaggaagcagagaggcaggaggagagcccaaaaattggggcaggagccaatcgtggaaggtcttggctgttagctgaggaagtggggaatgattatgttaccttaagctggggagtgatgcagagtctattatgacccacctcgcctggtctggtatgtttatcttgctatctcacgtgtatctatccacaacagtgcaataaatgctaaatttgaaggaaaaaaaaaaaagaaactcacaagaacatattcaacttctgtgaattattttcataaaataagggcagaccatgctctataatgctgagtccagtggttttcaaccctgactgcatattagaatcacctagtgagcttttcaagattataatgagggtcaggagtggtggcttacacctgtaatcccagtactttgggaggctgaggcaggtggattacctgaggtcaggagttgaagaccagcctggccaacatggtgaaacctcatctctaccaaaaatacaaaaattagccaggtgtggtggcacatgcctgtaatcccagctactcgggaggccaagacaggagaattacttgaacctgggaggcagaggttgcagtgaactgagatcgcgccacagcgctccggggtgggcaacagaatgagttccatctcaaaaagaaaggaaaagactataatgagactgtcaggtggtaagggctccctggcaaaactccgaccaacctgtgcactgggagaacagggtggagccttgggaagttcacaccatttgcaggagggaagagccaggcatcctctgttctccggttccttttcgcctaataaattccatttttctcatccatcaaagtgtctgtgagcctatttcatggccaggtgacaaggacccagctcttagctgaactaaggaaaagtcctacaacaataggaacctggaccccatcctagaccaattacatcagaatctttgaaggaaggggcagtcctggcatccgtgtatttccaaaactcctccaagaattctaatgtacaactggcgttaggaactgataatcaaaaatggcagagaaaggaaaaggagttttgttacttttccctaatcagcatgagaatacaacatagtagaaatgagaaaagtcagcaatttgcaggctataaagactcaaggctggatttcatggcattaatctgagagagccagtttaacatcttttaaaagaatgtgtgttttcttctgctcccaaagtgccaagctttcaagaaatgcatatcttttcattatccctgtttggaaaccaggacaacagatggcaggataatggattgtgtcggctcaagtgagagttgctttaatttgtgagatatcaaattcatattgactgtggggacaggctgatatgatttatttcaaatggaaatggagccttcatgggctctgtctttgtccattaccataagacaaagtctcaccttcataggtgagacatattggattgccattgatagaaactgtttgcaggggctgcaagaggtagctcttgttctcagtgactaagtgttggagaatctccagatgcccaaccaggaagcctgaacttcacagcagtgagggctcccacccagcaccccgctcctccagatcagtcagcaaagtacaaaggaagccttgtttatatttatttttctttgcggttaacactttatatattcctacatgtactctcaaaaatgcagcatgacattttgaaaagaaaacgcaataggtgcaacccattcattcctgaaagaaattatcttcagggacaagaaacagatcctgcttgcggctcttggcaatccctcttcagcatagcagtgtgaaaccctgagccaacaatcagtcggaggctgcttgctgccagaagtgctcctacctcctggcgagggtggcttagagaaaatccccaacctcagtgggaaagatagagcaaaaggagaaggagccgagggaagaacaggaaaggctaaaaggcaagcagtgattgtccccttcctggaaagaggtaaagagtagagccaagcctcaatggccaggcacctg

SEQ ID NO: 17 - DNA, 5329 bp, Homo sapiens
tttatctaatgagtaatctcacccaatacagcattgtgatagacattggggattcctgttctcttgcccttttctgctatttaaaggctgaaaagcaaaattttctgttttcctttttttcagccaaaggtggccatatgatttacttctggccaataaaatgtaaggtgtctctttccagatgaaaagggatagatacagctggaagaaccctgcttcttctgttcctgttgcctcatcccccttttgcctgtctagaaagcagatgtaaggcctggagatgcagcagccaattggtaacatgaggtgtcaagcatgaggataaaagtccctaagctaggaaatgcagagcagaaaaactaaaagagccttggcccttgggtgcatttcttagcagctacaccagcattgctcagttcttggcttctcaatacctaagaaaaataacttttttttttttttttgggacagagttttgctcttgttgcccaggctggagtgcaatggcgtaatcttggctcaccgcaacctccacctcccaggttcaagcgattctcctgtctcagcctcccgagtagctaggattacaggcatgcaccaccacacctggctaattttgtatttttagtagagacggggtttctccatgttggtcagcctggtcttgaactaccaacctcaggtgatccgcccgcctcagcctcgcaaagtgtagggattacaggcctgagccaccatgcccagctctaacttttttgttaatgtaccgttatttgccgttgaaaccaatatcctgttatttgtgaccaaaagtacttgaataaaggccaggagcggtggctcatgcctgtaatcccaacattttgacgggcagatcgcttgagctcaggagtttgagaccagcctgggcaacatggtgaaactccatcactacaaaaaattacccggatatggtgtcacatgcctgtagtcccagctacccaggaggctgaggtaggagaatggcttgagcccaggaggcaggggttgcagtaagccaagatcttgccactgcactccagcctgggtgacagagggagaccctgtatcaaaaaaaaaaaaaaaaaaagaaaaagcagtctaataaaccaactctgagatgttcatattttacaattatgtaaaaatgtcagtgtctaaagtgagtttgttttaatgaccaagggctgcttcttgtgcacacaaaagagcatttgttgttaattgggtttttaattattacacaatttattgaagaaacaaatttttcttaaatttttaagttcaatttaaaatagttcagcttacatatagatgtaataagtgacatactagagatccatgcaaaaagaaagaaaaagaaaacattgtttcacagagaagcatttgagctaggccttaaataatgagaaaaaaagaaaatttaaggcagaaaaaatagcacatggggtcctaaaagggtgtattatgttagatgtccacgtgaggcaggaaaaatagagatgaggctggaaagtaaacgaaggccaaattgcttaaggtcttatttaaaccagactaagcagctgaaagtttatcctatagaaaattgaggttgggcacggtggctcatgcctgtaatcccagcactttgggaggccgaggcgggtggaacacttgaggtcaggagttcaagaccagcatggccaacgtggtgaaaccccatctctactaaaaatacaaaaattagctgggcgtgatggctggcgcctgtaatcccagctgctcgggaggctgaggcaggagaatcacttgagtccgggaggcagaggttgcagttagccaagatcacgccactgcacaccagcctaggcaacagagcaagactctgtctcaaaaaaaaaaaaaaaaaaaagaaaagaaaagtggaaactcttaagggttttttatgatcatatgggcattttagaaagatgctctgcagctgtgagaaagagactggaggaggccataggtagagaggctattcggagacgattatggtattaactaatgatagaggacacgagtttgaaccaagagaagaccccactgcataggctgcagcaggccactcttactacaacaccagggctttgttctaggtcctactgttcaccacacagaaacccaatcactggggcagtgagtattgccagggaagaaggctttaatcgggggctacagccaaggaattgggagatcagtctcaaatccatctccctgatcaactaaaatcaggggtttatacagcaaggaagaaatgaaactacatgcaggaaaacaggaatagagaggggtgaggaagaggagttggtcaacaggaagcaggtggtgagttaggcaatcatgatgggtgaggtgtctggcatctcactgtcctgatgcagcaacctggtaagtttcagcttcctgatactatctgggaggcatgacggttggtttcctgagaatggaactcagataagacaaatggaacttactcaagttttaagactaagaggattaattcatatgtttattcagaagaaactctaaacattagttgtatgggacaattgggcaggtttcacaaccagggcaggcgacaagtgggggacaaagcagaggctcagtgttcacagtcagagctgagggcaagtcaagtctgtaatggaaaaggggccagtgttcccaagatgcattgccaaggctgtgcaggaccacgggaccagtgccggacctgcaggaccttcagttcacgaccacatgctaactgctacaggctgcagcttcagaccagcagagcacacagaaaacaggtggacaaaggagagagaaggcgggggacccagaaggggcccgtggctcttcctgctgtggtgaagactcataagccatactagtctctcttctccatacatctgttcaccacgttaggagaagaagcaggaagaccgggagattattgagataattcatccaagagaaactgaacatagctaaaggaattatgtcaatgatcagcattaccatgctttaaaccagactggacatttcaatcatcttcaccaccaccaacaacaactaaccaagtgagtggtggcttaatagaagaccagagcagctatggacaaactgataggaaaacccatttcatctgcacaacaaagttggagcacaagttaaattatgcaactctcttggggaggccaaggcaggaagatcatttgaggtcagaagtttgagaccagcctggacaacatggtgaaaccacgtctctactaaaaatacaaaaattagctgggcatggtgttgcgtacctgtaatcccagctacaggggaagctgaagcaagagaatcgcttgaacatggggggcagagttttcggtgagctgagatcgcaccactgcattccagcctgggagacagagcgagactccaactcaagaaaaaagaaaaaaaaattgtgcaactctgatacagaggcatagaaaaagaagagttgaagatacaaacattggttgataatatccagcactgtccagggaagacactgaatctgaggcgcatcagcagttcgtcatcagagatgaactccctcttgtgaagcatggacctttccttgggcacgtacatttcctagccagctctttgcagcaactcatgctcataaaatggcccttgttttttttgtttgtttgtttttgtttttgagatggaatctcgctctgtcacgcagtggcatgatctctgctcactgcaacctctgcctcccgggctcaagggattctcctgcctcagccacccaaatagctgggattacaggcgcccaccaccatgcccaggtaatttttgtattttcattagagacagggtttcaccgtgttgtccgggctggtctggaactcctgacctcaggtgatccacccttcctcagcctcccaaggtgctgggattacaggcatgagccaccacgcctagccggccgttgattgttaattcatctaattcatcatcaccagttcttccatactaggaaagggagattagaacattccaggccctggaagaggataatctcttttaaatagatagaataggcttttatcttatataccagtccttaaaaatgtagctggggttagtctctaagcaggacgaatcctggggcactgacaataccgagtttcctgcctgaaaggctgaggaccagaccctggactaaaaggtgaatttacaccctggtgatcacttggctaatttctcccaacaacaccgccgccttcctgtcctgtcccttccatcaatgtcatgtcacactgcgactccaccttggatgaataaacaaactcatggaagtacagcacagtttggccaggtgcacatacttcctccaagttcctattcttgccctgtgacacgctccatgtgtgttggccaagctgtggcctcacagactcatccctaaatcacctcccatcacctattccactctattctgacctactgtcaaagttctggctgctgatttttatattccttctatttattttcccactgttgctgttggatttggatttgccttactcagaaagccctaagtgacgccttttctatttcagcccatctccctctataccagccctgaacagaagggctgttctcctacccagccctccctggccttgcagacaggacttaggaccacagagccgtccaggggacattcaccacatcagaagaaggtcaaattggcatcaaccaagctagattcagcattagatgtggaggttccaacaatctccagaacctttggccaggctctacctcagggatctgagagcagcataatctacagagagacagggacacattcagcaggactgctgattccccagggaggctttgagaaagtagtgcttcaggaagcagcatctgggagctgatggtgctcctatttggcagcacagagctgtcctgtccttcccactgttccagacgcagtgatgatggagcgaagagcactacactgtggctgcagcagctcaagctcacagccaagtcacacaagctcaacatgttccctgcccattacatactatttgggggtagacattggagccaggcaggcctgaatttgaataccagtgtgactctttggccccagtcctctttgagtctcaattttctcagctatgaaatgacagtggttatacctccctcacagattaaaccacataaaaatgcatagcatgcacattgcttgatacagcagacactaaccaatgtgaattctgattccttttcctga

SEQ ID NO: 18 - DNA, 3200 bp, Homo sapiens
cacttagccttttctccagtctagaaatctgtttgctctgctaattgaactaccctaataaaatcaataatgtctcttatcttcagtgaggtaggaaagaaagccattccgaagtggcagagaagctgctttttcctcctgcatgctgcctgctagtgtggatcttggcataacagacactacttggcaaaaggtaagtgtaccaaagtaaaaaccatattcttggtgagttcattcattcctaataaagacttaggtctcttttcctgcaaatattgtcactgagtgagtgtgaagaggtgccttcttatttttggaaatcatggggagtgggattagtgagcaagaggtgagaatgggtgactatcaccactcttgtcgctaagggctagactggttcatctctgcctcttctgtgcatgtaaataaacacagttccctgggagcctatgttagttcagggccaaaaaattaatatgccacaattgtatatactctttattaattatatatatatatatacatatatatatatatatataacctttttttatttcttaacatgttaaaggaaagaagatgagaacttacggaaaaataattaagttgaaatgtccttattttatctaattcagcctgctcctcttcctctactcccatatcagttattatcataaccacttacacaatcactcaggtttggaaccaacctatccaactggtctctgggccttctgcctggaggtcctccttgctccttttcacattgtatccaatgtggtctttactaagtttggatctgattttatctttctgctgatttaaatcattcagctgcttcccaaagattcatggttatggtcagattcctgagcaaggtatacaatcgccttcaagatttggcattgcctgcttctctgggtttatcttccatccttgtgccataagcaccttcctctccactcatatcaaaatgtttgcctcttccagaacttgttggagcctttagtgttctaatattatcatacatttctgaaagaagggtaagggtgtaacattcctcaaatatatttaactttggaacattttacagtagatgttatgtagaactaatgttctgagaaacacacttaggtaaatggcacttaacatagtatggtatacattgtaatgtgtatcatgccattaagtgtctttcattctttatttatttttatttttatttttttttaagatgggatctcactctgtcacccaggttggagagcaatggtgcgatcttggctcactgcagcctctgcctaccgggttcaagcaattctcccacctcagcctcctgaatagctgggattacaggggcatgccaccatgcctggctacttttgcatttttcgtagaaacggggtttggccagggaactcttgacctcaggtgtttaaaccagtatttctcaaatttatttgactgcatttctttttcttcatggaatacttattaaaatcttgcaaaactagacttcacataacataaagaaaatcttgttggctgggcatggtggcccatgcatgtaattccagcactttgggaggctgaggtgggaggatggcttgagaccaggacttcaaaaccagccgaggaaatatagcaagatcccacttatacgttaaaaaacaaacaaaaaaaaatttagtggggcatggtggtgtgcgcctgtagcccctgctgcccagaaggctgaggtaggaggatcggaaggctgaggtgggaggattgcttgagctaggaggttgaggctccagtgagctatgatcatgccattgcatttcagcatgggagacagagagagaacctgtctcaaaaaaaaaaaaaaaaaaaagaatgccccgggctgggtgtggtagctcacgcctgtaatcccaacactttgggaaactgaggccggtggatcatgaggtcaagagttcaagaccagcctggccaacatagtgaaaccccatcactggtaaaaatacaaaaaactagccatgcatggtggtgggtgcttgtaatcccagctactctggaggctgaggcaggagcattgcttgaacccgggaggcagaggttgcagtgagtggaaatcgcaccgctgcactacagcctggataacagtgtgagactgtctcaaaaaaaaaaaaaaaaaaaaaaaacaaaaaaaaaaccaaaaaaaaacaaaacagaatgccccatctcacattgtaaggtctatcgcatacaagacagctatctgttttgtcttgtcatttaaactttttttaatttaaattttattttattttattatttgagatgaggtctcactctgtcgcccaggctggagtacagtggtgtgacctcggctcactgcaacctccgcctcccagtctcgggcaatcctcccacctcagccttccaagtagctgggactacaggtgcgtgccaccacatcttgctgatatttttgtatttttggtggagacatattttcaattttcaccatgttgcccaagctggtcttaagctcctgaactcaagtgacccacctgcctcggactcccaaagtgttgggattgcaggcatgagccaccgcacctggcctaaactttttaaatatactcattcacataaagtagctcacacagaaaagtactgatgttctttcaaaaccatcaggaacatcagcttttatttgaatgaacagaaaatagaaactgattgctattctttgaaaagaggactctgttgtatacataccatagccttctgttagctattcagtaaaagtctttgatgtttctgcaataaagcaaagtgatttcaaaaagaaaaaaaaattgcctctgtcctcatggcctccataggtgtcattctttctacttaaaatcttacttttttttctctacccagttaattttcatccttcaagatgtttaaaaggaatgttcccaaccttttaatgataaagatatatttttttatctgtacttccaaagcatcctcagcaaatatcctagcacctgtcatacaggattacatttgctggggcatgactctgtgtctctcaccaaatatgaacactctgtgaaggtgaaggagcgtgtcattttgactgtatatcctccagaacctagaagtgggcatgggatgtagaaaatgctttttaaattaaataaagaattgta

SEQ ID NO: 19 - DNA, 12496 bp, Homo sapiens
cttcactaatacagtagaagtctttaaggttcaaaggagaaacaggcacataggtatggggcaggccatcagttttgtctttacacaggcccaggggccttagtgatcaccagtgggtctgtctgtcccccaacactctgtctcagactccggcctttgcatgtttcctgagacctcttgctcccagatcccctgaggaggagacaggttggcagtggaaagagtgtgggttttggagcctccagatgaacttcgaatcctagttctacctctttgtagctgtgagacatcggccagccggctcacttctgtgagcctctcttccttctgtgtgaagtgtggagataatttataccctgcagcatagctgtaaggattagaaatgatgtatgtcgttaccctgtagggcttggtgctgagagtgcgggcccaggctagctctgggggcttcacactggctcagttcggttggtgttgattcaatgcctggtgtgtgttcccaccttccacaggagaaggtgggggatcgggccacagaaaggtccactacacaactgggcaagttcatcgtgtgaaattgagtgctgcagggtcccacacaggaagaggtgacagggaggagctttttggaagatctaggcttgcaggaagagatgggggccagtagagtactggttgccagtgtggacccccacactggactcccagggcccaacttcagctctgccacttcccagcaaggggcttaaccttcggaaacctgtttccttatctgtcagatggagattatgatagtacctccttgtggggttgttagatatgttggagcttcccagctcccagataagggatttcctcagccctcagggcagctgggtagggcctgggacaagccatggctcaggttgtcctagcttgagcagtctcacctcaggcatgcagcagtggctcctctactccacccgatgtgtgctgaacacatcatctcattttctctgtgtgccatgaggtgaagatttgggaagcattgacctaaatgagttccagcaggcagaggggtgtggagagctcatattctgagtgggaagaatagtgtagggaggaacggcagagggggtgaccccaaagcgtctttttatggaccccagatccctgctatcagtgtcaacatgtggagcagggttgataactaaattatggagtttttcacctggtgactgacaacttggtaattaaagagatattaatctggtgctgtgttgctggttgattttaatagaaagaaaagaatgtggggaaaggggtctttattgctgtctctgttcctttttgagtgaatggtgagagcactgaagcagccgcctctccagatccctagattttcctgctctactcaggctcagggtagactgaggggcttaaaagtggcaggctcatcatcaaatgacatttttacagcacataaagcatgtcgcacctggtaccgccttgagttccctcacctgctctgtgagtaaaggaagccagtggtggctgtctcattttgcagatctggggaggttaaatgactcgctccaggccacacggttggtaaaaggcaaagccgagatcaccaggcaggctgtcggactttaagccctgggttcttgatgttaagtcactctccctaatcatctggcccatgttaaatgcctcttttatcacatgcactgttgttcagcgtttcatgtaaaaggtacattccaagcgtatcgcttttctagctagaagagatggtggaacattgtgtataggtggaacacgtagggacggctgctaaaacggctcctacaaagacttctgccccacgtgacgttacgggtgttttgtcactttgtccctaaaccaccatgcttcctcaaaaaggagcaggcccgaggtggcgctgatggccccattgctcaagtacgtgtggaagaagctcatgccatttgcctaaagctgtggccccttcccagaagagagggacagggaaatgctgtttggggggctgccaggcgggccagctttagcctgcaaatgacgggtgtcgtttgtgtcccatgggggctacctcaggcctttcctttctcccttcaaggattttcttattcaggggaagcctacctctgcaaaactgtttgtccctccttcatctgaatattctctaaatatggcgcaaaacttcctctgccacctgctgctcatattgtttgccctcttgggccatccccattgccaccacctctgcatgggctcccaaatcctgcctggctgcttcctgtggtggctggcaagcctagaagagaacattcatccagtcagtcaacatacatttcctgagcaccagatctgggccaggggcaggtgttagaagatctgtcaggcacaggcctggcccccagaggcacagtgttttgaagggtaggtcaaccatgagtggtgggagggcagtggggcctatttattgggggcacagaggaggaaggcttatccttccaaggaggtgaaatgctagtaagagttaagttgagtaaggttgtttccacgaaagttgttttttagctggagaaagtgatcagtttggattcttacacgtactagatgctcagcgaggccttgaatggtggcactggttctcaaagtgtgatcctcaaaccaacatggatttcctgggaacttgttagacatccaaattcttaggctctatcccaaatcctctgaatgaaaaactaagaaatctcttttataaaagcccttcaggtgattgtgacgcaggctaaactttcagagtcactgaattaatgactgtgcacttctgtacctgctctttgcaacccatctccaccccctgccccctccctccctaccacatccaccgctgtcttacatacacactgtccctggagtgcagagaacatgacttattttattcttttttttattttttcaatttttaaaaaaatgttgtgggtgtatagtaggcgtaaacatttgtggggcacatgaaatgtttagatacaggcatgcaatgtgaaataagcacatcatggagaatagggtatccatcccctcaagcagttactctttgtgctacaaacaatccaattacagtctttgagttatttttaaatgtacagttgcattattattgactatagtcaccctgttgtgccatcaaatagtgtcatgtctttttcgaacttttttttttttttgagacagagtctcgctctatcgcccaggctggagtgcagtggcacggtcttggctcactcaacctccacctcctgggttcaagcaattctcctgtctcagcctcccaagtagctgggactacaggtgcccgccaccatgcccagctaattttggtattttagtagagacagggtttcaccatattggccaggctggtcccgaacttctgaccttgtgatccgcccacttcagcctcccaaagtgctgggattacaggcgtgagccaccgtgcctggccctaactatttttttgtacccattaaccatccctacctcccgccaaacccccaactacacatcccagcctctggtacccatccttctactccctatgtccatgagttcaattgttttgatttttaagatcctacaaataagtgagaatacgtgatgtttgtctttctgttgctggcttattttacttaatcatctccagttctatccatgttgttgcaaatgacaggatctcattgtgtgtgtgtgttttttttttttaatttataaatttttaaacccccagccccacaaaacacacccccatataccctcatttctagttctttacacatggttgagattatccgtaattactggaatgaattgaatgattcagccatgggtgctccctatccagttcacctggtggagaagggccgcagtgctatcaggagaaaaaaaatggaagcagaattttttgtggggtgccttggctccattagtgtgctatgtggcctagggctgtgcgcccagtaggctctgcaggtatttcttgatgcggcctaaacaccaagctatttctctcccgcatattaaggggctcgatagacaggacgcctggacagggctctgttcattgtggctgaggttagcactcctctgggtggtgacagaccctgtccctgagaaggatggcagcttggtttgtgctaaattagttccaaagcatcagatgggcaatgacgtcctttctgtgttaacattccccaggcgggtcacaaggagtggctgaagggagaggaagggctgtgttactcaaacacccatcttgccagtaattacttctttcctggctgacctctgctttctgtgcaagtgttctcccctccctttattctcctgcgcctgctcttttacatttttttctttctttctttttttttttttttcaaatttgttccaatctagaaaacccatcctctttcaaatggcataatggttgggattataaatgagttggctcaaagtgtgccccctctaggagcagccactgagagagcatttaattttgagcatccagttcaattaaaattccatttaatccagcttacttttcacagagttgtcttccccagtgagctgattacctggaggtgtttccaccagcctccttggccctggaggaatggggaagggactggacacgaggagggacagagcaggcagatgggggctctgcttccttcggacagggacttcgtccaacaggcgagagctttgggtattcatccactgcagaaagtgagaagtccaactgaggctgaggcaccccatgacctcctcacctctgactccggccctctagtggtcgagtccctccttagaatttccactaagtgaattgtctccaggctgcactctagcatttggttttattcatgtgtaaatctttgctccccatgcagattgtaaactcttccccttgccgtccctgcaggactgcacgtagcacatagcactttgcacaagtgttgggggccccagtaggaactaggtgtgtgttaaatttaggggagtctggtggtaagattattatggaaagaacctttcccatcactttatatcatatccatattggctttcctatcagctcatttgagaggaaattctgacctgtctggacattattgagtggctttaaagcaggttataggtggcgatttgaatacattgaccatttaagcaaagtgggactcatttctggactcacagagctcattaagcagacaggctgccaggtctgtttggatgaaatactggctatgcgcatgtactgttctccagcaagtctagacctgtaggagtccttcactgggctttatgtcaggtgtgcttccagagtggcctgtggccctctgtgataagtcggtaggagggggacatggtgaggatgctgacctgctcacttgtgtcttgactgggagaccggaatgcctcctgttgtctgaacaagctagtatggaagtagcatctaggcaagctggtgttaagacgcaagtaattactcagagaaattgctggtgtgtcaaactgcttgatatgtaagtttcctcctctttcctttgttttattttttgaggcataattcagagaacactttcatcaccccagaacgaaaccccatacccaccgacagtcactccccaccattcctcctcccccgtctcctggcaaccactaatctgtctttctgtttctatggatttacctattctggacatttcatattaatggaatcctgcaatgtttgccctttgtgtctggcttctttcacttagcataacgttttctaaggttcatccatgttgtagaaggtatcaacattccattcctttttatggctctgtgatctttctctttccattttattcctgcccccgctctttttcagttgttcttccatggccattctttcccgggctctggggactattttcagggtttcaaggtacaaagtgaagttctgctagttgtgcacttgtggtgctgccttcgcccctggctcaggtagaggcgagggctgatctcttctctacccttctgatattctttttcttaaaaaatttttttaatttttttttttttgttccttttaatgcttgggtctggaccttccagtgttcttgttttctctgtgcctctgttcatatactctcccaccccaaccacaccctaatagctttatttatcaaacatataaatatccattaaacataagagtgaggtgaggaacacaaaattccatccgatcgggttcttcccccgtaggagtttacagtccagttggaagatgaatagagctggccagaatgcaagtagaaaatgggatgtgcatataaatcatgaaatgtgagtgaggagtgttagaaaggtgcccaactacccggctgtttgacctgagcttcccagataggcaaggtttctgtggggccgtttagattcagaaacaattttattggggctttcaaggaccatcaggtacatgggtctgatttatgttaactcgtaagagatcagcctataaatgaggttgccaaagagttaatctaccatgtagccccagtggaaaaatggacaagacataaaccaatagctcacaagagaagaaaaacaaatagccaatgaaaacacactctgtaaagacatgtgaataaaaactttgtttttcaacctatcaagttgaaaaggagaaaggaaagtaaatactctctgccccatttttgggaatgaaaactgaaacaaccagtttggaggttaatttgccaaagactctttggtttgcagtgatctgattttatgaatttatgcctagaaaacattcagtgtacccagagatttacataaaatgatattcttcacaatgttatttataatagtgataaattataaacacattgatgcatagtaaaaagggagttgctaaatcacagaatgatttatattagaataatcacagccattaaaaactgccttcaacaaatatttaaagaaatgtgaaaaggctaatgatgtgttaagtgtgaaaaagcaggaatcaaaaccatatatatatgtatagtatgattaaaactttaaagaaaatgcacatgtataatatgcagaggaaaaatcagaacaaaatagtcaaaatgttaaagtggttggttctaggtggtgaccatgaataattttagaaatttacttctttatactttattgtgttccctaatttttttaaaaaaactcatttttatcaaacttctatatgcagatggtttaaagagtcagcagttctggaaggagttattatgaagaaataaaatattcctctttacttctcctgcagaaaagacatttcccactaccctgagacaaccactttcaactctgctgtttattttgataacaaatattctctgttgaattcacatgatgactgatgaggcctgagctccctttcacacatatcttccacttcctatccacctttctgtaggagctatattgtaatttcagtttgaccactgatcagtgtttatatttttatgactattcacagctgagccatgtagtgtactatgattatattttttttcttgtaccactttctgtttctcaagtgaacaattatcttgttgcttctcttacttggttttcactgtatgtctcagctatttcatgcaaaattcaccctcccatgcagcaagtcatatcaagtattctgtcagtttcttcttttgcagccatccctcctgcaccttctaacctgctgtagctgggctggtgcctcttgcctgctgcacagctgttatcctgggatttcccttcaggtttattaggattctctttgcctctatctcttgtattagatccctgtttccaggatctcaggtcttactggtttatttcctcactttggtggaatgtatattttattagtttcctgagaaaagagtcattgtaggcaacttttgggatacctagtatgtttgaaaatgtttttattccttcataccggactgatactttgaaaatagattatattttttctccctttggaatttttaaggcattgtcccattgtctttcagcttctatttaagttgtttagaagtcccctgccaacctgatccctgatccattgtcaggaacccatttttcctctctgaaacttaggatctgccattttaacctcctgaaatttcacaatcataggctttggggtagggcctggctgggtacccacaatctggaaactcatatcttccagttctaacaaattttcctggattatttctttggtttatttagtttcagtcagtctcttttgttaccctggaacttccactattcagatgctggagttgctggaatgatcctctaattatcttacatttcctttctgtcttttttctttattttggggagaaatagaaacttcctcaagtttatcatctaccccttctattctgtttttgaaatgtgattctatttttaaagtgccttttcctgttgtctggatgttctttttttctttagcatcttctaagcggtttaggttttgttttgttttgtttgagacaggctctcactctgttgcccaggctggagtgcagtggtgtgatctaggctcactgcaacctccacctcccaggttcaagtgatcctcccacctcagcttcctgagtagttgggactatagctgcatgccaccacttctggctagttttttgtttgtttgtttctttggtttctttttgttgttgttgttgttgttgtttggtagagaggaagttttgccatgttgtccaagctggtcttgaactcctgtgctcaagtgatccacctgcctcggcctctcaaagttttggaattataggcatgagccactgtacctgtctagtttgttttttgatggtatatcatctctgatttctctgaggatattaatgatagtgtttcaaattttttgtctctctgtgtaatctctaattttgatctctttcaggtagttcctcaaatgtctatctgtgtttacaagagtggcattgagcacatgagaaagcatgtatgggcagggctggttgactctgagcttccctgttggtcagggtttctcagcttcagtactgttgacattgaaggctggattgtttgttgtgggggggctgtcttgtgcactgtaggttgtttagcagcatccccagccttttccccctagatgccagcagcatccctcctccattgatggcaaacagaaatgtctccagatattgccagatgttctcctggggcaacaccagtcctcacttaccccacccccagttgagaaccactgttgtagggtgatctgttggggtctttttattggggaacctgtagggttagtaggtattggtcttcccccttgggctagtcatataaaccaggaaagaatcttctactcttctgcccgagggattcatcctgggaggcgagtgaaagaagcagagtgttggaggggggtctcaattttctttgtaccgtggccttgtgtgcttcgactgggcctggtgtctcccattcgggaagcctagttctgcccttaccagagaataagtatcatctgcctttcaccaggattggggagcatttatcatgatagggaaggggaaaaggtattaaaaagcaaactcgttccaccctcttgcttgtggctccgcgttcagtccagctgcagaagcaggcgctcttctggttcccatagcttcagaccctcagggaggtctgctgtgcagtccggtgtttaactggcacctcattgctcgctccgaatttggctccgtgggcctgttaagtaagttccacttgtttttttgccttttagcttctaaattttgttattgttatttcttttcctatttcttttgtccttgtggctttatgttttttaaaacaattactgtacatgttagaggattttggagaggtcaaagataaatgcatacgttcagttggctgggacttaactgaagtcttctctttttttatagttagaaacataaatatgaagaacaaagttatagtggtggatattctgttcagggccaggctcctgatgaattaataaagaagttgcttggcatacaggctttgcagcaaagcgagttggatttctgggaggagatttctgtttcatctggatcctggggtcacgtgatcacgttttccttccatacgagagcatgggtttccagtggccaggatctgttgtgtccactagctccagcatccgctgtcttactgttggacagaggtagatagtcactaatattctcattatgcaatttctactttgctagactttgcgtagagtctgtatagaccatgacttttcagttaacatatttttcagataggccaaaacatactccattaggttatagctttctttagttacattgcagtcaccttgattagatttgggtgttttgaagtgtctcagtcatctgaatataaaccgtattacagatgactaataacaattacaaattgattttcattaacttaattttcaaaatgtagccctatctcaaatgcatagagtgtcctactatagaccccataaacacacacacacacacacacacacacacacacacacacacaaaacctgtatatagacatatatctctctaatatattagtatatatatgtatatacaggtatgtgtgtgtgcgcacgtttatatgtctgtgtgtgtgtgtatatatatatacacctttgatatatatgtgtgtgtatatatatatgtgtatatatgtacatatgtatatatacctttgatacaggtatcaaagacattggccaggcaggaagagtacggtgaggggagggtctggacagttttcctaagtgagtagctggtatgtgtgtatggtttggggtggcaagggggcccaggcaagacagagtattccaggccaagaaaagagcacagaaagagtcatgtgggagaagctggggtggatggggaggtgtgggagcagcctatgttcattttggctacagagtagtcgttcatcggagaagccattaaatctaaggtgggaagaggagtttgatgactgcatggccaaccttgaactctgagctacatagtttggacttctaaagggcacggtcttctgaagatgggtgccttgatggagagattaacagagaacatccagtaatacctatttttccatgtagccttttctgtttgtcaagggcagatgtattctctccactctgaatccctgtggcacttagcatcaatggctcttggctcttgtattcatctgtgcctacatttgaggcttccttggacccgtttatcccatttagccctaacaatgacattaagaggtaggtcatactgtctacccctccctctgcaccgcatttttttagtggatgaggaaatagggtcagagatagggaaatgacttgaacaagattacatacatggccagtgagaggccaccctggacctcgggccaggccctctgactccagatctgcattccactgttctcatgacatccccttgctgccagtgtctcactggttgcttaactaagccagtggctctttgaagggagactcacacgatttgattttccaggcagcacataacacaggcccaaacgatggagcacaggctctgacaagactcacttatcggcagcacagggtggggatgagaacagggacctagccggttcctatgcaatttcaccagactgtagggtctatacctctaagtttgaaactccctcatccccactgctgccagcccaactgctccagtgatagttttccaccacttcaccgagagcctgggctcagctgctgccctcactgccctggagaaagagaggaatgacaccacctgtcccgttgctgactctaaggcttttatgagaatacacaaaagagaatagatacttgaaaccactggaatgacagtttatctggtgattttcttataaagttctattgttactagtttcctcctctatctgtactgttgcttctctttgattttgtctcactggctcttgctttgcttcagaaatggcactcctccctagccaggtcctttagagtaggaaatcaagaagttgagctgctagattgtctgaacttcttggaacacagaggatgctagtgtagacatgtgtgcattattgtacagggagccactgaaacctgcctgctgtgtgcaaagtgggccgagaggactccgtggccacatcaaagcccatgtgcatttgactcttttcccttcccagcctttgattttttttgaaaaacgtatttgagatatatcagtttagctattttctcagtattttaataaaatacctgactttagtccttgcctgccatgtaaacctacacacttatttaaaccagcaaaatttctcagtgcgtttg

SEQ ID NO: 20 - DNA, 25807 bp, Homo sapiens
aaagagacttaagaccaatagcagaccaaaagaaaatgcttccttgctactttgtgtctgaagactgtatataaatatacataaaatagcaatttctggccgagcacagtggttcacgcctgcaatcccagcacttgggaggctgaggcgggtggatcacgaggtcaggagttcaagaccagcctgaccaaaatggagaaaccccatcttgactaaaaatacaaaaatcagccaggcatggtggtgggcacctgtaatcccaatcacttgaacccgggaggtagaggttgcagtgagccgagatcgtgccactgcactccagcctgggtgacagagcaagactctgtctcaaaaaaaagcaatttctgggtagaagagctataaattacatatgatcccacaatatgtagggatgttaaagatttgaaagattatggacatatttcagtagctgatgaacataatgtttaggaattactattctgaacatgaaaaaatgtactaggaatagattcaacaaagtagaggcatgggccaaaaaattcatatgctcaatagagatttactcatttagtcaacaaatatttattgaatgcctattctgtgctaagcagtataacaggtactagggattcaaccctgaagaaataaaagttttttctttcacagtgcccacatttgagtgagggaagagaaggagtgaataatcttaggtggtgttaatgctatgaaggaaaacttaagacttattgtagaacacagatgcaagagaagagatgctaacataggcataccagagaagatgaacgcctctatgttaatatcttacctattattcgacttgttagaatttctttatcagaagtaccaatctctcttctcagatagtttgtgggaattctacctgctgcagcagctttttgtctgtagtcaacctgaagcagcaataaaaaaaagttcatataattctttttgcagaaacaaactatactgtatgaatgctaattctcctgaggttgctaacaacacagtctagactcagagtagaaaatgttatttacttagcattttgtatcttttggggagaggaaagttgatagaaatgtttctgcaaagtgattttaaaaaacgttcaggtgcagtggctcacgcctgtaatcccagcactttgggaggccaaagcaggaggaccacttgaggccagggttttagaactgcctgggtaacacagaaagaccttgtctctacccccaacaaaaaaaaaattagttgggcacaatggcctgtgcccatagtcctagctactcagaaggctgaggtgggaggattgcttaagcccaggagtttgaggctgcagtgaactatgatcacaccactgaacaactctagcctgggtgacagagcaagaccctgtctcttaaaaaaaaaaaagtcttctactcaacagtaaaagtggaagaagactcactatttgccacagatgctcattctgatcaagtcaaacattgcttttttttggtatcaactctgttaaatataattgtacaccccttttcataatagaagggagctataaaattctcatgagctcattactaaatatacacagttgtctcttggtatccctgggggattggttctaggacctcttgcagatatcaaaatccatggatgctcaaatccttgatgtaaaacaccatagtatttgtttataacttacgtatatcctctcatatactttaaatcatctctagattacatataatccttaatacaatgtaaattctacataaatagtttttataccgtattgcgtagggaatgacaagaaaaaaagtctgtacatattcagtacagatgcaatttttcccccaatattttcgatccatggttggttgaatccatggatgcaaaacccaaggacatggagggctgactgtacttgcagagtcatactgaagggaaactatgagggcaatgaattcattgcttattcaatgtcaaagtactcatgcacttccaatcttcttgtcaacttacgcacctggacgttccaaattctaaagtatgcttaatcctagtatttgtttatgaagcagtttatactcttttaatgaatcagtatcaaaaaactaggaaaaattctttgttgtgcaagtttgtattttccactcactagacactggacaaaaatattatacattctacactttactcagaccatattacagttcagataaatcagcaaatacttaccaccaaaggcataaactgggaaggggaaggttttgttttactgaccgctgtgaccattactgcagtgtcacctgacttaaacataaagaacaacgctggtaagttcctttgaaatcagatattagcatctaagtagcaactgaataaatccttactccaattaaactcaagaaaagatatctaattctacgacacgattatgaaataaaaaatattcacaagtagtccaatcttgatctctgagcttttcaaaagctatggaatcaaaataaggaaagattaacaggtaatttagtcatattcaatgaattgaatagtattctctacttcttatgtggctatacataaggaaaaattccccaattattactatagaagaaaataccaaaatcactttctctagaaaagcacaacagaatttattaacgcataaaacagaagcccaagtttggaaaggatgttaaacgtcacttaatacggctgggcacggtcgctcacacttgtaattgcagcactttgcgggggcaaggcaggtggatcacgaggtcaagagattgagaccaggccaggcgcggtggctcacgtctgtaatcccagcactttgggaggctgaggcaggcggatcacgaggtcaggagatcaacaccatcctggctaacacggtgaaacctcgactctactaaaaatacaaaaaattagctgggcgtggtggcaggtgcctgtggtcccagctactaaggaggctgaggcaggagaatggcgtgaacctgggaggcggaggttgcagtgaaccgagatcgcgccgctgcactccagcctgggcaacagagtgagactccatctcaaaaaaaaaaaaaaaaaagagatcgagaccatcctggccaacatggtgaaaccccgtctctactaaaaatacaaaaattagctgggtgtggtggtgcacgcctgtagtcccagctactcgggaggctgaggcaaaagaatcgcttgaacccaggaggcagaggttgcagtgtgccaaaatcgcaccactgcactccggcctggagatggagcaagagtccacctcaaaaaaaaaaataggtcacttaatacatgcagtgctctggactctggttgtctggaatgattcttgcagtagaaattatcttagtagtatctgaattaatttccagtaccaaaattctaagtagttacacgatgttgtagttacacatttagtatgagtctccgtaaccatttttaagatgaattttaaaaatctggactttttacctgtactacagcagagccatctgcaaatctggccagctttccagaagatatttctaatttcctgtttaaaaataaaaatgcaatacaagaagacttaggtcatctgtacaattcctgcttagtataaaataataaaagattctaagggaagattctaacccccaacccacccactccaccaacaaaaaggggcagaatccatgatcattatcaaaagtaaaagtggaatttaagagtggcttaaagaagaatacggaaaccaaggcacaggattgatctgaacaggaaagtcttttggaggttcagaagttaactgcttccctaaatgttaattcccatgtaccatctattttttttttgaggtggggggtggtctttgtgccttgtatcttctttttcttttctttttttttttttgagacagggtcttgctctgttgcccaggctggaatgcagtggcacaattacagctcactgcaacctagaacacctaggctcaagcgatcctccaactcagcttcctgagtagttgggactacatgtgcacaccactacacttggctaattttagtttttgtatggatgagttcttactatattgtttaggctggtcttgaactcctggcctcaagcaattctcctgccttggcctcccaaagtgctgggattacaggtatgagccactgtgcctggctccatttaccatcttagtacagtctcttatcatctctcaccttgttgactacagtaatgttttaacatacaaacaggattgtttccctacttaaaaatcctttagccaggcgtggtgtctcccacctgtaatcccaggactttgaaaggctgaggcaggcctgatcacccgaggtcaggagttcaagaccagcctggccaacatggtgaaatcccatctctacaaaaaatatcaaaattagctgggcatggtgttgcgtgtctataatcccagctaccaaggaggccgaggcaagagaactgcttgaacccaggagggggaggttacagtgagccgagattgtgccaatgcagtccagcctgggtgacagagtgagactctgtaacaaaaacaaaacaaaacaaaacaacaacaacaacaacaacaacaaaaaactttagaatttctcccaatgcttttaggacaaaatataaactcctaaatattgcctataaggaccttcatgttcaacagaaggggaaagaacaattttcaattcaatgaggaaagagtagccttttgaggcaatagtggacaactggatgcaaaaaagaatgaatcttcataaattaagtcaaaatggatcctagacccaaacgtaagagctaaaacaataaaagttttagaaacaaaacacaggagtaaatcttcagagacttgggccacacaaagtcttaaatatgacatcaaaagcataaatgacaaaagaaaaaaataggtaagctgatttcatcaaaatttaaaactttaattaagaaagtaaaagaaacaccatagattaagagaaaaatatttgcaaaccatgtatctgataagggacttgtgttaatatctagaatatttaaagaatgcttacaattcaacaataaagacaactgaattttaaaacttggcaaaggatttgaatagccatgtctccaaaaaagacatacaaatggccagtaagtacataaaaatatgctcaatatcattaactatcagggaaatacaaatccaaatcacagtgaataccacttgacagctgttatgaatgttccttgtagcattattcataatagttcccaaatggaaacaacccaaatgtccatcaactgatgaatggataagctaaatgtggtataatccatacaactgattattattcagcgataaaaaggaacaaagtactaatacatgtcacaacatggataaaccctgacaacattatgttaagtgaaagaagacagtcaccaaagactatgtttccatgtaagaaatattcataataggcaaatccacagcgatggaaagtagattagtggttacctggggctggggagaaacgctaagtgactactactaatgaatttctttttagggtgatagaagtgttctaaaattgatggtggtaatggctgcaaaactttgaatatactaatatccattgaactgtacactttatttatctgtatttacttattttgagatagggtcttgctctgttgcccaggctggagtgccgtggtgccatctcagctcatctcagccttgacctcccaggctcaagtgatcctcccatctcagcctcccgagtagctcgaaatacaggtgtgcaccaccatgctgggctaatttttaaattttttgtagagatgaggtctcactatgttacccaggctggtctcaaactcctggactcaagcaatcctcctgccttggcctctcaaagtgctaggattacaaatataagccactgctcccagacgagttgtacactttaaattaactgtatggtatgtgaattatatcttaataaaggtgtcttatatacatgaaataggcagcactattagccttattccctagtttcagcagagaatgcaaaaagaggttactgatgtcttgaaacagaccagcaaaacttgtcaaagagctcaagattcatcaaaaggtgttttgagatgaaaccaagtcagtgacccctgaagatacagagaaagagaaagatgttgtgtcacatgaactcagtttcggcaacattctatcatagtctggtgctgaaaatgcacaaaccaaacacaagcatgtagacaggcccaatgccctaccccaagtaagattattctgtctttcacataccaaggagatgaaggaacaacccttaatattttcacctgttaaatacctttgccagaagcctgagttaatgaaaagcatatttatctattcagttagactcattttgttaagtttgaaagtcagaacaaagtatgtacatttaatatatgttaataaatacaatgattttgtagtatcaaattcttgactctgaaatattagtttttttttaaaatcagggaatatttgagaaattctagttgggtttctatttattcaacacagatgttataatgatgaaagcctacaataaaatgggtctcctgtgactaatgggaatgaggtacagagaggctgatgctggattagtatgttgagtagatggaaggaatgagatactcaaaaccagtcacactgtgtagtatcacagacctgcaacaacctatagctgaaatcagtattaagtaatggtttcatgaggcaaatgtaaatctgacatcttgaaattttgtttaaccctgagtaacatgccaccagtacttctcaaaacttaccaggaactggcattctgtctaccaatgtaaattctgaatacctaagtgatctctgtgaaggggagtggaggatctttaactagacagaagtgggcccaaaacacagggaagaaaaactgtgaaagctacagttctactctactaacggggctactgccttagcattttgcccactgtggcatattctgttgaatatcctcagtgatttgatacatagtagatgctcaataaaagcttgctgaaatgaaaattaaacacctgcctccaaggttactgtaagcattaaatatactatctgaaaaacacctacaataattatataatcttccagaatgcagtaaagaatatatatgataacaaatataatgtgcctggtacatagtagtcactcaataaatgttgccaatggcaaacaagacaaaaatgaaagaatttatccagcaggtatgatattttattagtctagttatttcaacacatgacacgagtttaaaaagaactacctacaaaagaggaacaggttgattaataaatgaaagagtcaaagtagattatttatggaaaatatggagggcagcagctgcatcttgttttcagtatctaatgcctatctcacagtatgtgtctgttgaatgaaatgttctgggcatttctttgaagcatgtgtagtccttgaagaatggaagagatgtccacttccctcaaaaatcagaattaatgaatgctgggagtggaataagccttagagataacctagtctaggggtgaccaaactacagcttgtggcctatttctatattactcttcaattaaaaatgtttatatatatatatatatatatatatatatattttttttttttttttttttttttgagacaaaagtttcactcttatcacccaggctggagtgcaatggcacgatctctgccactgcaacctctgcctcctgggttcaaccgattctcctgcctcagcctcccaggtaaatggaattacaggtgcttgccaccacgcccagctaattttgtatttttagtaaagacggggtttcaccattgtagccaggctggtctcgaactcctgacctcaggagatccacccacctcagcctcccaaagtgctcggattacaggtgttagccactgtgctcggccgttttttaaaatatttctaaagggtttgtaaacacatacacacagtgtgtaccccaaaaagcctaatatatatattatctggtcctttatagaaaagtttgcagacccttgatggaatccactctccacactttgcacaagaaaatggtgaattaacctgttcaatgtcaactacttatcaaagttagagtgcgagacctggattcaaaatgatttttttgctttttgtatgaactggggtccaaattttttcaaagtacacgtaaaaaatttagatatatgaagtttgcattagcaattccatttattctaagaacgattaaagcaaactttttttttaaaaagcggtcccctaaaaaaaagtatgggctttgtaagcaaaaaacagaaattcaaaaaccacctagtcccataatactaacttttttatagactcttagaaagttatctaaccttttttgagcctctgtagtcttaactataaaatgagggtaatagtacctttacgacaggtttaaaaagattgcgaggatcatataactggcgttcaaaaaactgacttttccttttcctcctaacccagggtcatagtggtcacactttaggcaatcaattagattggatgacatgatatcttgtactcctaacttcaagtcatccttccgtcttagcctcccaaagtgctgggattacaggtgtgagcgcctgaccttttgccatctctttgcatcgatctttgcttttgtttctctctgtgtgtctccttgcctctctccctgtcactgtctctctctctcccctgcctccctcttggtctcttttttttgctgtctctttctgatgaccttgttcccatctctgtgcgtgtgtggctctctccctgtccatctcttaccatctctgccttcctctcccaggtcttaaacgaatatttccacaatgtctgtgaactggacctggtgttcaacttctacaaggtaggctcctggtgaagaggaggctgaaggagcccgaggagtgggacgtgggggacccgtggtgcactagccacccggagcctctgctgaggtctgtgtcccagctcgaggggcatcagagccccagcttccagggtccgggccagcatcccggggggcctcgtctcacccacgtcaactcgttattcctaggtggaatgtttcccacttaagagcccagtggtcccggaaagtaaagagatcggaagtcaggtggacggacagagtcggatggagcaaagaagcccggcacacaccaacagagagaacgacatagcgcgggaaggagggtccgaggagacacattccaaacccggaaagggaaatttggaatttaggtttagggtaaggagagattaaatagagctgggataccgggtttctaccctgggagatgaatacgctcaagctggctggacaagacaccttatgacaatacagtgaacgcacgtcactccttacctgttgcctaagtccacggccacagctcgagaccctgcgctactccatagtgctcgcacttgcaactgggtgagtgcccgatcccgccgtggcagaaggaaaggaccatcgctcaggggccggagccggaggcacgagcagcagtacctgcaggccgccatgacacccggcacgcggtcaacgcaggctgtgccctgattggctcactccgcagaccgtggggcggagcctgatggagtttcgtttccgcggtgcccgagggacgccggggtaacggaaaccttggccaccttctacgaagactagagagggtcaaacctatcagaacgcgattatgttgcaaacgatctttgtctttatgtgccaacgaaaggcaattagataaataaggtttttgtgtgtgtactatcgtaatttaaaggagaagtcctagaataatgtaaatgtttaatatgcagagtaaatttatatttacttttaatactagaagtcatagaacaacacattattattatttggatctgtgaactaagaattagaatttgggtggtgggccttggaaagagatctccttctccccttctccgccctggtttttattttaaaaatttcacatagcagatatgttactacagcgatttgtgttaaccaatttacagtaaattcatttttcatcgacttgtaattttagaaatctttattgtcacttctgattcattttcatttccattgctaataattagcaatttatatttctgtcccttttggtcgaactcttaaatgcaaaatgccagctactgtttgaagtaaatattttgtaaaatgaaaaaaaaaagtttttgggatttgaaaaatttttagagaatggataaatttcttccaccccattaatccattctgttagaaattctttatgtttttccttgaatgaaccaatgggcattttcatattatgatgtaaattttttgtgtaaggtgataaccgccttaccccaaagaaaaccaaacaacaaaaacccaacactcattcaaacacagttttaagaattaaaaacgttggctggacgctgtggctcacgcctgtaatcccagcactttgggaggccgaggcgggcggatcacctgagttcgagaccagcctgaccaacacagagaaaccccgtctctactaaaaatacaaaactagccgggcatggtggcttatgcctgtaatcccagctactcgggaggctgaggcaggggaatcgcttgaacccgggaggcggaggttgcagtgagccgagatcgcgtcattgcaacaagagtgaaactcggtctcaaaaaaaaaaaaaaaaaaaaaaaaaaaaaaagtccgggcgcagtggctcatgcctgtaatcccagcacgctgggaggcagaggcgggtggatcacgaggtcaagagacccagggcatcctggccaacatgctgaaaccgcgtctctactaaaaatacaaaaattagctcggtgtggtggcgcgtgcctgtaatcccagctactccagaggctgaggcatgagaatcgcttgaatccaggaggcggaggttgcagtgagccgagatcgcgccactgcactccagaccgagactccatctaaaaaaaaaaaaaaaaaaaaaaaaaattaaaaatgttgatccgtgatgatttaaaaaagaaaaaagaatgatgagctctaaacagacaaatgatttgctggcaaagcagttttctgacaccttgctttcatgagctattattactgatttgggatttccattccaatagagggattaccattaactttgtttacagatttttagtgttaaagcagtttttgcgtctcctcccttttactttaccttgagttgccacagagttttccagaccaatctattgaaatctctcatgaagataaatctctcagaaaacctacttgccacaattgaacatgacttttgatttatagagtaagaatacaaaatcatctttttgttaatatacttaattactatgtaatcattttcatttgggcagtattgcctaatagtttagagcatagacttggagttagtcccagctggttccaatcttgtctctgttaattaccagttgtgtgactctagctctctgagcctcagtttccccataaaaacagatagtaatatgaatctaatagggtttttgtaaggattaaaagtgtcggccgggcgcggtggctcacgcctgtaatcctagcactttgggaggccgaggcgggtggatcatgaggtcaggagattgagaccatcctggctaacaaggtgaaaccccgtctctactaaaaatacaaaaaattagccgggcgcggtagcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagtgtcagatgatataatagtacctagcacattgtcaacactcaataaatggtaaatttagctttcatccagccttttcgtttttttcaagacagagttttgctcttgttgcccaggctagagtgcagtggcgtgatctcagctcactgcaacctccgcctccggggttcaagtgattccccttcctcagccctcccaaatagctgggattacaggtgcctgccaccatgcctggctaattttttggatttttagtagagatggggtttcatcatgttggccaggttggtcttgaactcctgacctcaggcaatccacccgccacggcctcccaaagtgctgggattacaggcatgagccaccgcgcccaggcttatccagacttttcttaattcttcctccagtttccaggtattctgaacatttttctcttcttcagaactccttgaactccttgaatcggttagcttttatccagccagaagtgatggaaagcagcatttacctattaagaatcccccacccccatttcctcacacaaatctgatataattcaaatagtagtaattggatagtaaactcaaaagcaaatgtaggcactaaaatcttgcagcagagctttattatgaagatatagatgatacagaatgcgtttatatgtttatattaagcatttttagattagcgtagaaagaaaaatataataagtttaaattcttgtagttgttactactgaagctataatccgtgaggttcagtctgagatgttattctgcaagtagagttatgtcaagtgtagttcaacagccaaaatataatttaaaagggatttatttacctatgactgctgaaggacattaaaaatgatccaacttaaatccaccagcaacttctcagatctccttttcccttttcttcaaactctgatgaacctgcatcaaaacagttaataccactgcatgttctgaataagcaactacgttaagtaaaacaccattgcattaaattatgcttaactactttttttttttttgagatggagtcttgctctgttgcccaagctggagtgcagtggcacaatcttggctcactgcaacctccacctcctgggttcaagcaattctcctacctcagcctcccaagtagctgggactacagacgtgcgccaccgcgcccagctaatttttgtacttttaatagagacagggtttcaccatgttggccaggctgatctccaactcccaccctcaggtgatctgcctgccttggcctcacaaaatgctgggattacaggcgtgagccacagagcccggccctttaactatattttaatttagtttgtagtttagtttagacaggatatacatttatattgcttttatgactaaaagctgtaacaatatggaagttatattttgttatatagtaacattataattaaaagtatcagcagtccctgaagtgttcaggaaaaaattcttctcttgaaagaatgtagcctactcaactttaagaaagtctgtgctacaccgctaccagaaggatcttctttctcaatcacaaatagaattgtgtctccatcctgattaaattttttcagtggcttcctaaatctttaaggataaaatttaaactgctttgtatagactataagcttttcctttcctattggcctcatcaactttttcttactaccctgtttccttcccttcctcttttcactttatactccaagtaaactgaactgcttgttcccttgcaatacttctcctgcatctgtggctttgcaggtatgattctctgtgcttggcacacactcctcacatgcatcaatcaaacaaactcagtcttcagtactatcctctttacttccctaggcagacttatggatacaatctatgtctgtccttccactttattaatgtatttatgtagttattaattcatctgtgcaagtgaatgtgggaataggtattgcatagtggttaaaagtgctggctctggcatcagattgcctgggtttgcatcttacctctttcccctcctaaacaagtgactcttgataagatacttaccctttctatgcctcagtttcctcttttataaatgggaatgatagtaaatacctacctcccagggttgttatgcagacttaaggcagtcttatttttatgaaactaaggatagtccctggcacatggaaagcatgataaggtgctctaatatttattgaatacttacattatgccagggtctgtgctaggcttgagaccatagagatgtcaagagagccatagggcataatccttgctttatggagcttgcattctagcgagagactgacaaaaacccaatcaaacatacaaacagataaattagaatgtggtttatggagcttgcattctaacgagagactgacaaaaacacaatcaaacataaacagataaattgtaatgtggttaatactaagaaggaaataaactaggtaaaaagagaataatgggatggagagagaacaaacttcaaaaacagtggccagggaatgcattcctgaggagatattttagccaatcccaaggacgagaagaagacaccttctgaaacatgggggccaggtgggagcagtgacttgtagcaggaggggtgccctgagtcaggagagaatttggcttctctgaggatgtggaaaagccagtgtcactagacagtagtaagcaggagagtagtaagcaggtgggtacgaagtagaagaggaaggcagagcatagcacggggtttgggaaaacagcggaaagtttaaacagggaagtagcaggatctagtgtacattttaagatggtcccctctggctgccaggtctagaatggatcagaggaggacaagagagaaatgttgtgatttggactaatgtggtggcatggactgatgtggcggcaggggtgacaagaagaaaggatgggcagattgtaatatattttagaggtggaattgatcagacttgctgatgaattggatacagagagagaagaactaagaccattaataggctcagatgggtcagaaatgcaatgtctgagacaccagagcatagctgtcagcagatatttggatctgagtgcaggacacagaggagaggactaggctaatgtaaatataaaagtaatcactgtgggagtagagattagagagagagtgagtagagagaaaagagaagagggcctggtctgaaccctgaggagggagaggctgcatggctatgaagttggagccagtgttgtgttgatgcaggaggagcgtgagaatgtattatgctagtattttccatttgctcccgtccatccgttctctaccttccttggctttgctctgtgccccagggaactgatcattatggattgcaacaccccaactccctggccctctggctattggttggatcagccaatgggaagtaccagcaggagatacaagaggagagacacactaaaaattaggaagccataattcattatggcaaggcagtggctgtatttctctgccactgtggctcctactgggcaggccctgcttgcccgcttccagctctcactccaattctactgcttctcctccttgctgccccggcattaacacttccccatgggtgctaatgcctcagtgctgcagcactcttcttagtcctggaatctgcctgccactctgtaactagtactttcctaaaattctgttcagaattcacatgagtatgcaatctgtttcctgcttcccttgccacctcagagacaccttggagacgcctctccatactctctcctagcaggaagtcattgttagttgtcactagcagcttgttagcctggaggtgggaagtcaggggcttgtgctgtctgttgttctgattaaccctcagtatcaggcaggcactatgtctcagggtcttgggtgctggtggcattctctgtgttcatacccccatcccagatgtcattctgagcccagcattctttctgtcccttccccaggggtagagagtcttgttctgtttcttccctgagctgcaatcagtttccacagctttttctttctttttctttttttcccctcccctcccctcccctccccactccccctcccctccccctcccctcagccttccccttcccatcccctccccctcccctcccctctctcccctcccctgccctcacctttctcctttcttttccctcttctctgccaccctcccaccttccctttcttccttccttctctctctcttttgggggagggggatctcactatgttgcccaggctggattcaaattcctgggctcaaggggtgctcccacctcagcctctggagtagctggtactacaggcatgctccagtgtgcctggctgcttttcacaatgtcttaggctaatggtgtttgttgccttcccacagcacctaaggcttctattcctttggagagacagggaagaagcatccagtgagggttctgcctttcccacagtgactgtgtcccccttccccaggcctacaccatgagggacactctcaggattcttgctcttacctgagtcttttttgtaaggtccagtgaggtccatggagacaagcttttgagtgattgcaaattcctcttgtgtctatggtccccaggggttctatattctctgggcagctgtcttagtcagcttgagccagaaggccatagactgtttggcttaaacaacagaaatgtatttatttgtttctctttttgagacagagtcttgctctgttgcccaggctggagtgcggtggagtgatgtcggctcactgcaacctctgcctcccgggttcaagcggttctcctgcctcagcctcttgagtaagctgggattataggtgcacgccaccacgctgggataatttttgtattttagtagagatggggttttaccatgttggtcagggtggtcttgaactcttgaccttgtgatccgcacgcctcggacttccaaagtgccgggattacaggcgtgagccaccgcgcctggcccagaaatgtatttcttatacttctggaggctgggaagtctaagatcaaggggctggccagtccaattcctgataggggtcctcttctggcttgtagttggtcactttctctgtgtccttacaaggaaagagagagtagggttataggggagagagagaggcagagagggagggggaaagagagagcagggaagaaggagagagagggaaggagggaggaaggaaggaaggggaaggaagggagagagagaaaacgtgagctgagcaagttccccggtctcttcttataagggtattaatccctgtatgaagataccctcacaccttcatctaaacctaattacctcccaaaggctccatctccaaacattatcatattggggaatagggcttcaaaatatgaattgtggagggacacaattcagtgcacagtaatagcccatactcaggttttagcaattaaagtatttggttgaattcttcttcttgccagtgtttggtggtgactgctccaggtggcaagagctcatgccccagctctctttgcaggtgcccgtctttcctaagatttccggttagtaggttgttctgtctcttcagctctctgatgcgctcaagaagagttgtgaattttccgatggtctggctttgttgttgttactgttgtgattgtttttgttgctctaagagtggggtgctctttccagatttctacagcttaagcagaagccacaggcctctcaaagcttaagcagaagcacaggcctctctctcctctctactactcagggaggtgaagaaagagtctaatttgttcattcccaagttagtttttttttttttgcttcctcctgcttccataattcttatgcctcttccaggattgggacataggataatagaatagaggaaggaatgaaataattcaatttctggagccgatggaattcttctttgaccaacactggatgtttttcatttctaccattactacagacatctaaaatctggccatgatatgggttataggtatgggttacatgggtgacctctgctaggactgccaaactaatgccgtttcccagtgtgagtactctctgggtgatcttttgtgactctcccagcctctgctcctggtagtctactgtacttgtacagctttttttttttttttttttttttttgagatggagttttgctcttgttgcccaggctggagcgcagtgatgcgatcttggctcacagtaacctctgcctcctgggttcaagcgattctcctgcctcagcctccccagtagctgggattacaggtgcatgccaccactcctggctaattttgtatttttagtagagatgggttttctccatgttggtcaggctggtcttggaactcctgaccttaggtgatccacccaccttggcctcccaaagtgctgggattacaggcaggagccactgcgcccggccctattgcacagcttcttactgctgagatcctcttgtcttggctcttagctctcttaggtgaagtaccttcaaaatggatttcttgggttcttttggaccacaaactcatacatccttgtcccccaaataggtaaaattatagcttgtttgaactattgatctctattcttgctctgccatttctggtggcttcaggtagcctctgtcttccaaattctctgtgggaagcaggcactagtgtccatattcttaaatgttcctggtatggccactttgcaatagcaggatagaccctcacccaacattctaattcgatgtcaagactgatgatgtcatacacacacatcaaaagggtgtgaaaaggtgtattctttttttttttttgagacggagtctggctctgtcacccaggctggagtccagtggcattatctcagctcactgcaacctctgcctcttgggttcaagcaattcttctgcctcagcctcccgagtagctgggactacaggcgcatgccaccacgcctggctaattctttgtattttattagagacggggtttcaccatgtagcccaggatggtcttgaactcctgagctcaagcaatctgcctgccttggcctcccaaagtgttaggattacaggcgtgagccactgcgcccggccaggtgtatttctttcataatgaggctttttggggagagcaggacaggcttcacaagctggtttaaaggtgacttgagagagtaggaaaaggagattggcttggagtttttcttctcgtaattgggtggggtggggtgacggtccctgcttatgggtaggcagaggcttctgtggttagaatctcccatgagtgccaaaggagggagcacctgagctttcttatcagcttgcccagatgtgggccacaaggggaagagaaagcggtgagcgttaaaaatgatcaggaatcaaacatcaaaaaatggatttaaattctattaaggcttagtctagctctaggggacatatggcaagacttcctgataactctgttcctgggcctgggcttggcttctaactcatgatagcacaggactattgtacagcttaataaatgtctagttggagagggagatgccaatcttttcctcattctctactgtggttctcttgggctcccattgcttagtttggagggtaagatagggaagagggactctgacttcctccacagagaggggagaaaaatgtcacatcatttctaactaggctggcaactctctacctcaatgcctctcatcaatctgtgttccaaatttctactattctgctttttggctggaatgagtgataggagttaataattatggactagttctgctatcttagattttatagagtgttggggcaattattactcattgttttcagttttagagccttaactcaaattctgaaaccatgggaaaagcgctcattcaacatccggttatacacagaggaggaggaaaatttctttcattgggatggcagagagtgtaaggctgagaacggatgcaggtgaattagtttccttccctctctccctcccttctttcctttctttcttccttccttcctttcttttttttttgacagagtgtcattctgttgcgcaggctggagtgcagtgacacgatctcggctcactgcaacctccacctcctggattcaagctagtctcctgcctcagtctctctagtagttgggattacaggtgtgtgccaccacacccagctaattttttttttttgtagttttagtaaagatggggtttcaccatgttggccaggctgttctcgaactcccgaccttaggtgatgcacctgcctctcaaagtagtgggattacaggcatgagccactgtgcccagccagatgcaggtgcattagaagatttgcttaagggaggatgggaaaaatttatttggcttcagtctctagtgaattttgaggcaaggggagcagctgagagtaaggggggaaagaaggtatgtgaagttaagggaggaagtgattttgggggatggaagagtaagtctattcaagaaacacagttggattgctggacagtggtgccttgctacatggcctttgaagtttgtgatcatgaatttcaagagaaaccagtctattcagttgggtgacttttttttctagcaaattgtacctgtttggtgcaggcatggaaaaagcaaatggtaggattcatctggggttggggttttctaggtgctatgaactaattgtgtccctccacccttcaaattcatatgctgaagctcagccagcacggtggctcacgcctgtaatcccagcactttgggaggctgaggcaggaggatcacttgaggccaggagtttgagaccagcctggccaacatggcgaaaccctgtctctattaaaaatacaaaaaagttagctggctgaggtggcgtatgcctgtaatcccagctactcaggaggctgaggccaggaggtggagtttgcagtgagccaagattgagtgactgtactccagcctgggtgacagagcgaaactttgtctaaaaaaaaaaaaaaaaaaaaaatttgtatgttgaagctctaacccccaatgttgctgcgtttgaagtaaggcagtaattaagtttaatgaaatcttgagggaggagctctgataggattagtttccttataagagacgccggagagcttttgggctttccctctctcctcatcacgtgaggactgtgaaaaggcagccatctacaagccaggaagagagcctcttccaaggacagactctgccagaccttgatctgggactgctagtttccagaactgtgagaaaatacatttctgttgtttaagtcacccagtttatggtattttgttatggcagcccaagctgactattacactaggcaaggatgactgagggagagaggggcaaaggagttatggatgtttgcagaagagtgattataaggaggggaccccgtctgagaagtgaggagcccctccgcccggcagccgccccgtctgggaagtgaggagcgtctccgcccggcagccaccccgtccgggagggaggtgggggggtcagctccccgcccggccagccgccccgtccgggaggtgaggggcgcctctgcccggccgcccctactgggaagtgaggggcccctctgcccggccagcaccccgtctgggaggtgtacccaacagctcattgagaacgggccatgaagacaatggcggttttgtggaatagaaaagggggaaaagtggggaaaagattgagaaatcagatggttgccgtgtctgtgtagaaagaggtagacatgggagacttttcattttgttctgtattaagaaaaattcttctgccttgcgatcctgttgatctgtgaccttacccccaaccctgtgctctctgaaacatgtgctgtgtccactcagggttaaatggattaagggcggtgcgagatgtgctttgttaaacagatgcttgaaggcagcaggctccttaagagtcatcaccactccctaatctcaagtacccagggacacaaacactgcggaaggccacagggtcctctgcctaggaaaaccagagacctttgttcacttgtttatctgctgaccttcccctccactattgtcctatgaccctgccaaatccccctctgcgagaaacacccaagaatgatcaataaaaaaaaaataaaaaaataataataaataaataaaaataaaaataaaaaataaaaaaaataaaaaaaaataataaggaggggaccatgaaatctaggctagacaaggcgctgtggacatgaaaccaagagaaagttgatgaatagtgagaaatggtgggaccaatggatcaaatgttgaattatagcaatgaggataaaaaggtggtggttgttttcaaggttcattcgtgttatagtatatatcactacattcttcctttttgtggctgaataatatttcattggatggatataccatgttttctttatccacttatcagttgatggacatttggtttgtttgcagaaatgtgaattattggattttttttttcccagttaatttttactgggcttctgacatttgcagttaaaaaagtttcacatactggtgagtgtgaatgtcataacaatgtcaattgcacagagtttttatagggattatatatgtaatggacactgctgcactatccagaatacagactgtgtacttgggaaaatcaaggaagagtacattcacacatttagttatccaattggtccagagccccagaactgctcagtttgtttgtccctagggaagatacagaaaatgtatctgctactgctcttttcattgtctgtgaaaagtaagcatttatctaaaaattatgctttcttacttaatttttgtgttttactttttaatatatattttttaagaaacaaacacacctattcctcattgtcatgggttcagtaagaaagctgtgactagatagcactgctggcccacagtttctgctctgaggaaagcagtaacagaggttagaacatttccctcctttggaatggtcacccagctctgctggtgcaggtagcagatatctcttctgtatcttccctaagaacgaacaaactgcacagttctggggttctgggccaactggataactaaaaactcccactttaaggcagaaggtagcagcaggttagatatgcctggatgatatttgctgctgcagtctttttgtttttaattgacaataagggatagtaaaaacctttttcagcctgtttttgtctcttggtgtactgaacttttccttcattccaacacaagacaatcagaaagggtctgcctccagaaaggatcacccctaattttttccagatcttaaaacagcaaggttcaatgtttagaccctcagtgtcatgagtgttgctctgtgtcatgctaccgccaatgaccattttggttatttgctacttctaccaccacccatcattgtcattattcctagggaatagatttttcttgtgctgaccacactcctgatgctttcgtacatgcaactcagtcacaaactgctacagagaaagttttactggtttgtgataaacagaatcaattcacaagtagtctttggtgtttacttgtgtgttcttagattttaactaaatgcagtgcccccctccacaccccataccactggattgttgtctaacttttcacattggttaattgttcttaggatagtggggtcattgttccttctcacaaaacaaaacagtttctttaaaatcaggatgaatgagcagtaattgagcataaaagcctgaccttgccaacagtgcattgcatgcttagtcaaattagtttagaccattacagtttatattaattgtgtttgtcatttgtaattaatgtgaattaaaatttggggaattttagaattgttttggtcaattatgctagtgggaatttcagaacatattaacgtgttctcttgctccttaaaattgttctgtgtttctgtgttttgttaacagaataattatgtctttgacctgattttggaataggctatcttttgttttttattttttattttttttgagacggagtctcgctgtcgcccaggctggagtgcagtggcgcgatctcggctcactgcaggctccgccccgctgggttcacgccattctcctgcctcagcctcccgagtagctggcactacaggcgcccgccacctcgcccggctaattttttgtatttttagtagagacggggtttcaccgtgttagctaggatggtctcaatctcctgacctcgtgatccgcccgcctcggcctcccaaagtgctgggattacaggcgtgagccaccgcgcccagctggaataggctatctttaatgttagctcggggataatgtggaaaccattcttcacccaattttctctggtttcctttgacagttggcataagtctgatcgggagagaagcaatccatacatttgaattttggctcattgtgtaagatgataacattgagccaaatttagaatgtcttagagtaacttgagactttctactgaaatatgcttactgtgtcttggatatgaaacaggtggctcagcagacaagcatgagctgttgtaataaatggactattatatgcaaagaacctttacattatcatcgttaaccctcattaaaatcaaaagcttttagcttctcacagcttattttcttttaaagagatgatgttcaaggtcatgctgtagtctttgaaatgtttacatttaaaataaaacctcgagggccgggccgggtggctcacgcctataatcccctcactttgggaggttgggacgggtggatcacgaggtcaggagttcaagaccagcctggccaagatggtgaaacccccgcctccactaaaaatacaaagattagctgggcctggtggcaggtgcctgtaatcccagctacttgggaggctgaggcaggagaatcgcttgaacctgtggggcgtaggttgcagtgaccccaatgcactccagctgggtgacagagtgagcctccatctcaataaataaataaataaataaataaagcctctgcttattcttgtgaatcaatcttatgagagagatggatttgaagttgagcagtagtatcaactttaatttttttttttttttttttctgagatggagtctccctctgttgctcaggctggagtgcattggtgcaatcttcgctccctacaacctccacctccagggttcaagcaattcccctgcctcagcctctccgggtagctgggactgcaggcacgcgccaccctcccagctaattttttttgtatttttagtagagatgaagtttcaccatgttggccaggctggtctccaactcttgacctcaggtgatctgcacgcctcagcctcccaaagtgctgagattacagatgtgagccaccgtgcctggtcaactttaatattttattgtccttttcagtctctcatatagctttcaaaaattattgagttcacagaaatccactcacatttgcagtttctctttcttttagcaatccttatctctttttttcctggttctcatacgcatcattctcaatatcactaaccatgcatggagcctatatcattacgtgagaaagcacagcaatttctttagtaa

SEQ ID NO: 21 - DNA, 9444 bp, Homo sapiens
atgtgctcctattttgacctcttcacttagactgcggatcttcttttttttcaaatccatcacagctgcattaatattatccaccttaagaaagggaaataaattgaacacatttgagatcataaaaataccaacttatagtatcataagacttagaaaaaactttgagagctcatgcagtctatctcctctgcctgtgggcaggaccattcttaaatcatcataaaaaataagcttaaaattttcagagaagtaagagaagttactaaatttttctaggtaagcaaccacaatgctcagaattttcaccattagtaaatgtttcttcttataatctaaatcatgtatgatatactttataatagtttattctggcagtactattagtgagattgaagacattgctttttcctgagaaccctgggtcctcatctataacaggcaaatgaggtctaccacataaattgactacagattaaaatgaggtaacagataaaaagctttcagtacagtttatggcataataggtacttagcaaatatgagtgtttccctgatccccaaaacttgccctgccaaaacacctggttattacctttgacattatcaagacacacatgaaaatcactattaaattgccatcaaaatgttattccccacccaaaaaaatttcaaactttaatgtttttgcagcctcttctaagttatttctattttcttcatacttatggacactctaggaggagcagatgtgtctctctatacttgacggagaaatgatctgcctctatcttggaaagtcacccacttagactgggaacctaagaaatggatgaaaaggtatgatatgaatggccacattcctaggcagtcataaatcactagtttaattaaaatcactagtttaattaaaaaaaacacacaaaagcacagagactagtttaacacccatgtacctaccattcagatctaataaatattagtatttatacaattttatttccaaagagccaaggattatatgctgaattctaaaaccagtcaaacagctaatgaggatactaaatgttacataaataagctatgatttcttcatatggcacatattctacttgtattcctgatatttcttttttaaacctcatagatatgtcaaagtcacacgtgcctagattctgaacacagctcatttcatgacatcttgcactgtagctggttaattctcatctttttcagaatagaacatgcactagaagctcgtggcaggaacggctcgacccacttagtgaggaaaattggtcctcactgatgtcagacattgtcaattttatcttatttttaaattcatatcaatattattaagcttttcttctgctgcgttaggtgggattggagcagcttttagtctaggactaattttcctcactaccaagccaaagcccttctgagtactcttcccaatgttacggaaattactatgactagtaagaaaaaactatccccacctctgtgtgtggattattccctctaatcctttcaaggggttctattctagcttcctaacatgcgtgcaatactcgaagctccgatgaagacatgaaaggtactacagatctttagagttcactctctgtgcagctctcctttccaggagagagctgtgaactctagcaccatggcctcctcagacttccaactcctatctccgcaactcagggagaccactaagttccacgtggattcccccttcctgcactgcagtctggaaactctctacagccagtaaactgggtaattgtagggctcatcttgtttgtttaccctctctcagaaatcaattcctgtgctgcctgatgtccaatgccagaaatccattatgtcatgtattttgtctaggttgcttgtttgtttcagggaggataaactgatctcttttacaccaacttggccggaatcagatttctaaattggcaggttttttctgtcagcaactaaaaagtgtcattacatgtcattctataatatgtcttttttactttgattgcttttaagattttcttgtcatctttgattttcagtttgactatggtgtgcttaggtgtggttttctttcttttgagacagagtctcactctgtcacccaggctggagtgtagtagtgcgatctcagctcactgcaacccctgcctccagggttcaagcaattctcctgcctcagcctccagagtagctgggactacaggcacacgccaccatgcccagctaatttttatatttttagtagagaaggggtttcaccatgttggccaggatggtctcgatctcttgaccttgtgatgtgcccgcctctgactcccaaagtgctgggattacaggcgtgagccactgcacctgccttttttttttttttttttttgagacagagtctcactctgtcacctaggctggagtgcaatggcatgatcttggcttactgcagcctctgcctcctgggttcaagcgattctcctgcctcagcctcctgagtagctaggattataggcatgtgccaccatgcctggctaatttttgtatttttagtagagactgggtttcaccatgttggccaggctggtctcgaactcctgaactcaagtgatctgcccgacttggcctcccacaatgctgggattacaggcgtgagccactgttgcccggcctggtgtagttttctgtttgccctacttggggttgctgactttcttgaaaccatagagtgatgttttacatcagattggtagtgtccttgtcaactattttttcaattactgcttctgttctattttctctctcttccttttctgggactccaactatattctgctagaacttttgaccatgtcctacatctgtcttatgctctattctgttttctttttcttccatattttttacctcttgattttggaattctagtttctagaactgtgaaaagaataatttctgttttaagccactaagtttgtgatcatttattatagcagccctagaagacaaatataactaccacacatcataccgaaattgaacaacgaagtagatggatggctgatagtgggagctaagtttctcactgttggaatgagaagataaaggctagtgtggtctatgtggtaatggattagagctggagacgtcagtatgctctgaggagtttatgacatttcatgaattctataatatagttatatacagaaatgtgtatagatatgtgtatatatacagtatacacacatatatatctccctgttgtcctggctcagtagggcaagaaccaatgacacacccagtagcaataagcacacttagaacctagatcttggcttctaataccattctccagtagtaggaaccagggctcctagatgaaatgtctaattatatggctagggcaaagagtaaagaagatgaatttggagcatctcatatagaagatgaatttggagtatcttacagtgccagaaaaagaaaggaagtgcttaaaaaacaaacacaaaacacaaaaccaaaaatgatcggggtatgtcaaagggacataagaatcaactgaaagagctcctaatggccaaagctggaacaatctgaggggaaaaaaagtagtattagattgtaatgcaagtcataaaataaatatccacaagtccatactgatataactctctattccttaagtgtgggccttgcataatgacttccttccaaaagaggatagtatggaggagaaaaaaagaacagctttccagtggagaaacctgacaacacctcctcacctgggagatcaaggttaatatcaacagtagtaagtcatgttgatagtatgaatccttgatatgatgtgatgaaaatgacactttacctctatggtcttcccaaaatcaataacatgagtctaataagaaaaatatcacacaaatctcaactgagggacagtttacaaaataactgaacagtaatcttcaaaagtgttaaggtcatcagaaacaaggaaaggagatcctagaaaaaggttagaaaacaaaacaaaacaaaaaaacaaggaaagtttgagaaactgccacatgcaagaggagcctcagcagatacgatgactaaatgtgatgtgctaggggtggaggagtgggggaagggagagcatcaggataaatagctaatgcatacaaggcttaatatctaggtaatgcattgtcaggtgcagcaaaccaccatggcatacgtttacctatgtagcaaacctgcatgtcctacacttgtatcctggaacttaaaataaaattaaaaaaaaaaaatgtgatgtgaaatcctagatgggatcctggaatagaaaagggacactgggtaagaactaaaggaatcagaataaagtacagactttagctaataacaatgaattggtattggttcactaattgtgataaatgtatcaaactattataagatgttcataatttttttaaagcatctgatgagattaaccactgtttataatgagtggatcttgtttttatcctgattagagcaaatcaactataaaaagacatttgtaaatcaatctgggaaatttaatttatgagctgtgtatagatggtgccaaaagatttccctttaattttgactgaagtgccagaaaataaagatgatgtcaccgtggttatttttgtatttcttagagacccaaactgagtaagggtaaaatgacatgttgttcatttaaaataatttaaggaaaaaagaaaaaaagatgacgtgtagcaagagcttgaaaactgttgaacctgggtgatgaaagtactgacatgattttttttctacttctcatatgtttgaacaatttcatgatataatcatgactttttccatagtgcccttttgataactcctatgctacatgtgattatgaatattttcatttatggaacattctatccaagtacaagtatctataattttgacattgcaacccaatgttttagtatactccttcttcaatatccctcaatcatgaattacttcaagcctgggcacagtgtttcatgctgggcacagtggttcatgcctataatcccagcacttaggtggggccaaggtgggaggatggcttgaacccaggagtttgacaccagcctgggaaacatagtgaagccccatctctataatcaatcaatcagtcaggtgtggtggcacacacctgtagtcttagctactcaggaggctgagatgagaggactgcttgagcccaggttgaggctgaagtgagctatgatggtgccactgcactccagcctgggtaacagagtgagaccctgtctcaaaaaactaataaatgtctaaatgacattgcactagcatctacttctacttctgttactatttctatcactaacttcaattttaaagctcttttaccatatttatccttctgttagtgttgctatacattttatgattcttttaagagtactcctaatgctttgtttggcagtaataaaaagaataaaattaaaatgtcttaattttctgaattgaaagtagatgcaatagttgtaagaaatgcagagcaatttgatttgggaaattaaatcagtccctctaagtaaggatgaaagtaacacagtcagtaataacccatcttttaaaaaaagggaggttttcaaacactgcatgttctcactcataagtgggagttgaagaatgagaacacatggacacagggtggggagtcatataccggggcctgttggggggtgggggaaagggggggataacagtaagagaaatatctaatgtagacgacgggttaatgggtgcagcaaaccactatggcacatgtgtaccttatgtaacaaacctgcacgttctgcacatgtatcccagaacttaaagtattaatttaaaaaaggggggggttatggttttttaaaactgcttttatagtccttcaaacaattacagagtgtaccatatagttctggaagactttgcataccactagtgaaaatcggggctatttacttttcttttttttgagatggagtcttgctctgtggcccaggctggagtgcagtggtgcaatctcagctcactgcaagctctgcctcccgggttcatgccgttctcctgcctcagcctcccaagtagtaggtgcccgccaccacgcctggctaatttttttgtatttttagtagagacagggtttcaccgtgttagccaggatggtctcgatctcctgacctcgtgatccacccgcctcggcctcccaaaagtgctgggattacaggcgtgagccaccatgcccggccctttacttttcacttcaacttcttaccagctatttcctttttctttctttctttcttttttttggtatttatctgtatctgagagtttatcttgattctgccccttcacctgcaaattaagagtgacaataacccgaataaaaaatgtttggattgtcacaatcagaattcaaaactttttttttttttttttgagatggagtctcgctctgttaccaggctagaatgcagtggtgcgatctcagttcactgcaacctccgcctcccaggctcaaggaattctcctgcctcggcctcccgagtaactgggattacaggcgcgtgccaccatggctaatttttatatttttagtagagataggtttcaccatgttggccaagctggtctccaactcctgacctcaggtgatcctgcctcggcctcccaaagtgctgggattacaggcgtgagccactgcacccggccagaattcacaatcttcaggtacatctcataacctctttggtcctcagcttccccatctgaaaatggcaatacaatcttgtttatttcaagccaagtaattgggctaaataactctaaccttaaggtatgtaatcctcaatgaccaaattttatgaaaaagtaataatgtacccctcttaactatacatgacatttggacagatttaacaaacataagctttaattttatatacagttgtaatggtgctgatataatgaatgacttcaatcctcaaattggtataaatccatgaaagttaaagtgaaaagtctggattaagtatttgttgtatttgttccaactgtatctcctcaaaagctaaaagctgagtgaattatgcaagcctaacactgtctcactttacatagggttcagatggttccagtcttcttggatttatttcagaagagcacatgttacctaagcttccacaatgactatatagtctagtgggggctatgtggagtatccatcaaatgcttgtctctgctgaaattttcacagtggatagtaaaatatttttttaattccctagtttattgtgaaaagccaaaatgagaataaaattttttaaaaaggagaatattttcctttcttgattgaagaacaaacattacccagtatgtaggaaatgagttacctcactagcctgttactttgaagttataaattttttctttcctaaggaatatatgctgtcaaaaaagatctgcaaaacatataaaagcacaaacaagaaaatgagtcatctattgtctaatcactcagaaaataaaactgctataattgctgcatttctctaccttttgtcttagtttttaaatactattaatatttttctcatgtgcttttccccagcagcctgcaacagtaatttcaagattaccttgaaatcaaatccaacatctctgtctgccactgggaagccaggctcccatgatccttactacctactcatctaaccagccccttctctgtcaccggtccctatgattctgcagcccctccctcagcctcagcactgcactcatcaccctccatgtgctccaaccgtggggctgccctcttcatcccatctgagctcccactcacaattccaggccacaccacccctgcacagaggcctgttaccccatgtgagctgggccactccctgtgctgcagtcctccttgccttttgtgggattcaacatcccgcccggaagcgtcccagtggatacacatcctcctcaccctgtgtggctctgactccccatacctgccccctaccccatgtgaacatctgcctcacccttctcaggccctgctcccataccaggccactccctgcgaggacacccagcttatcccacctgggcttcaactccccacattagtcaccattttcccctgcaacgatgcactccccacaggaccagccctggccctccatgctgggcgtgccctccccacagtgtcggtgcccctaccctgctctggctctcccactccttgctgccgctgcccctcaggtggacgctcttctcaacatccttgggctccagctccctgctctgagctgtgtctcagtccattcgggctgttagaacaaaatacctaaactaggtggctcagaaaaaacagaaatttgtcagtttgagagcctgggaagtccaagatctaagtgctggcagattcaacatctggtgggggattggtggttcacagacagcaccttctcactgtcctcccgtagcggaaggggcaacgggtgtctctgaggcctcttttataaggacactaatcccattcatgagggataggcctactgctcatgaatgaggcctcaggaatcatctccctaaggccccacctcctaacaccatcactttggggttatgatttcgacatatgaattttgaggggacataagcatttagttctaagctggcctcccatgctgatgccctcctcactctgacactgcaagtcaagatgctcccttgggcacaaacgcacaaaccctgctcagactcggacaccttgcactggaactccccatgcatgggcactcagtctctggcttccccggggcaggcagctctcactcatggatgccctcctcaccttgccaggatcccaacaccctgctttaggccagtctggttctccccatcaacaaaaatgactcttctgctctgtcctacctgaagtcttcaggaagggaaggaatggggaggagtcataggtactcaatactgtttatttccttttttgtttttggtaagtagaaagaaatacagtcatgtgtcacttgatgggtacgagtcctgagaaatgcatcactaggcaatttcattgttgtgcgaacatcaccacacctggatggtggcgcctactacacacctaggctacagggtacagtctattcctccttggctacaaacctgtacagcatgttactgaaaactgtaggcaagtgtaacacaatggtgtctaaacacatttcaacacagacaaagtacaataaaaatacagtgtataaccttatgggacctcatgtggactcatcactgactgaaacattgttatgcggtgtgggactgtatttggctaaactagtaa

SEQ ID NO: 22 - DNA, 8810 bp, Homo sapiens
ttgccatcaaaatgttattccccacccaaaaaaatttcaaactttaatgtttttgcagcctcttctaagttatttctattttcttcatacttatggacactctaggaggagcagatgtgtctctctatacttgacggagaaatgatctgcctctatcttggaaagtcacccacttagactgggaacctaagaaatggatgaaaaggtatgatatgaatggccacattcctaggcagtcataaatcactagtttaattaaaatcactagtttaattaaaaaaaacacacaaaagcacagagactagtttaacacccatgtacctaccattcagatctaataaatattagtatttatacaattttatttccaaagagccaaggattatatgctgaattctaaaaccagtcaaacagctaatgaggatactaaatgttacataaataagctatgatttcttcatatggcacatattctacttgtattcctgatatttcttttttaaacctcatagatatgtcaaagtcacacgtgcctagattctgaacacagctcatttcatgacatcttgcactgtagctggttaattctcatctttttcagaatagaacatgcactagaagctcgtggcaggaacggctcgacccacttagtgaggaaaattggtcctcactgatgtcagacattgtcaattttatcttatttttaaattcatatcaatattattaagcttttcttctgctgcgttaggtgggattggagcagcttttagtctaggactaattttcctcactaccaagccaaagcccttctgagtactcttcccaatgttacggaaattactatgactagtaagaaaaaactatccccacctctgtgtgtggattattccctctaatcctttcaaggggttctattctagcttcctaacatgcgtgcaatactcgaagctccgatgaagacatgaaaggtactacagatctttagagttcactctctgtgcagctctcctttccaggagagagctgtgaactctagcaccatggcctcctcagacttccaactcctatctccgcaactcagggagaccactaagttccacgtggattcccccttcctgcactgcagtctggaaactctctacagccagtaaactgggtaattgtagggctcatcttgtttgtttaccctctctcagaaatcaattcctgtgctgcctgatgtccaatgccagaaatccattatgtcatgtattttgtctaggttgcttgtttgtttcagggaggataaactgatctcttttacaccaacttggccggaatcagatttctaaattggcaggttttttctgtcagcaactaaaaagtgtcattacatgtcattctataatatgtcttttttactttgattgcttttaagattttcttgtcatctttgattttcagtttgactatggtgtgcttaggtgtggttttctttcttttgagacagagtctcactctgtcacccaggctggagtgtagtagtgcgatctcagctcactgcaacccctgcctccagggttcaagcaattctcctgcctcagcctccagagtagctgggactacaggcacacgccaccatgcccagctaatttttatatttttagtagagaaggggtttcaccatgttggccaggatggtctcgatctcttgaccttgtgatgtgcccgcctctgactcccaaagtgctgggattacaggcgtgagccactgcacctgccttttttttttttttttttttgagacagagtctcactctgtcacctaggctggagtgcaatggcatgatcttggcttactgcagcctctgcctcctgggttcaagcgattctcctgcctcagcctcctgagtagctaggattataggcatgtgccaccatgcctggctaatttttgtatttttagtagagactgggtttcaccatgttggccaggctggtctcgaactcctgaactcaagtgatctgcccgacttggcctcccacaatgctgggattacaggcgtgagccactgttgcccggcctggtgtagttttctgtttgccctacttggggttgctgactttcttgaaaccatagagtgatgttttacatcagattggtagtgtccttgtcaactattttttcaattactgcttctgttctattttctctctcttccttttctgggactccaactatattctgctagaacttttgaccatgtcctacatctgtcttatgctctattctgttttctttttcttccatattttttacctcttgattttggaattctagtttctagaactgtgaaaagaataatttctgttttaagccactaagtttgtgatcatttattatagcagccctagaagacaaatataactaccacacatcataccgaaattgaacaacgaagtagatggatggctgatagtgggagctaagtttctcactgttggaatgagaagataaaggctagtgtggtctatgtggtaatggattagagctggagacgtcagtatgctctgaggagtttatgacatttcatgaattctataatatagttatatacagaaatgtgtatagatatgtgtatatatacagtatacacacatatatatctccctgttgtcctggctcagtagggcaagaaccaatgacacacccagtagcaataagcacacttagaacctagatcttggcttctaataccattctccagtagtaggaaccagggctcctagatgaaatgtctaattatatggctagggcaaagagtaaagaagatgaatttggagcatctcatatagaagatgaatttggagtatcttacagtgccagaaaaagaaaggaagtgcttaaaaaacaaacacaaaacacaaaaccaaaaatgatcggggtatgtcaaagggacataagaatcaactgaaagagctcctaatggccaaagctggaacaatctgaggggaaaaaaagtagtattagattgtaatgcaagtcataaaataaatatccacaagtccatactgatataactctctattccttaagtgtgggccttgcataatgacttccttccaaaagaggatagtatggaggagaaaaaaagaacagctttccagtggagaaacctgacaacacctcctcacctgggagatcaaggttaatatcaacagtagtaagtcatgttgatagtatgaatccttgatatgatgtgatgaaaatgacactttacctctatggtcttcccaaaatcaataacatgagtctaataagaaaaatatcacacaaatctcaactgagggacagtttacaaaataactgaacagtaatcttcaaaagtgttaaggtcatcagaaacaaggaaaggagatcctagaaaaaggttagaaaacaaaacaaaacaaaaaaacaaggaaagtttgagaaactgccacatgcaagaggagcctcagcagatacgatgactaaatgtgatgtgctaggggtggaggagtgggggaagggagagcatcaggataaatagctaatgcatacaaggcttaatatctaggtaatgcattgtcaggtgcagcaaaccaccatggcatacgtttacctatgtagcaaacctgcatgtcctacacttgtatcctggaacttaaaataaaattaaaaaaaaaaaatgtgatgtgaaatcctagatgggatcctggaatagaaaagggacactgggtaagaactaaaggaatcagaataaagtacagactttagctaataacaatgaattggtattggttcactaattgtgataaatgtatcaaactattataagatgttcataatttttttaaagcatctgatgagattaaccactgtttataatgagtggatcttgtttttatcctgattagagcaaatcaactataaaaagacatttgtaaatcaatctgggaaatttaatttatgagctgtgtatagatggtgccaaaagatttccctttaattttgactgaagtgccagaaaataaagatgatgtcaccgtggttatttttgtatttcttagagacccaaactgagtaagggtaaaatgacatgttgttcatttaaaataatttaaggaaaaaagaaaaaaagatgacgtgtagcaagagcttgaaaactgttgaacctgggtgatgaaagtactgacatgattttttttctacttctcatatgtttgaacaatttcatgatataatcatgactttttccatagtgcccttttgataactcctatgctacatgtgattatgaatattttcatttatggaacattctatccaagtacaagtatctataattttgacattgcaacccaatgttttagtatactccttcttcaatatccctcaatcatgaattacttcaagcctgggcacagtgtttcatgctgggcacagtggttcatgcctataatcccagcacttaggtggggccaaggtgggaggatggcttgaacccaggagtttgacaccagcctgggaaacatagtgaagccccatctctataatcaatcaatcagtcaggtgtggtggcacacacctgtagtcttagctactcaggaggctgagatgagaggactgcttgagcccaggttgaggctgaagtgagctatgatggtgccactgcactccagcctgggtaacagagtgagaccctgtctcaaaaaactaataaatgtctaaatgacattgcactagcatctacttctacttctgttactatttctatcactaacttcaattttaaagctcttttaccatatttatccttctgttagtgttgctatacattttatgattcttttaagagtactcctaatgctttgtttggcagtaataaaaagaataaaattaaaatgtcttaattttctgaattgaaagtagatgcaatagttgtaagaaatgcagagcaatttgatttgggaaattaaatcagtccctctaagtaaggatgaaagtaacacagtcagtaataacccatcttttaaaaaaagggaggttttcaaacactgcatgttctcactcataagtgggagttgaagaatgagaacacatggacacagggtggggagtcatataccggggcctgttggggggtgggggaaagggggggataacagtaagagaaatatctaatgtagacgacgggttaatgggtgcagcaaaccactatggcacatgtgtaccttatgtaacaaacctgcacgttctgcacatgtatcccagaacttaaagtattaatttaaaaaaggggggggttatggttttttaaaactgcttttatagtccttcaaacaattacagagtgtaccatatagttctggaagactttgcataccactagtgaaaatcggggctatttacttttcttttttttgagatggagtcttgctctgtggcccaggctggagtgcagtggtgcaatctcagctcactgcaagctctgcctcccgggttcatgccgttctcctgcctcagcctcccaagtagtaggtgcccgccaccacgcctggctaatttttttgtatttttagtagagacagggtttcaccgtgttagccaggatggtctcgatctcctgacctcgtgatccacccgcctcggcctcccaaaagtgctgggattacaggcgtgagccaccatgcccggccctttacttttcacttcaacttcttaccagctatttcctttttctttctttctttcttttttttggtatttatctgtatctgagagtttatcttgattctgccccttcacctgcaaattaagagtgacaataacccgaataaaaaatgtttggattgtcacaatcagaattcaaaactttttttttttttttttgagatggagtctcgctctgttaccaggctagaatgcagtggtgcgatctcagttcactgcaacctccgcctcccaggctcaaggaattctcctgcctcggcctcccgagtaactgggattacaggcgcgtgccaccatggctaatttttatatttttagtagagataggtttcaccatgttggccaagctggtctccaactcctgacctcaggtgatcctgcctcggcctcccaaagtgctgggattacaggcgtgagccactgcacccggccagaattcacaatcttcaggtacatctcataacctctttggtcctcagcttccccatctgaaaatggcaatacaatcttgtttatttcaagccaagtaattgggctaaataactctaaccttaaggtatgtaatcctcaatgaccaaattttatgaaaaagtaataatgtacccctcttaactatacatgacatttggacagatttaacaaacataagctttaattttatatacagttgtaatggtgctgatataatgaatgacttcaatcctcaaattggtataaatccatgaaagttaaagtgaaaagtctggattaagtatttgttgtatttgttccaactgtatctcctcaaaagctaaaagctgagtgaattatgcaagcctaacactgtctcactttacatagggttcagatggttccagtcttcttggatttatttcagaagagcacatgttacctaagcttccacaatgactatatagtctagtgggggctatgtggagtatccatcaaatgcttgtctctgctgaaattttcacagtggatagtaaaatatttttttaattccctagtttattgtgaaaagccaaaatgagaataaaattttttaaaaaggagaatattttcctttcttgattgaagaacaaacattacccagtatgtaggaaatgagttacctcactagcctgttactttgaagttataaattttttctttcctaaggaatatatgctgtcaaaaaagatctgcaaaacatataaaagcacaaacaagaaaatgagtcatctattgtctaatcactcagaaaataaaactgctataattgctgcatttctctaccttttgtcttagtttttaaatactattaatatttttctcatgtgcttttccccagcagcctgcaacagtaatttcaagattaccttgaaatcaaatccaacatctctgtctgccactgggaagccaggctcccatgatccttactacctactcatctaaccagccccttctctgtcaccggtccctatgattctgcagcccctccctcagcctcagcactgcactcatcaccctccatgtgctccaaccgtggggctgccctcttcatcccatctgagctcccactcacaattccaggccacaccacccctgcacagaggcctgttaccccatgtgagctgggccactccctgtgctgcagtcctccttgccttttgtgggattcaacatcccgcccggaagcgtcccagtggatacacatcctcctcaccctgtgtggctctgactccccatacctgccccctaccccatgtgaacatctgcctcacccttctcaggccctgctcccataccaggccactccctgcgaggacacccagcttatcccacctgggcttcaactccccacattagtcaccattttcccctgcaacgatgcactccccacaggaccagccctggccctccatgctgggcgtgccctccccacagtgtcggtgcccctaccctgctctggctctcccactccttgctgccgctgcccctcaggtggacgctcttctcaacatccttgggctccagctccctgctctgagctgtgtctcagtccattcgggctgttagaacaaaatacctaaactaggtggctcagaaaaaacagaaatttgtcagtttgagagcctgggaagtccaagatctaagtgctggcagattcaacatctggtgggggattggtggttcacagacagcaccttctcactgtcctcccgtagcggaaggggcaacgggtgtctctgaggcctcttttataaggacactaatcccattcatgagggataggcctactgctcatgaatgaggcctcaggaatcatctccctaaggccccacctcctaacaccatcactttggggttatgatttcgacatatgaattttgaggggacataagcatttagttctaagctggcctcccatgctgatgccctcctcactctgacactgcaagtcaagatgctcccttgggcacaaacgcacaaaccctgctcagactcggacaccttgcactggaactccccatgcatgggcactcagtctctggcttccccggggcaggcagctctcactcatggatgccctcctcaccttgccaggatcccaacaccctgctttaggccagtctggttctccccatcaacaaaaatgactcttctgctctgtcctacctgaagtcttcaggaagggaaggaatggggaggagtcataggtactcaatactgtttatttccttttttgtttttggtaagtagaaagaaatacagtcatgtgtcacttgatgggtacgagtcctgagaaatgcatcactaggcaatttcattgttgtgcgaacatcaccacacctggatggtggcgcctactacacacctaggctacagggtacagtctattcctccttggctacaaacctgtacagcatgttactgaaaactgtaggcaagtgtaacacaatggtgtctaaacacatttcaacacagacaaagtacaataaaaatacagtgtataaccttatgggacctcatgtggactcatcactgactgaaacattgttatgcggtgtgggactgtatttggctaaactagtaa

SEQ ID NO: 23 - DNA, 2013 bp, Homo sapiens
tttcttgattgaagaacaaacattacccagtatgtaggaaatgagttacctcactagcctgttactttgaagttataaattttttctttcctaaggaatatatgctgtcaaaaaagatctgcaaaacatataaaagcacaaacaagaaaatgagtcatctattgtctaatcactcagaaaataaaactgctataattgctgcatttctctaccttttgtcttagtttttaaatactattaatatttttctcatgtgcttttccccagcagcctgcaacagtaatttcaagattaccttgaaatcaaatccaacatctctgtctgccactgggaagccaggctcccatgatccttactacctactcatctaaccagccccttctctgtcaccggtccctatgattctgcagcccctccctcagcctcagcactgcactcatcaccctccatgtgctccaaccgtggggctgccctcttcatcccatctgagctcccactcacaattccaggccacaccacccctgcacagaggcctgttaccccatgtgagctgggccactccctgtgctgcagtcctccttgccttttgtgggattcaacatcccgcccggaagcgtcccagtggatacacatcctcctcaccctgtgtggctctgactccccatacctgccccctaccccatgtgaacatctgcctcacccttctcaggccctgctcccataccaggccactccctgcgaggacacccagcttatcccacctgggcttcaactccccacattagtcaccattttcccctgcaacgatgcactccccacaggaccagccctggccctccatgctgggcgtgccctccccacagtgtcggtgcccctaccctgctctggctctcccactccttgctgccgctgcccctcaggtggacgctcttctcaacatccttgggctccagctccctgctctgagctgtgtctcagtccattcgggctgttagaacaaaatacctaaactaggtggctcagaaaaaacagaaatttgtcagtttgagagcctgggaagtccaagatctaagtgctggcagattcaacatctggtgggggattggtggttcacagacagcaccttctcactgtcctcccgtagcggaaggggcaacgggtgtctctgaggcctcttttataaggacactaatcccattcatgagggataggcctactgctcatgaatgaggcctcaggaatcatctccctaaggccccacctcctaacaccatcactttggggttatgatttcgacatatgaattttgaggggacataagcatttagttctaagctggcctcccatgctgatgccctcctcactctgacactgcaagtcaagatgctcccttgggcacaaacgcacaaaccctgctcagactcggacaccttgcactggaactccccatgcatgggcactcagtctctggcttccccggggcaggcagctctcactcatggatgccctcctcaccttgccaggatcccaacaccctgctttaggccagtctggttctccccatcaacaaaaatgactcttctgctctgtcctacctgaagtcttcaggaagggaaggaatggggaggagtcataggtactcaatactgtttatttccttttttgtttttggtaagtagaaagaaatacagtcatgtgtcacttgatgggtacgagtcctgagaaatgcatcactaggcaatttcattgttgtgcgaacatcaccacacctggatggtggcgcctactacacacctaggctacagggtacagtctattcctccttggctacaaacctgtacagcatgttactgaaaactgtaggcaagtgtaacacaatggtgtctaaacacatttcaacacagacaaagtacaataaaaatacagtgtataaccttatgggacctcatgtggactcatcactgactgaaacattgttatgcggtgtgggactgtatttggctaaactagtaa

SEQ ID NO: 24 - DNA, 140062 bp, Homo sapiens
agtgagttggaaagtggccttaggtcacaaacactagccactttaagagaaatgcagctcatctcactgaccttgaaatgagttttgcatgtgcacacacgagtgtgtttatttgtgggtgaaagaaatttatctaaacaattacatacatatgctcgtaataaagcatttaggacatgctgaaaagtaaataaaaataagaatcacttcaaaacccataggccagagatacaatctgtaaatatattttggtggatttcctttcagacttttctctatgtatatattcaacatagggatataaatagatattttcaataaacatagtatgatactattttgtaaactgcttcttccatttgatactatatcttgggtacttttccacaataaaatgttattctatatcatcatcctgcataggattctgttgcttgatatttcttattttaactaaccttccattgattaacatcacatcatttgaaaataatacatttgtttctttcttctctttcttatttcagcatgttggctggaacttccagaactggcccagacagaactcattcttgacttgaacctgattttatagcagtgcctttagtatttcaccattgtttttcacacttcctcttggtttctaataggtttgtaatacagagggagtctttgcattacctctaacactaacagggttttatatttttcttttaagaggataggatggatgttgaattatgtcaaatatcttcataagcagccagtaagatgatggtatagtttttctcctttagcctgtgaatgtcctagtgctgaagccacgttggttcctaagatcatccctgtgttagtggttttgcagatcgggaaggtgaagttgttgccttgaaaatatttcagaaaaggtagcatgctttataacctgtgctatacctgctctttttaactgtaaatcaaggaaattgtcctctatcagttcatagggtgtttcctcattttttttttattgctacagtgttcctttgtgtggttgtgtcatagtttgtttattcaaccagttcccagtagtgatagatatttgaggtgtttccagtcttctgctgcagtaagcaaccccataaatccattattttgtaggtgtgtggatatactttaaagtaaattctcagaaacgggactgctgtgttagaatgaaccaggaagctttcagccttttagagatagattactaacagataaactctgatagactcaggtaaacagagtttagacaacttggctataatatattcctatgtttgataaaacatctgcagacaagacagttgagcctggaattgctgcacgtgtgtgtgcatgtgtgtgtgcgtgcttctttcataccttttatgctttcttcttgatattcatgctttctcatagcgattcacatccttcagtctctcattttttttaatgcacttagattttccagcacatgatggaagcaaggaaggtgatgaaatcattgttagacattgagcagcttggggccagacaccttggcaggtgctctgagtatattatttcgaactctcatttcaaccacaccaagagcccttttgaactctttttacaaaatgaggaacccagagctcagtttgctcaaggtccccagctaggaagtagtaaatgcagagtttgaagccaagtctatctgctccacagccatatcctctttattagccacacccatccaggatttttcccccagcgttcctattcccagtcattcccagctaacaatgagttgggaaagactgatgcgtggtgacatgtcctaatagttaaaaacaataccattcagcttctggcttattcttttaaataacagctctgtgttgctatcttcattttgatgccaatcaggtaaaattaacaaacacttgtggaacatctttcaggtggaaagcatgaggctagttgctgtagggaatacagaagtgtaagtcaagacttatgctggacaagctgaagcttagtcttgccaagcaatatgtacattgactggttaatgtagcctgtttctttttagtgctgaataatattctattgtctggatgtgctgcagtttatttatccactcgcctcctaaaggacatcttggttgcttccaggttttggcaattatgaatgaagctgttataaacatacatgtgcaggtgtttttgtggatatgttttcaactccttttagtagatactgaggactgtgatagctgggaggagaattttttttattatttgaaattttgtttttgaactaaaatggtttttaaggaataaaaagaggaaaattgttgtgctgggatctctgcgtgtctcagcaggttatagcaacactgtccacaacagcatcagacactcagccagatgtgagtcgagttgcctcccgtgtagctgggagcagactcaattgcagagctggtgtcttatactcgtagagctcctctatcctccttgaaccttcaggctctgtctccatgcttctcacacaatgatctcctttgcacaacctcagagcacaacagtgcttcttttctgcacagagcactcccctgtctggacttttgtcgtcctcagccttgcctttttctctccaaatgtagcagagcagttggctcaccttgttttccatatcctctacccatggatttctgttatccctactccctcatccctacaaccctcaacagaagtaaatccaaatcaatgaataaaacaactggactttgtcatatagagggtaattccccaagaaacaggacgctgtattaaactctttcaaaagagtaaatgagttaccttttatatgaccaaattgctttctaaaaggactaatccaagttaaagtgcaaatttaaaagcctctgaataaagcctaagagagaagtacatggcatggacgattgacaaatataatccaagagcaggaagtaaccagatatgaattgtgagatgctgggaattctcccgaagttggtgtcaaacatactcattaaacttgatactgtctgtacaacgaaagggcacagaagggagtggtaatacaacacagggtgcgatccaggaaaataccttatttatagaagagcaaggctgtaagggactgagagcatacagggccaccctagtctcacagctgagcaaattcagggaagccagggccccacctaaaatcaaatctgaacctctgccacctagttcagcactctttgcccatttagaaggcattctgaagtgattttgaaaaaatctttattaatttcttttttgcaaagttaaaatattcatgattaaaaatatatatataaaagtttgtatactgaaaaacatctctcctgcctcttttttttttttttttttttttttaattgagacggagtctcactctttcgcccaggctggagtgcagtggtatgatcttggcttactgcaacctccaccgcccaggttcaagcgatcctcatgcctcagtctcccaagtagctgggactacaggtgcctgccaccatgcccagctaatttttttgcacttttagtagagacggggtttcatcatgttggccaggctggtctcaaactcctgacctcaggtgatccacccacctcggcctcccaaagtgctgggattacaggcatgagccaccgcgcccggccctgcctctcttattaatttcttctgtacccttctagtgtttctttgtgaaaatacaatcaaatataaaaatgtgggaagggggtgagggataaaaaaactaccagttgggttcagtgtacactgctcaggtgatgggtgcaccaaaatctcacaaatcaccactaaagaacttactcatgtaaccaaataccacctgttccccaaaaacctatggaaataaaaaatatttttagaaaagaaagaaaaaattaaaatattaaaatgcattcttatttccattattttttacataaacaatatatcaaggagatccttccacataagtgcatagaaagtgtccttgttctgttttaaattattgtgttgtaaggctgaatcatagtatatttaactaatctctatttatggaccctggggttatttctaatcttttgctcttacaacctgtggcgtcataactaactttgtacatatgtcatctcataagaatgtatatctgtggattcccagaaatggatttgcaaggtcaaagagtaattgcatgtgtacttttgacgaatattaccaaaatactttcccaaaggcctgtaccattttgcatttccatgaacagagtagaagtgtgcctgtctacccacagctagagttagcccttgctggagatctgtcttcccaggttatagtcttcttggactaagattaaattctttcatctcttgaatacatacttgggggcattagtcctgaggcatgctgggtgacatggaaaaccagcattgactcaagaacttggcatggctagagctcaatgtatagtccagagtatcagtgtctgtcaccccagattagctctttcttgcacttctctttgagaggctgtttcttagaatagccttgaatgttgggcaatcaggtgatcaattctaattttatcctcaaagtaatcctggagaagtgagggggcagatatgacttccgcttgacagatgaagaagctgaggcacagagggaagagatagcaccctcttactaccctcttctcttctgagatgagccccagttgtaagattggggtcttgatgaactggagagcattttgagagggcaacactttgaggtggggttgcctcctgctggggaggtgcagatcattcagagggagtagagagcagcacattgaaggcctctccaggctccaggctttagatagaagaaagaaacaatctttagttcaactttgatccctagtttacttgtgttcttgatgttcctttgggccaggggctggacctcattcatcttcgtacctggaacctctaggattagcagggccagggcagcagtacaaacagaggatcccagcccccagtcttcccccttctcttcctggccctggctccatcttgcatctcaaaaagccctgtgcactggcctcagccacccctcaggcctgggagttcactcacaggcagcaaggtcccctctccagacccagagaagatgcttgtccaggccctggaatcaggatcaggactgtttggataggaaattccagggtcccaggtacctgcaagatggcccagaaggaagtttggactccagatgggcacatcccttagggaccatagatttccccaaagaagaaccctctaaaacataggtcctaggtctaagagtgatgctatgggaaataatccagttaaatcatgaattcaaagggactagacaaagctggaaaatccaggtatgaaaaagctagatgcaagtcagagaaatctgttcataagaaggttttaaatggggagaaaggaagcagaggttgtaggagccacataagcaagaaaatataagtatgatacatattatgggatgggatgggatggagctgtcatagagttggggtacattgtcttatagatgttcatggagctggctgtaagtgggagctatccttttccagacagcaattcttgtcttctgtcctctgcttagaaggcagaggtatctgtaaactcagtcacaaaagtccttcccagcctggttgtcaggccattttactccacccagattcagggggccctgcctcaaaggatatctcgttaggtttgttgaaacagaaccttagcacaaaggccctactgcaatacgagtcatgccaaatccatatccactgagaggttccttacaaatataactaagtacaaatacctccaagaaagtcatgccatggtgagttttcctttgactatcagtccttcccacttgagaacgtattcaatttcttctcttctctcaggtatcctaaaacatccctgttgttatttccacttcagagggtcagggcccccaacagcaaaccaatgcccaattaataagcagcagtagtaccaggtttcatggtatttggtcaaatctgcataagctccattttgctttcttacagaatcacagactcctgaagtttgagggaattttttttttcttttttttctttttgtagagacggtgtctcaccatgttgcccagcctagtcccaaactcctggcctcatgtgatcctctcgccttggcctccccaaagtgttgggactacaggtgtgaaccactgtgccctgtcttattgagggagtttaaagcctggtgcttgaatgctgtcaataactgaggtaacttacaaggtacccaagtttacctttgagctactctgacttccaaagggtcttctttaggttcagctgaaatctgtcttttccaattttccaatcattagtcctcatgtcaccccttggggtacacacagaatatctccagcacctttcccagctgacccagactatggcccactttactaccataatccatctgagtcacctctgtggatcagatacctcctaggttttcagccattctccacatgacatggcttcaggaactatcccctacacccacatgctgagtttgcaatgcctcagggggacctccaagtgaagatgccacataggctgttggataaataatctgacattcagagggaggactaagataatggatatagatttgagaatcattagctcatgttgggggtggttgaaggtagttgaggtcacctatggaaactgtaagattaagagaggatggaacctgggggaagatagattgttcaagggtaggtggaggaagatggaggagcatacaagagacatggagaaggagcggttggagaggcaggggaatgaccaagagagtgttaccatagaaactcagggaggagggtgttcaaaatagggatagcagtgatgtctaatatagcagaggcccaggcatttgtcagcttctcagaagaagtgagaatgagaactagagaacatagggctgaggagagaatgggagggcagaagtggaggcagggagtgaagacaactttttgagctgctagctgggaaggggagtcaaaggagtgccatttgtgattagggtgggagagacccgagcttgtttcaatgctaatggaaagagccaggaggaggatgaggtggaagatatgaggagagtgggtggaagatatgcggagaatgggaagaacaccacggctgacatggtcttgaggaagagcgttgggggcatgaaaggacagtggagggaattattcttaaataatctgcagaaaggacagataattcacagagggggaggaaaggcaatgtggatgggcttcagagcagacatctctgaaagaatgtaggggtagggtagagggcaagatgtctagttttgccttgacgtagtagatgaggtcatctgttgccagtaaagggagcaatggtagagtaagggtctgagaataaatgccacatgtgggaataggttcccctgctcctcactaaatgatatgtctcctgcctgaccctgagtagcaccatggctcctgctgccccctaccccatccatggcattggatccaaccattggcctgaatgggacctcagtttattatcttcagcctcgcaggctagattgctgattaatactcttgttgtccaaactcttctcttagataaggcagagcctgggggtgtgggagggattcttccaagtgctttagaaaaatcatttattcctcaagcaatcatacaaagtaggcactagtgttatctccataaaaaaactgaggcacagagagggtaagtaacttgctcaaggtcattcagttggaagagcagagctaggattcaaatctcaggcactggttccagagaccatgttcttaactttctttagtaaaagaaagtgaaggtaacatgcagaacaaaggacagaaggaaggtgaagagacagttctaatggtgtttcagttcctggttcttgtgcttgaggtctctggagaattcctggttcctgctttcttgaggcttaattcttcagttattcatttgatgctgtgagataccccagtgtcattctagtaaaacatgaaattggagagattcagctggaggttctgatgcattcctgggacacttagccttcagtagcccctgatatttggggatctctgatgggtggggtatggcttagccagaggggaatgtgtagcacccagctgccttgcttgtgggagaggatggggctgttgaggttactgagctggaacgggcatggaggtctccattgttctgaccttgcctttcctggattgccccacattccatcctattgaggtgatcactggttcactggcagagatgggacactgtttatcagttccttctgggtttcccttccttccttacccagcctgggacccactagctttttcagctacattctcatcaatgaatcccacctttctctccctgcgcacctgtcagtgtcaggccatctcccagtcctgaatcagccctaccatttattttctctagtcgaactcagctatagaaaattccacagccaggttgagtggttccagaacaaatttatgacttccaacctcagctgtgttcacaatgctgctaaaaaaatcttttcattcagtcagtacttttcagataccccaagtccattgctctgagctctcgccatgctccgtgagtccctcccccaacctcagcacctctcgttgtttgtagcctctatcttcacagctgggggcaggggtgagatgcatattgactgagtagttggtgaagtggtacatgctgtgcctagagtatgaaaagaaatgaaattggaggattctcacatcacactatgaaatctttgtcacttgtttcagtttagagatatgcaaagtcactgaaaagaagcaagttggatcccaggtctggagtatggctttaacctgtctaaaaagaatgtgtctatttacaagggtcttgggcagcctggaagcccaggaaaaaggtaatcccagaggtcaaccattccagccgttgagcaattgcaattgatcacacatacactcatggagttccagtgggaccccgatgagaagggcattgtggtaaacttgagcttcataatgctgcagctgcagcaatttggggaacactgagatctctccatggctcttccgagcctctcaaaaacatttaacacaatcatcaggattagggacctgacagccaagaggtaagtttggcagccctgaggcatttgcttttaacaagctcccatgatgatgtcaactccccaatttatatctctagccctcttgcttgaacttcagactattgacaactgtttacagaacatctgctcttgagtgttgaagtgacatctcaaattcaagatgaccaaaacttaactccttcctctgccctgaaacctgttctatctgcagtcatctccattcagttcatgtttatgatacagctaaaattgctcatcagcatctaatgaagcaacgaagcaactttgtcaatcagacattgttgttttactttctttttcttccataaacttactctatggtagttcttttgttagtatggactttgaactcttcctgggcatctccagacctggtctctcatcaaaaggctgatctcatctaattagggcctgaggactgcaagggagggaagatcaaggggaatcctagaaacctggattccgttcaggcaggaaagcagattgatgatcaatggcctgggtccatgccacttactgcttgtgagactaggaaagttatttactttccagacgattcatagatcaacctaggggagggggtgttgattaaatgagaatatgtatagtcactgatgcatagtaaaagctcagttaactactggtagtaatgctttatcttaggatattctgagctagaaataaagtaaaaaatgaaattgatttgggagcctaaagaaattatcctgaaatgcataaagagaaacatgtaaaatactcattgaaaagctgaaatggaaaatggtcattttcccatagatattggtggttcacttcataaatctttctgaattaatcctttaattcagtatgtatttattgagcatttactatatgttaggctgttaggcactgctctaaatgctgaagaaaaatccgtgagcaaaacaggtgaaaatccctacatttctgaagctaaccttctattgggggtcatatattgaacaaaataaataatactacgggttggaggaaaggagatgattcatttggagtttttaagtagagtgatctgggacctaacgtcatcttctgagctgggggaagatacaaaaaaatcttaaaatatagtcccagccctccagaaatgcacattttggttaaggaaataagacaggattcacatgccaattttggtgatagaacaaacaaggcattattatgtacatggagacaagcaatgttctaaaaggtcagagaagctggggagcaggaagggatgcagcccaaggacttgttggcatgagtggtctggaaaagtctcctgaagggagtggaacttagccgcgaaatagtgaagcaagttttcttccatccttcctcccctcccgttagctgctgggaagcagcttgtgttgcaatgggccaaaatgaaacactaatcttggccttttccaggaagaggctgtcatggggagataccgtaacgggcatagaaaaacaatcacaatagcttcagtggatccccacgtgacctggccaaattggctggagagggaacaagtctttcaggtcaagctcaggctttgaactcagtaggaaccaacccctgcagattcagtaacaccttctacttccaaatctttatagcatgaaaatccaagggggccacagattgctctgagttaaccaccaggagctgccaataggagggtcctcctgcatctctttcttaaggctttgggtttgtacctgtactctagagatgtggccaagccccacttgtggtctgtgttagaggagccccaaagaacacagacacgaaccttgggggtggtagccaggtgtaaagtagggcttgagaagagtgagttcctagtacccattttagattagactgcacaggggagaagacaggcaggatgtgtgaatcaggaaatagattggttctttgggcctaaatgagtgtcaaatctccaaagagtcaagtacattaaattcatcccagcttggtgaggtaggtgctaagtttttctaacaaagtagatgtttgaataattggggccttagatgagtcactatagtggactgggtatggagaggggcagcattattgatctccttttcctcattctccatgtagaattgctactagagtcttacctctattttctcatggctatttggccttcaacttgaaatagtatctagtatgatgcatgggttggataaagatgtcagcccttgtaaaatattgcagttactttgaaaaaaggctggagttctcaactgggatcccttcttaccagctacgtggccttgagcaagttgatgcacgtctctcaggctgttttcttgtctgtacaattggctagtgtaaacttcatgaggttattgtaaggatcaaattagataatgcatgtagagtatagcaccaataattgtttattgttattacttttattatctaaccaattggagatgaggaaaagtaattattaggggacaaatattgtataacgagccgacacaagagtgagtggaaactgtaacttgcctaccaatgcgggctggattcacacttagccagacgtctccaataatgctcccagccctagcagaaccccagttgccctccgaatggtcactggatttgtcccttcctatcttctctccttctccaaacccggccccataatcctgaccttcatttctgctagccctggaatcctatgatttgccctgctcttcttcagctcctcccaacactgcagatgtctttgttctcctatgcgtttggtcctcctcctgcccctcaatccaagggtccatcagtttcatgcaaattaggatcatattctcttcatgaccactcatcctagaagggaaagcttgcaaatgtgcagatgggtttggtgtgagggtcaggatggacagagaagtgcatttattcagtccaacattttctaaatacaaattacattttttaaaaaaggaaattaaaataacaattaaataccatttccccatggcaaaggcaagcaaagaatgaccgtataccctgagtaggtgaggaatataatttggtaacatctttctggagagcaattaggcaatgtatttcaaaagtgttaacattttcacattttctttatcctagcaattccactcttaggaatttaattgagaataagaacaaagatttacaagcttgtcatcacagtaattgcctggaaatagtgaaaaaattgcaaaagatctaagtattcaaaaataaggaattggttgagtaagtagagacatccctgtataggtttactctgtagccataatggataatattgagaaatctatttatggtcaatgaaagatgtttgtcatatattatcatataaaaagcagattataaagcactatgtacagtattttacaatgagtatttaaaaactttttatagaaacagggtcttgctctatcactcaggctagagtgcagtggcacaatcatagctcactgacgcctctgactcatgggatctggtgatcctcctgcctcagcctcctgagtagctaggactacagatgtgtgccaccatgcctagctaatttttaattttttttgtagagatgggatcttgctattattgtccaggctggtcttgaactgctggtctcaggcaatcctcctgcctcagcctctcaaaagcactgggattataggtgtgagccactgggcctggccatatttgcacatttttaaagtttcaaaagatatgtatcaatttatacactagtatcttggtgtttggaggttacaagttattctctattttcttttctttttttttgtatattttctgattcctttatggttaatgtgaattagtcatgtaattacaagccattttaatttgcattaaattactagtaacacattttaggctttgggaattcaaaaaatgaataagagaaggagaaacaacatttattgaattttttttaacattttaggcaatgagctgaatcctttgtataatttaattcatttaatttttaccataattgcatgggatattatgtttccagtttacagataagggaactgaggctcatagaagattagaaactagcctaagattgtacattcagtgggatttgaaaccagatctgacgccaaagaacttatcgatattcatacaggtttaaaatttttccatgacaccacaggagcttgcagtattagaggggctcagaacccacaaacccaaagacttcaggtccaggcagacccagatcagtggctcatgagtgagacaaacatagggtcatggagatgcatagaggggagatctggctgcataatcagggagtgagatctgatgtgaacttgatgtcagatttcaggaatcagcaattgaggctagagcttttcccgaaggccaaagaatgtgggtgcagtggcaaggaggaagagtagggacagatgggttgtctggagtagacgtggggaagtttctgacacaggcagtactggacaaggttgtctgcacgaggtttgttgattcatatttcacggttaatctctttgcatttatttattttatagcattaccacttttgtgtcattgattttcacttctgagtttgcctatttgtttgaaatctcttcatctcatttctattagtttttatactccattgagcacttctcagtgagtgagcattttcacttcacactcatcaaagagccaaatgaggagaggagacaccctaactgcagggattaggtagtaggcttcagaggcagtgaccaagcaggatccctggtaggccactccctctcctctgctacctggaagcagaacaaggctggatctcacccttctgctacctgcatttaactaactaggaagtcatatgggttatattttaaaatatattttaaaaatatgtatctgacaaatgcatttcatgatcctagattggattctgggttggaaaaaattactataaagtacattggcaaaatttgaatgtaggctatatattgtataatagtttgttatcaatgctaaattttccaaatttgttaattatactgtagttatataaaaagatccttgttcttaaaagacagatgctgaagtatttggggttaaggagcatgatgtcagcaacctattcttaaatggctaggcaaaaccaataataatgtgtgcatgtgtgcagattatctatttatctatctatccatctatccaactatctagagagaaataaaacaaatgaggcaaaatattaacgactggtaaatctaggttaaaggtatgtaaatgttcattgtattcttgcagcttttatgaaagttttttttttttttaaaaaggttaacaatttctcttgaagacttctgcttctggccaaagtggagtaataggttcagatttgccctcttgcctgaaacaataacaacaacaacaacaaacacaataaagatatatgaaggaatggttttcaagacatggacatcaggtgacaaatgacagtgattcctgggagttgaggagagttttacaattgctccagcttacagccctgaagaagttcctagggcacagttcaggaaggtggaacccagatggagcctggaaaatgctctgagttgaggaaacagagataagagtatggggagaccaaagcaactagagtttgcaggatagatgatggagaggagagaggtgcacagagagagcccaggagatcctcaggggtctcctcaagatcggttcaactaagtaccaatcagcacatgtgtgtgaggaaaccatctgcgaggattagaagcagcgctgctcagtgctcactcagggctgagaacagtgccagttcccacctgccagattggaaagtcccatgattcctggggcactcagtagtttgtacagaaggtccttgcctcagaagtgggcaataaataaccctagactgagcacttctcagcacccttgaaaaaaaaaatcataaaatcaaaacctgaggatccaactgtttccaagtagtttaacttatcccagagcaaagttcaaaaatatatataggaatccaaaaatatttaacacccagcaaagtacatttacaatgtctagtatctaagcaaaaattaccaggtatgagaagaagtagaaaaatatgacccatattaaaaaggagcctaggcttttcccctcactcagctgtgatgaggcaccccaacccttccttgctggggtgatgtgccctgtaatgaccttctcctcagtgattatgtcagtgaaggccatgtggggacctggaactctcaccctcaccagctgtaatgagacactctaccccagtggagtgtccacagaggccaagtgaggactgtggacttacacaaccacctggcaattatgaagcagcagtcccctttcctgactggcacagtgtcagacagggcctgctaaaacagaaaatttaaataagatataatgtcttatataattcccccaaagcccaggaattaatagaaaatcactcatcatgtcaagaaccaggaaaatctcaacttgaatgagaaaagacaacaaatgccaatgttgagatgacacagatgttgacaaaaattttaaagaaaccattataaaaatgcttcaatgagtagttataaacatgcttaaaacaaatttaaaaatagaatgtctcagcaggaaaacacaagacataaagaggagccaaataggctgggtgcggtggttcaccccattaataccagcactttggggtgctgaggtaagaggatcgcttgagcccaggagtttgagaccagcctgggaaacatgacaaattcctgtctctacaaaaaacacaaaaagagctggtgtggtggtgcgtgcctatagtcccagctaactcaggaggatgaggtgggaggttggcttgagtccagatggcagaggttgcggtgagctgtgattgcataattcaagaagctaatgaacctcaaacagaataaactgaaaagaaatccatgacaaagcacatcataatcaaacttctgtaaaactaagacaagacagaatgagagaaatgacaccttgcacagagagggaaaataatttgaatgacagaaatttttcatcagaaactgtggaggccagagggaggcatcacacatttttcaagtcctgaatgaaaagaactgtcagcccagaatcctaattcagtgaaaatgtcattcaggaataaaagggagattgcctagctatattaaaacattataatttagcctaatgtaattttctaggcagtttcagtcagttttttgctactctctgatgttcaagatagaaaaagttattttacaagcaagctgaatacaaaataatggaaatagtttgtaaaaccagtatatattatatgcctatattgcacatgttaaagcactccattataatacagtatgtaatctactgtttttgaacggttttgttcagcatttggctatttaaaaaatatttataaagagatttatttctttcagttctggaggcaggaaagtccaaggttgaggggttcacatctggtgagggccttcttgctgtgtcatcccatggcagaaggtggaaaggtaagagggcatgtgtgtatatgtgtgacggggtggaaaagagcgagaaggagaaaaagagagagagaagtaagaagatcaaaatcacccttttatcaggaaccctgttttatctgggaaacataacagcattaatccgttcatgaaggcagaggcctcatgaccaaaccacctcttaaaggtcctacctttcaacatggttgcactgtgaattaagtttccaagaatatttggctcttaagtacatttttgttgttgtttccatttagaatttcttttctagagcttgctttaattttattcattcaaaactttgcacttgctttcttttcctatatttatttcctttttaggttatgaagctttttgaggtggaaccaagcacaattcttggatctaaataagcatttgatttaagttatctttgagcttttaataacttaatgaacattctatgctattctatgggaaatgcttgagtttttcatttgcttatattttctttatcaattttgtgtcttttgggtaagtaaaggacataaagtatggaataccttaataagacagtgaattaaatctattcccctgatttaactacgaaaaaagtcaataataagaaaacaatctccccttccccaaataggacaactatttgaacaactattcaaccaaagacaatatatggattggagacaagaggatgctcaacatcattcattagggaaatacaaactaaaaccacaatgaaatattactggttacctattagaatgattaaaattaaaaatactgaccatatcggccaggcatggtggctcacgcctgtaatcccagcactctgggaggctgaggcaggcagatcaccaggtcaggagatcgagactatcctggctaacacggtgaaaccccgtctctactaaaaatacaaaaaaagtagccaggcatggtggcggacgcctgtagtcccagctactcgggaggctgagacaggagaatggtgagaacccaggaggtggaacttgcagtgagccgagatcatgccactgcactccagcgtgggtgacagagcgagactccatctcaaaaaaaaaaaaaaaaatactgaccatatcaagtattggcaaggatatggagcaactagaactttcatacattgccagtgtaaaatggcacagccattttggaaaacagtttggcagtttcttacaaacttaaacatatacctaccatgtgattgagtcatcccatgcctagatatttacctaagagaaatgaaagcacatatccatacaaagagtttatatgaatgctcatagacactttatttataatagtaaaaaactggaaacaacccaaatgtccatcgatggatgaatgaataaatatctatgagatggaatactacttagcaatgaaaaagaatgaagtattgacacatgcagcaacatggatgaatctcaaaatgattaaggtgagtaaagaagccagacaaaaaacagtacatattgtaagcctccatttatataaaattctataaaatctaacataatttatagtgatagaaatcagatcagtggttgcctaggtgtgatggggtgtgggttgcagggggagagataatagaaggccacgagaaaacttttggggtgatggatatgtttattatcttgattgtggggctagtttatcaggcatagtcatatgtgaaaacttatcaaatcgtacactttaaatgggtgtattttattatatgtcaattacacctcaataaagttgttttaaaaactttaggaagaatatgagctataagtcagtcacacattaattaacgttaattaattttctttctttcttttttttttttttttgagatggattcttgctctgtcgcccaggctagagtgcagtggcgctatcttggcccactgcaacctccatctttgggggtaaagcgattctcctgcctcagcctcccaagtagctgggactacaggcgcacactgccgtgcctggctaattttttgtgttttagtagagatggggtttcaccatgttgcccaggctagtgttgaactcctgagctcagacaatccgcttgcctcggcctcccaaagtgctaggattacaggcatgagccaccgcacccggccccggaatctgcatttcaacaagctcttctgatggttcctctgcatctgggagtcgagaagttcttgctctatggcctctgaagttgcttcgaacccaattcagaatctcaacccactcctctgccttttctagtcatagttacttttccttaagtgccacactggcataaaggcgttcgatgttccactatctttcctgcaggtgttcagcacatgatcggtggtttctagggtctgccatgggtcttactaattatttggaaccaaatataacagaaaacaagtttggaattctaaaaaatcccttaaaaacctttttaaaaaatcttggacacagcagctgtgaatggtctgggcctgcctgtgcagttattgctgaaattactggggctgttgagtatttggaaatcaaatcccagaagtgaattggctgtgccaatcagttgtaaaaggatctggccctgggaggtttgatgggtaggggcaaatggggacatgggaagagggtgggaggcttcaggactgcatgaactgagtagaaagatttggcctttggggacagagcatgcaacgggcagctgttcccggtgacctgggcatctgggacttactgagggagagacgtgatcttggcctagctgaccaccatcgaaaccactcatcggaggcgtggatgcagtttgctgggaagatgagcaccgatctgtctggtggtcacatggagggctttgcagatctctgacactggatatttccccttgccctggtgccaaggactaggggagagatcactctgggcttgagtcagggacagggatgccaggcacagcgaaagaagatgactgtggtacaaacccagctgatgaagtggaaaataaataaaagagaaggaatcaagctggttcatgtaggaagcatgcacacactcatcccatccattgttccacatcgggcacctccctgagctagctgccactcctgctgcactctgccactccttggaaggcagcacagggcagtggttagagccttctctttcagtgtcagacaggcctgggttcatgtccaggtctgccactttacttactagctgtgggatgctgatgagcccaagctctctcctagcctgcttcttgatcagtaaaatgacaatgactagagtacctagtatatggagttactgcaggacttgaatgtgccaatacatctaacatgcttagcatagggcctgatcatggttggcatttgataagtgctagttgttatcattattaatattactaatcatcaaagaaagatcttcagttggatatttgggcaaaattatgaaatttatccctaatcttttgatttacagattggtgtggatctgttattaagtgttttctttttttttttttaagttatcttgtttcctgactcctgaattgaagagtgtttcttctatgaatttcttttcttacagaaataaaattgaaagaacttttagagaactgacatgttagacacagtcttgagcttcatagagatcacagtctgtcaggggagaaagaggacgaaaataagcaatttcagtacaggggaggaacatttcaaaaggggaatgtggggtgctaggaaggagggagatgcatgaacttaacacacctgtcacttctgagcaactggtacttccagcagcccctcctgctgccccctccatgcttccctctgaaagcaacacctaataagccattaataagtcagaagaaaaggtttgccatgaagaaaaggctctaagtatatttcttttagtttcttgaaattttcaagtctgattttaggaagttgccataacttgaaaaatttcaaacactgcatgagcatctagcaaaagcttgtaaaataaaatgagtgctcatcacatttagaggaattataaaggcagctgtgatacaggaaaaagagccctagtcttggagagtggagctgtgtatgtgccctggtttcaggtgctgtatgatgatatcaggcatggcactaaactacgatgagcctcagcttcttcatctgtaaactggggatgaggacacctacctcccaggatggtagaaggactacatatgattgtactagatacaaaagtaaaacagtgaacaaacagatgaagattgtttatctgggagtttaaaacccagaatcttccaaacaacagaatgctgaaaatagtaaagactagctaaggtttaaaagactagcatttattgaatccttactgtgtctaagcatggaagacattttatctcatttaattctcataacctgtgagatagatactctcatcatctgcatattacaggtgagaaaactgaggctcagaaaagtgaagtaatttgtcccatattcccaaactagctagtgtcaaagcctgactttttgacactggatgttttgagctcagagcacttttttttttttcttggacattttgagcttagagcacatcctcttttatgttatattcctgtgcttgtgtgtattatctcatttaaaacgcacaatcctatgtggcctgtatattattcccattcagtatgtgaggaaactaagtcacagagagaataaataactttctcaaggtcaccaagtaagtaaactggagtcaggttcaaactcaggcagcctgactccagggcgcttcaaccacaatgctaatggaattattctaaaatgattttaaaaacaatcattcattttcaaaatcatggtatcggaatgcgtgaaaaaagacttgctatggcacagagaacattgtaatggggtaacccgccaggctaggaatgacccaggtatgaccactggtcatggcacaaggccctttctgagcaatataggcagggcagagcctgccatgatggaaatcacagtaacatcatggaggtggcgctggtaaaaaaaaaaccagctctgcccgatgtgcatcgattacaagacctggtggcgaacatatgttttacagccctaaattgcattcgtgcaaatatttatcatccatcccctgccaaatccgcataatggaaaaacaaaccaaaggaaaacctccagaggatgtgaaggctatatcaagtctcttgccaattgttgtgctctttgggcgtaatatatctaaatcttagtaattccaggatttccagtaatctggaatatccgctaccctgtcctgaaagccctcctccagcagtgggccgcccaacttgagttcgctcaatttcctctttcacctgcaggtggcagcacgagtgccgatcgctgtcaggcgagggcgctcaggggtgggagccgaagagagtaatttagggatagaggtgagaacggagttagacacaaaagtaagatcacatgaactccgacttcggatggaacacatcatccatttaaaccctcgagccgagctcaactggaaactccacctaagtaagcgtcgtgggccctggagccccgcggctcagggcaggccggggcggggcggacgcagcgcggtttgcccgcctgtgcggaagcctccgcagtccgcggctggcagggcctggggcggtctttcgcgtgggtgtccgtccctccgcagccgtactgccggcgccagggccggctctgcacatttcgtaaggccttacatggctgcaccccccccgccaccgaggacctgagcccgccggccgccctcccgcgctctcccgcctggggactgcgagctccgcgctgcacctccaagcgggggacgcctgcggactccaccaagctgccttcccccgtactgctgtcccctgtgggagcagaggaatccgacccaggtctgcaggcgagggacaggaggcttctttagacctgacagggtgcgggttattttgtccctcacctttcctgctcagggacctgtcctcctccgtctcgttccatgccttctctcctcctcttaaaggatgctaatcacattcaagccaaaagattagagacttttctgtgtccttcgtcaggaatgcttggatttgttaggaagggaactggatacaacttcatgagatataagggtgtaatttcagacatgtgcgtttctttctaggattatttaaattacacctcaactcacaatcggctcatgccttacaaccatctgtggctaagaggcaagtcggacttcctggtaaaccctcttctcttaggtgaagcatggagctgtgaccttattaacctgaacagcaattgggagcctcaaaatagaaaaagcaaaaactcaggaaagtttatttatttattgttaagacagagtctcactccatcacccagtctggagtgcagtggcgtaatctcggctcactgcaacctccgcttcccgggttcaagtgattctcatgcctcagcctcccgagtagctgggattacaagagcccaccaccacgcctggctagtttttttttttttttttggtatttttagtagagacagggtttcgccatgttagccaggctgatctcgaactcctggcctcaggtgatctgcccgcctcagcctcccaaagtgctgggattacaggcatgagccaccatgcctggccagaaacttctttaatcaacattgattttccaggaatagaagttgtataatagagaaagcagcacctgagtagggccttagagtctagaaggtgctttcagttacaggcttgggagacacccattactcatatggtcttcgataggtaagtattaatccctggtgtttgtagtcatgataattaccacttgtgaacaatgtagctggtgtccattgtcctccaccagtactgcaagacaaagagtcattaactaagtagatgacacactcctcttagtttacactccgtcccacttgccccccacctccatgaaagcaggtatgattattctcctgtaaaattatttttcctcctactttcctgacctgaattcaactgcctttctgtctgctcaaccttctggtgaagatttctgcctctgcccctccccatctcaccttctaattcctacagactcctccctagattgaccacccgggaatgactgtctagattatacattatgaaatttgattatagttgattaaacacattgttaaatattgccctgacttgttttcattctactttctgaaagtataatctgaactagctgtgagctttgagagaacaggaaccatattgattaatcctaggcttaataagatgtattaaaaagagacaataaatatttaacagttgagtatgaagatgaaactttattgatgagaaacaggaaatgtcatccactcaatctttccattaaagtttcctgagtttcaactttgtgccagatcctgtgctggacagtgtagaggaaattaaacatgaggaagacatggtcctgccctgatttgtaggagataaagcattcacacagctcaccagaaggcagtataaatgcctcagagtgctggaagcagagcgctaccattcagaggagcaagaagagagctcctgtggctggtggtcaaagaaaagttcacagagaaagcagcacctgagtagggccttagagtctaggaggtgctttcagaaggcaaagatgttgtgtcaaagttaggcagagggaagagtaggagcaaaattaggaggggaaataagtcgtaaaatttatatgggaaaaccaagcaatgcagtttgactgcagtgatgcaataaaagtagtaagtgatatttatcaagaacctactgtatgctggatattatttactttatatatatatttttcatcttatcctcataatcacacatgaggtagatgctgctaatactaccattttatggatggggaagcagaggctcagatgacttaaataatttacccaaggctatagcactactaggttgggattcgactctggagccatgctattccccctccaagatatgtgtgggaagaagagagaagtgagattagggaaattgtttggcaggtcctattaaattgtaccttaaatgtcagaattcaatttggttaagtaatagggagccactgaagattactgaacaggtaagtcacctaactaaagtcagactttaggaagattgattggtaagatggattggagagaacagagacagaggaggaggagaaaagaccaagtaggaggtgaatgcaaatgggagatgaaaattgttgaccctattcacagtctgaatggagcagtgagaatccaaagtaagaaattgtcatgggagacatgtcagaagtagattctttagggcttggtgacttggtgaagtggacggtgaaggaaagggttggtggtgaatccaaggcattgagctgaatcctgaggagatgcagcattgtggtcaggtgggaggaggcaggctgagctgcttctggatagctccttttggttgcttagtcgtgttggtgggactgcactgggctatattttggtgaacatgcacaacagacagggttgatgcaggtctgggacactgggaaggggttagggatgaagttgtaagatctgggagtccttcacgtgaagccaagggagaaagaacccacctagggaatgagagtaaagagaggaaaagaaagaatctaatggaaccttggggagggattttattcagggagcaggaggaagacaggtcacagaaggcaggagaatgaccagtcagagaggagtgagattgagaggatatcaggaaagccaatgagagaacattttaaggcagagcgtggtcaccagtgtcaaagtactgtagaaagtcaaggagggtgaggactgaatttctttggcaactaaggggtcactggatctaacaaaagaggatgagataaatacattacagctcatgtatgtgacagaatattccacagacattaaaaaccaggttttcaaagaacagggaattggcaaagtgtttataatataatgttaaagaaaagaatgaggaaagaaagaaaaagaaagaaattaaagcgtaagagaggatacaattatgtctataaaacataattccaagtttattttgtctgcctaccttttaaacacaaacagaatattaacatatactagggagttttcctttgttctctgccaggctcttgtgcttttattgagtgaagcaaggttatgagcagagccatggaattagaaggttatgagcagagccatggaactggaatttgaaagactggattgcttcaaattagaaagggcttggagctacttgcatgaaggatccagggaagatcaggaagagggtagcaaagggcaagagtaaaagggtcacgaaggaggcaaagaaggcagaacagcctgggtagggcagagtttgggagtgagtcagacaagggaaatattggctgggttagtgagacctggaggacacaggtggatataaaaggtcttttgtgctggtatttgccagacttaaacgatgtgattctttgtgctatgtatttgaaaaactaaggcaaaaaagtctaaatttatttttaatgactttgaatgttgaatagatgattcatttttttttaaaaagcattcacaatggataatttcaaatcatacacaaaagcagagaaaacgttttaatgaacctaatttactcatcctttgactttaacaattattagtgcatggcaatctgtttcgcctatacccccacctatttcccccatcccattactttgaagcagtcattccatctttaaatatttcaatagctatatctaaaataaatgttccttatgtaagcatagtattatcatgctttaaaaataacaataatttcttagcattactaaataaatattcaggattttcagattcctgattgtcttataatttttgtagtttatttaaattggaatccacacaaagttcaccttttgcaattggttaatctagcttatgaacatctttttaagttacagattcccctttcatctcttttatttttccttgaattttttttcctgaagaaatccacagttgtagggaaaagaaagagagatcagactgttactgtgtctatgtagaaagggaagacataaggaattctattttgacctgtatcttgaacaattgctttgttgagatgttgttaatttgtaactttgccccagccactttgccccagctattttgttccaactttgagttcacaaaaacatgtgttgtatggaaccaaggtttaagggatttagggctgtgcaggatgtgtcttgttaacaaaatgtttacaagcagtatgcttggtaaaagtcatcgctattctctagtctcaataaaccaggggcacaatgcattgtgaaaagccgcagggacctctgccttggaaagccaggtattgtctaaggtttctccccatgtgatagtctgaagtatggcctcgtggggtgagaaagacctgaccgtctcccagcccgacacccgtaaagggtctgtgttgaggtggatttgtgaaagaggaaagcccgttgcagttgagatagaggaaggccactgtctcctgcctgcccctgggaactgaatgtcttggtggctcacacctataatcccagcactttggaaggctgaggcgggcagatcacctgaggtcaggagttcgagaccagcctgaccaacatgaagaaaccccgtctctactaaaaatacaaaaattagccaggcgtggtggcacatgcctgtaatcccagctacttgggaaggctgaggcagaagaattgcttgaaccccaggaggcggaggttgcagtgagccaagattgtgccattgcactccagcctgggcaacaagagcaaaactccatctcaaaaaataaataaataaataaaaaataaatccaccgtctgaattgtgttgatatttccatggtggtatttaacatgttcttctgtccctggtatgccctgtagattagaagctttatctctggccagattgtgggtagttttttttcttctttatatcttttttttttttttttttttgagatggagtctctctctgtcacccaggatggagtgcaggggcgtgatcttggctcactgcaagctctgcctcccaggttcacgccattctcctgcctcagcctcccgagtagctgggactacaggcacccaccaccacgcccggctgattttttgtgtttttagtagagacggggtttcaccatgttagccaggatggtctcgatctcctgacctcgtgatccgcccgcctcggcctcccaaagtgctgggcttacaggcgtgagccaccgcacccggcctatatcttttcatattttctaagttttccactcattattccttaattttatattcagaatttatgaagtaaaacaaagtttaaaatgactttagtagaaaacttttttaaaagaatggctttagaaattaattaacaggaggacaattggtgaaattctaataaagcctatagttttattaatagtattgtctgaaagttaatttcctgcttttgataaatgtcctatggttatgtaatatgttaaagtttggggaagctggacaaaggatatatgggaactctcttcacagttttttgcaaacttgtttaaaaaactgaaatttcaaaataacaaagttacaaaaaagaaagaagaattttagtggagtgatagagattgaaactagattgtagaaagttaagaaacaaagaggagaaagaaaaggtaacctgttggaaacagtggccatttaaaaaatggaaagaaattaggaagtagctcaaagaagtggaatgattaagattattttttatttattttttgttttgtttttaaggctggaagagacttgagcttgcaagtgaaataagccagagaattttgaagatataaaaaggtaataaaattatgtgtatgtatttaaaatgctctgtaagaaaattttttaaaaatgagattattggtataataaaatgggacccagaacagatgggtttgcctggtcaaggaaattaaaacaccacctcttcctctgaaataggaggaatacagaaaaggagtgatgttaacatagagaaactccaaagtggagagaaacagaggtgaggtagtagatgcctgaagacttttcacttgaccagaaaattgaagtgacatccttggctgatggtaagagtcattgggatggagttgaagactcatggagcctagagaattctttgcaagggctgggagggaagcaacaggaagctaactccagatggataaccatggaagcaggaagggcccagatagggttgtggagtgggaatacttagcgggtcctgtggtatagttatgacactttttctagcaaaagtgggcaatcctggagtgagcaggtggtgggtgatctagagtgagggttgccactggggacactggcaggtaaaagggccaagtgtcccaaggatgttagcaagggcagtgcagagtagctggtgtgggtccaggctgagcaggacagtgagggaggccaggaatgtggttgtgcttggtcccatgtggttatatcagccaccatgacattgaccttcatgtattgggttcttggaaattctttgtttagccaaggaagatagttatttcagcataggccaagccacaaaatgatagaatgagagtttacctttttttgtagattgttcctcctcttgcagctctaacatctggatgagccaccagtgggacggtagtggctccaaagaaatgagtctcccttctcctctgggggtttacccactgtctgatattcttggcaccaattcctttctcaggtggggagaatgtgaattgcttctcctagagataacatcttttctattcagcaaggtccaatcacaagtcagttctttgatatctcaggtaggttctgggagcaaactggccaaggactccaaaaagctaccccacactcactcctccagtaaaaaggcatcctataatgttagaaacacatgcttcattctgtaaccactgcttccagccctctcaggtgggtggctttgagaaatcattcctcaagagaaagtgaggaagaggtagttgaaggcaggaatgtgtttccaaaaagacagtgtattagtttcctatggctgccataacaaagtaccacagacctggtgattagcagtttactgacttacagttttggaggccagaagacagagatcaaggtgtcaacaggactggttcctcctgttagctttgagggaaggatctgttccaggcgtctctccttggcttgtagatagataaccatttctccctactttgcttttcatcgtcttccctctatggctgtccatgctggtgtgtccaaagttcccccttctattagattagagtccaccctatgaccgcatctaacctaactaattacatctgcagtgactctatttcccaataaggttacattccgaggtactaagggttaggaattcaacctatgaatttttgggggatacataattcaatccatgaaagaaggattggtatagtctcttctttcttttccctgaccacttacctcctatagactctcatgaccatctttgtgaagtattgaaatttcctcccttgaatccctgtcacatgtccttcaacctccagtccaccttgcgtatgcctgtcaaattcatctttctagaatttccacttctatcatgcatcctgattacaaaccatccatggttctccattgcctaaggaagtggttccaaaacttgccagtttattggactcacgtggaaagtttaaaggcatataggttcctgggctcttctctgatattctgatttaaagtctggggtagggtctctggcactgaaaacaaatctctagacgactttgattgtggggtttgctaatgtaaaaaagaaattcaagttctccacattctaattgaagtttactcttccactttattattctagaaccctttgcctaccagcccccagcatgctgtgacgatcctgccccagtattggacacctgaggaggcgttccctctcctattcctccaactggctcttgtcctgctctcatcccaccttttctttgaagtctcctgccactctatcccactgtcaccttgcccttcttcacctcctgtatcttcctgtctatgttactacctaggcagagctctctagcttctgaaggttcatggatcatagaatcccagggccaagagggccctggacatcctatgtgtttcaaaggtcttccaagctcagagggagaagttgagttccctacgtgatacttcagggccataggtggtagaactgggaagcggttcaggatgtgactccaaacgagaatggcatgagacgcttaggcttctacagctccttcctcactctacgcagccaggtgattgtctgctctgccagggcactggggcgaatgtcttctctgcagaggctgactgaagaggccagggaattggggactcagtatggcagagggcagagcagaagcactgtatttgaagagcggtattaagtaaaagttcacaagccaagcaggctcccctccttacagttcaccgtcatcaggaatacctaagacaagaaacacagtcacttctatctggagaaactgacaagtctaaaagaaaatactgacagaaaggactcatcaacaaaatcgctgggtccccacctaatcatcctatagcaaggcaagacctgacaatcaacaaaccctgctcacatgcactgaactatcagtcggccttttggtttctcactttcacatatgagtgaacagtcatggatcaccagagaccacaacaaacaaaaaacacaggaaaaaaaggaaagtcctaaagtccagagagaagcacaaaaaagaaaaattggatacatataaaggagtgagaggccgagtaacataagacttttcaatagcaacttgaggaattaaaagcccatggaacaatacctttgatatactgaggagagtagtttgaatttagatttttcttacacagacaaaccatccataaagtcttacagtagacaaattcggacatgcaaaatgcttatatcctgtgcattcgttctcagaaagatactggagaatgtgagcctcaaaaatgattaaaccaggaaagaggaagattgagatctgggaaatatgggattcaacacaggagaggacattcagaataatgctggggaagggaagttccagaacagctgtgtagcaggcctcaagaagaaacaatccagtctgcagtaggagaggtacagggctccatggggaaggaaaacaaaataatagatggatcatcagatacatatgaatatgtggaaaactgtatcaagaggctgttagagaataggggaagaagtaatcttagaaacaaagaagctaaacatgaaaatacaagaggacagaggactgcactgaagcatctagtcatgaaaaaaaatgagctgataggttcctgatgtgtttgactgtattgagaggagtgttatgtgagaatttggggaatgaaattgagatgaagaaagataagcaattattaaatcctggaaaaacagaaagttgtgtaagaaaggaaatgtaatcattgcacaccatatgactcagcggcaaataatattctatattaaaaataatgtaaagaataatataaatttaaacaaaaatggaaatataactatattgggaagattagtgcaggaaaattgagtgtgtgtgtttcagttattacactgtttctcagccataagctcacctttttacactctgctctgtgatgctggggctggaacgctgcaaaccacatttcttctttgctggctgtcttcatgttaggctctgtcagtatggaaattagagggatgctgcagagttggaggaggaagacagaaagaacatcttcctgtctgcttacttctctctcaatgttcattcattcatttattcaacaaatatttatttaaagactgttgtctggcccagcactattctaggtgtttaccttccagtagggaaagagaaataataaacaatatacataataaatagataaataaagtatatggcattatgtggaaaaaaagaacaaagaattagagtaagggacattgggagtgcatgggtgaggtgtattataattttatcttattttattttaactttttgagatgtagtctcactgtgttgcccaggctggagtgctgtggcgtgatcttggctcactgcaacctctgcctcctgggctcaaatgatcctcccacctcagcctcctgagtagctgggaccacaggtgcctggctaatttttgtatttttagcagagatagggtttcgctatgttggccaggctagtctcgaattcctgacctcagatgatctgcccacctgggcctccaaaagtgctgggattataggcatgagccaccacagctggcctataagtttatttatttttatttatttattttgcaatggagtattgctctgtcacccaggctagagggcagtggcatgatcttggctcactgcaacctctgcctcctgggttcaagcgattctcctgcctcagcctaccgagtagctaggactacaggcacctgccaccacgcccagctaatttttgtattttttagtagagttggggtttcaccatatttaccaggctggtcttgaaatcctgacctcaggccatctggccacctcagcctcccatagtgctgggattataggtgtgaaccattgtgcccaggctatttttaattttaattaattaattattattattattttgaggcaaagtcttgctctgtcacccaggctggagtgcagtggagtgatcatagcttactgaagtccttcctggactcaagtgatcttcctgcaccagccccccaagtagctagcactacagtaggtgtgcacccccgtgcctggctgtttattttttttgtagcgatgcagtcttactatgttgcctaagctgatcttgaacccctggcttcaagcagtcctctcaccttagcctcctgaagtattggaattacagatgtgacccactgtgctgagccttattatttttattgacacaaaatatagctacatattttctgtgtacatgcaataatttatcccattcatataatttgtaaagatcaaatcagtgtaattgggatatccatcaccttaaatatctgttctttatgcttttctttctgatcactttggttagtatgaacattttaacaatgtttatgctagaaacagttattctcttatcactattttgaaatagaccatagattattgtacactatagccactctactaatttatcacacactaggtcttatttcttctatcaaactgcatatttttacccattaatcaacctctttttatccctctcaccccctagccttcctggcctctggtaacaaccaatctattccctgtcttcattagatccactttttcagttcccacatatgagtgagaacatatgatgtttgttgattgattgtttccttttctgtgcagaagctttttagcttgatgtaaccaatttgtctatttttgctttgcttgcctgtgcttttggggtctttgctcagaaagcaaaaaaatctttgctcagacaaatgtccttgaggatttcctcaatgttttcttctagtagtttcatagtttcagatcttagatttaaatttttaatctattttgaatttatttttgtatgtggtaagaaataaaggtctagtttcattcttctgcatttggttatctagtttaccaagcaccatttattgatgacacttttctttccccattgtatgttcttggcacctttgttgaaaatgagttgtttgcaaatgtggggatttatatttgggttctctattccgttctattagtctatgcatctgtttgtatgtcagtaccattgctttgcagtatattttaaagtcaggtagtgtgatggcttcaggtttgttctttttgctcaagattgttttggctatttgaagtattttgtggtttcatacaaattttagtatttttttttttatttctctgaagaatgtctttggtctttgatagaacctgcactaaatctgtggatccctttggatagcatggacatttttacaatattaattcttccaattcatgaacatgagctatcttcccatttattagtgtccctctcgatttttttcattaatattttatagttttagagatttttcatatccttggttaaacttattgctaggtttttttttgtagctattgtaaatgggattgctttttttatttctttctcagatagttcacagtggcatatagaaactctactgatttttgtatgttgattttgtgtcctgcaactttactgaatctgtttttagttctaacagtttttcagtagagtctaggtttttctaagatcatgttttctgtgaataagactagtctgactttttcctttccatttggaatgtcctttttttctttatcttgactaattactctggccaggacttctagtattatgttgaaaaaaatgttgaaagtgggcatccttgtcttgttccagaccttagaggaaaggttttcaatgtttccctgttcagtttgctgttagttgtgggtttgtcatatgtagcctttgttattttgcagtatgtttcttctatatccaatttgttgagggtttttattagaaaaatatgttgaattttgttgaatactttttcatcatctattgaaatgatcaggtggtttttgttcttggttctgttaatgtgatgtatcacattattgatttgcgtatgttgaactattcttgtatcctgggaagaatcccacttgatcatggtgaatctttttaaatatgttgttgaatttggtttggttaaggatttttgcatctgtgttcatcagggatattggcctgcagttttctttttttgtgtgtgtgtgtcctttatttctctttcatattggaaggatagctttgcaggttacaactattcttggtaagcagtttttgttgttgttgttgttgttgttgttgttgttgtttctttcagcccttcgaaaatgtcatctcactccctgatggcctgtatggtttctgttgagaagtctgttgccagaagaattggagctcctgtatatgttatttgattcttttctcttgctgcttttagggatctctctttgtccttgacctttgagagttcgattattatatgccttggggtagtttatttgggttatacctgtttggtgttctctgatcttcctgtatctggatatttatcttttcctcaagttttggaaagttttctattattatttctttgagtaagttttctattccttgctcttgctcaattccctcttgaacactagtaatccttagatttggtcttttgagccaggcacggtggctcatgcctgtaatcccagcactttgggaggccgagggaggtggatcatgaggtcaggagttcaaaatcagcttgaacaacatggtgaaaccccgtctctactaaatatgcaaaaattagctgggcaaggtggcgcatgcctgtaatcccagctactcaggaggctgaggcaggagaatcacttaaacccaggagggggaggttgcagtgcagtgagccgagattgtaccactgcactccagcctgggcgacagagtgagactccatctcaaaaaaaaaaaaaaaaaaaaaaagagatttggtcttttgaggtagttttgtatattttgtaggtgacctgtatttcttttcattcttttttttctcctcatttctcctctgtgtattttcaaatagcctgtctttgagctcattgattcttacttctgcttaatccattctgctgttgagagcctctaatgaatttttcagttcagtaaacgtatttctgtttcaagatttgtgattttttatactttattttattttatttttaaattttgagacagagtctcactctgttgcccaggctgtagtgcagcagtgcaatcttggctcattgcaatctccgccttctaggttcaagcaattctcatgccttagccaactgaataactgggattacaggcatgcgtcaccatgcccagctaatttttgtatttttagtagagatggggtttcaccatgttggccaggctggtctcaaactcctggcttcaagtgatccttctgcctcggcctcccaaactgctgggattacaggtgtgagccactgcacccagccgcaagatttgtgttttaaaaaactgcttcaatatctttgttaaatttctctgacaaattttggaattgcttttccatgttatcttggaaattactgagtttccttaaaactgccattttgaattcttggtcagagagtttatatatcaccatcttgttagggtcagttactggttccttgctttgttcatttgaggcagtcatagcactctactggctgccgtttcttgtggatgtatgtctatgtttttgcattgaaggattagttattccagtcttctttgtctggcttgttttggtttttattgggtatgtttgcttagagattctttgtaatttatcagttgattttctttcttatgttccactgctaggttgctgcctcctttttggcactaaatggtgccttaagcccgggtttgccctggttctattaaacaaccagagtaccaccagtactgaatggggtaggtctcaagggggaatatcctggtaatatcgaaaggctggttaagagtttatgcccaaggatatgtggaacaaacctacagtgtggtgctgctctaatttggtgtcttctttggctgagagcagttttcacagctggagatggtagtcctgcctcctcagtttccttagggtgatttctcctttcaagcactcccagtgcatcctgtggtttgaggcagggacaggtctcctgacagagaaccaagagggtgggcaagctggttgtccaccccaactcactttttccagtgtagaaaccatgcgtcaggggaaattttctatgcattttgtgctaggcagactggggaaaggggtgtcacagatatggaagtccaagtctcttaccatctgcttggagtttttttcgcttctctgaggccaggagaactttctcatcttcatatttgagttataatttattgctagtgataatctcagcactgtatatttgatcttggttttctttggggtgagtgaagccagcttgtttctacaccagcttgtttctacactcgtttctggttctgccatttcagaaccagaagtctccacaattttaaatagagtggtctgtctgggtagactttattgggaagaagacatgacaaagagaaaacttgagcaaagatttggccttaaatgtgaataggcttggcatacttgaggaatgttcagagaacagtgtggctggaccgagggagagagggtgaaaaaagtgagaaagttgaaattgtttgctgttggaaggagaaaattagaagcaaggagggtttgggcagaagattgcctttcataagtcatgtatgatcatttcctttttcaattgtggacatgttaacttttgtaaaaatagagcttaaacttaaaaattataaatcacaaaatgcaatgtgatttcctgaattggaacagaaaaagaatgttagtggaaaaactggtgaaatctgaataaaggctagttaatcataatgtaccctttttttttttttttttttttagttttagcaagtgtaccatgtaatataagatggtaacattaggggaaactaggtgaggggtatatgataattctctgtattatctttgcaacttttctgtaatttttctaaaattattccaaaataagtttatttttaaaaagcctttaaaacaaacaaaaaattgaatcagctgataaaatgctgccttttccctttccccaattccaagccttgtactcttacctgggttttagcagttggtcattattaggtaggaagatgtgatttacctatggacccgggctgatctccagatggaaggaaaaaggccagcagggaaggctctgtatatcatatctgtggagcatccagctcacagcttcttggtgggtgacattcagaagctgagaagcagaaaccaaaacagaggcatttatgcaggggaaaaacaaaaccaaaaacaaaacattaatgtgtaattcccataagttcttaagaaagcagagtaacaaatatatctttgcaggactttatttcttaatctctgtctctagaactctgtagttatttctaataatgagtagtttcaaagtagaaataatcccagatccttgatcgaatagcttttttcctctctgcagagcttcctaaatatttttggtgggggtgcctgttcaggtgcttctgcagttgatgctgaaatatttccttatgtcagtgctttccatgtataattttacatgcttcaatgtatgaattactagaaatgtgccttaaaaagttttatataattatttagtatggagctagcaaaaaaaaaaaaaaaaaaaaaaaaaggtggcggggcggggagaagaaaaaaaaataatgaagaaaaagcttaatttttggtaactattgcctcctactccctccctggcaagtctttttttgagttttgaggaaatccttttctgctcatgctttttccacatattctaccttcatcctcaattcttctcccttctctattgtttaagttcttgggattaaaatccaggaaggaaagtattttgcatattatttttatattttgccccatgacatacctcctctgagatggagtaggctactccttaaactggggtgaaagaagaagggaaaaagaaaatgagagaaagagagagagagaaaaaaaggacatttcagcatattatccagccacattcagtccacttttcttgcatctaggagtctgcccgatgtattttctgggattgttagcagttaggggatgaacagtgagcactctggagtttgttttgattttatttgtgttcttcacgccttttaaaaaatcacataagaaataaatttattgcagaaaacaaaaaaaagtgatagaaaaaatgttaaaataaattgaaaatcacctttaatctcagaaatacagaaacacttatcctcgtccaaaatatcaccaaccactcagtgccagaaaccaacacacgtagagaaatagaaacaaggggtgaagccctgagcgtgtgaccctgcggctgcagaagcttctgagacccagctgcctgttcttcttttggctttgtggtttcgtgttttgcccatcacattaattttctgtattgaatgacactcttttggttgtggcagaaacccaagttgaatttatttataaaaaaataaatagaaggctgggcgtggtggctcacgcctgtaatcccagcactttgggaggctgaggcgggtggatcatgaggtcaggagattgaaaccatcctgtcgaacacggtgaaaccccgtctctactaaaaaatacaaaaaattcgccgggcatgttggcggatgcctgtactcccagctacttgggaggctgaggcaggagaatggcatgaacctgggagggggagcttgcagtgagctgagatcacgccactgcactccaacctgggcgacagagcgagactccatctaaaaaataaaaataaaataaaataaaataaaataaaataaaataaaataaaataaaataaaataaaataaataaatagaaacaggatgcctgctcagattgcataagtttgaataccaactccatgtggtctttggcatattacttaacctctaaaagcctctgttttctcatctgggaaagggtacccatgttctctggagattgttatgggaattgaataagataagaaatgggcctagcacatgttaatcacttaatacatggtgctagtctagcagtaattgaatagtatgtggtcacccgagtggaggaagttgtgttgttagcatgttattcctagaggaagttggaaggcaggtaacagagggagtgaggcaggccttttctttctcacatgtgcacgcccgtgaactccaccatgacctgctgtaagaattgctggtgtagacagccatgctgctaatatcctcctccaccatgaatacccccagggagcacaagaggccctgactgactatctcttgactaatggtcaggccacggtagccagagtccaggaaaatctcaaacttcatcagtaatgaggggagattttgccacaggttatctgagggagccaagagctctgcagtttgagatagtggtttcagatctgtggagtcacaaaaagtcatgtaagatacctctgagaatttaggtttgttcattctactgagggtagaactgcacattgtatttatgtcctgagcccatctttttgtctttttttttttccaaatcaaatcaactttgagggggatatttagcatctagttaaaacagcttatgaaaaaccagccaaagtctggtaaaaaaaacctctttggaaatgacgaccataatctctggtttgtagatctttactgctcttactaaatgttcaaagagttttctgggttttttgtttgtttgtttgttttttagagattagtatgcacacatgaattaggaagtattcctaaaatcaggaagcaggaagaaagcaggattgagcagagggagaacttggctatgatgttgttacaacgccctcaatggatcctatagagagtgatgaagctagacgtgactttcagagttgtgcagagctggggtgagaaggccaggcctcaacccctcccaccccaacccccacactacctaactggatggacattagatgtgatgttcaaaggatcttaatggaatagttgttgaaacagatctgagatgcagtaaattttggtctgcagaatcaagtcagcattacctcaatcagaatttgtgatgaacatatacaaatacatctggcttgagacagcctagtttgaaaatatacacaggctcagaagggacacgctgtttctcaccaagtcctaggttaggcaatgccactgtaaggtgattgctcctcctaggcaccaggcctgtagcccaggtaaagctgccacttgtgtgaatagtggaggctggcttttggacttatgatccaagcagacaggtttttcctaagtatggttaactgagtcataaactatcacatcctgtataacccatttgtgtttttttctgactaaaataaaactctccattaaaactgaacagcaattaaacgatttctaatctccactttacacacaaggcaacctgcaatttataataagatttgaagacacagaaacatctcttagtttcccacctccccaccgcccccgccactgatctgcttcaatagctggaaatctttgtttaatctgactccaggtctttctttgtgtttgagaaaacattcagactgcatcttctgtggcttctctatgtcccagctgcaacttcaagaaccctgatcagtgcgatcaaagttgtaatttaaagcttttgggaagcccaggctttctctgtattagacagttatcagtcctcattatcaaaccactcatcccctttgttgctctatataatagaaaaagcagcttcctgctcccagtgacttggcaaaaaattgaataagagagagagattatggccatggcaggtgtgcacagcagggtccttcccaaaccccctctcctccgagccttctctaatcagaaggagtcattggtttcccttttcaaaggagcctgtctacttggcctcatcccagggtcgagagtagctcaatgattaaattcagtgacagaatgtagcagctcttcctgctggaacctttccagactacttccaccacagccattaatttcttgaaattaatttttccttttatctaagcagtacacacatatctttaaaagttaatgacagaagtctcctatgaaaaaacagcagtctcctgccccatccactcctttattcttattaagtttttttctttgccgtttatctctatttttattctatttgatatgtgcgtatcattggtttgaggcatcaattttaaactttatcttttggctttctcatgaactacaagagatataactttctttctgttctgatttcagatttatattttttatatattatttcattatattattttatattataaaatgttatattattatgactatgtaaatattgtttattgcagagcaaaggagtatattataatgttttatttttatacatttttggatattcctagggttaataattgcctttccatccatttgcttaaattacttgtttcctttgggtagtatctgaacatgattattcccattgttaaataacttaccagataactttcctgactccatcctcttgcttcaggctgacttgttgctcttggaaacagctgtgcagcatggctctaggccttcccttcatcaacctggaaatcccttttgactcttatttgtgtttgatctcatttcctggatcctaagtctttctttttttttgatttattgaccctctcattttcatggaacatgttcttaaataactattcctgagaaagagtccgtggaagcaaagttttctgagatctttcaagcctgtatttttcctttgtcctcatgcctgactgataatttggctgggtatagaattttagactgaaaataatttttttcctttcagaacctggaaagcagtgctttatgttttctagctttttctgttacggttaagaagtggccattcttattcttagttatttggatgtaattttttttctctttagaaacttctgttcctccttggtgttctaaaatatgatcatggcagaagttatattctttttctggtacctgatgggctcttttaatctttttgtttgaagcatttttaaaaattattatttgtttgataaatttcttctctctcaagtttttgtttgctctttctagaattcttattacttgaatattggactccctgaattgatcctctaattttctggctcattttctttccctattgtttacctcctagttattttgttttgtttttggggagactcccttgaatttaccttccaccctccctattgactttttttttgactgtggctatcatatttaatttccaacttctctgataggtttcctgtttctcctcctcctccttctatagcatcctcttcttgctattatctctccaaagaatacatacagtttttcctctaaagttgtttttcttcttgttcttttcttcaagtcccttttctctgtctgttctggcctttgtttttcaccttgggggtctttttcagatgtctatggatccttaaccattcattaatatttgagtcaatcactaagaatctgatgtgggctctatgggcaggggtagggcttgcttctggtgatctcctttgtaggaccgtggttctcagtaggggcagctcctgggcagtttggaaagttgtgaggatttttagttatcacagttattggggggcctactaacatttaatatgtgggggacaagaatgctagttggattgcaggacagttccacaaaacaaagattgtcctgtatctagggctgccacctaaaataaaggacactcagttaaaatcgaattttggataaacaacaaatacatttttttgtattagtatgtctcaaatattatatgtttatgggccaaatctggcaaccctgtctgtgtcctattctatgtcctactgcacagttatgtgggtgaaaagctctttataatgatttgattcttgatatcagctctgctttatatataaatacaaatacttttttcacatggatttaacataccctgtgattttttaaaatgcagctactatgtaaattgagaggagactggactttgttttgtttagaacttaaccaagggttgtcaccatttagaaaaacatgtcaatggcaacagcactgctcatgatcaaatatgcagataatttttacaattgcaaaaattaggtttgcaattgtccctcttacccagaggggttccaatgcactaacttagatcttatttcaagatggcaaatataagaaatatgacaaaataaaatgaacaatggtatcaacaatattcagttgaatatggtctaacttcttttaaggttggactgttcattgtaaaaaatgaaagcatctaactgtttcattatgtctcccaggtatgctgcccatgtgcctacttagtaaaccatcttgggccgtgaactactttccttttttttctccttcgtaaggacattataatttaaagaaaataatgtgtaggttgattattttaactatgaatttaatttcacatagtaaaagaggtatttcaatatttttgctttaaaaagaaagttgaaggtacctgcaacatggtcaaatctcaaaatataattatgctgactgaaagaagccagacaaaaagaggacatattggccgggcctggtggctcatgcctgtaattccggcactttgggagggtgaggcaggcagatcagctgacctgatgatcgagcctgacctcctggcttgaggtcaggagttcaagaccagcctagccaacagggcaaaactatgtctcttctaaaaatacaaaaattagccgggtgtggtggtgggtgcctgtaattccagttacttggaaggctgagccagcagaattgcttgaacgtgggaggtgagggctgcagtggagcagagattatgccactgcactgcagcctgggtgacagtgggagactccatctcaaatgtcatataattcaatttttataaaattctcgaaaatgtaagctaaccctatagtgaccaaaagatcagtgattgcctgggaatggaaactgggacagagaatggcaatgaatggcacaaggaaacttctggggaatggctgtgtttttaaatcttgattttggtgatcatttcatgagtgcatgcatatgtcaaaaatttccaaattgcacatcttaatcatgagcactttactgaatatcaattatacctcaataaagctgttaaaaaacaacaacaaaaaagaaggtgttgagtctgatagggttgaggccaactgctacagtacatttgtgcaatgacaggatttttgcactgagacacttccaaatgtcagtatctgtaggatctgtatggctttcttccagtatgattcaattttccagattaagattctctagtctctttgctggaggatatgaacctgattgccagcattcttggaaataagcaggggaagggtgagggggtctaaccattcagtgtgcaggcttttactttcttctctattttcaagccatcccctcaccctcccttcccctcttcctgctgtccccagtccagtgcttctctcactactgttaatatttatagcttcccttcccctagaatacaggctttaaacatgtttcaataggacaattataaaaataaaagatttgtttgcaatcatttatctagatgaacccttggatgacagaatcatttggttattaagtgaaaccaggacagacatttggggaaggggatggcattttaaccttttgtggagccattccccatcagacaatcctttgctgccactgccagagataacaccaggtaggatgtggcaatccagatcttttcatctggatgtcagcaacagcaaggcaggggcctggacaggattcaggtcacacagtgtctagctggctggtggagctttgaggtctttatagagaagctctgcactgagattatcatgaagcctgtgagtgttgggggtcagcctgaaggcagcattctctgagtgcttccagcgggaactccctgtcgttcgtgaaggcagccgtgcttctaacactggagtagcagctaccacttgtgagcacttactgcatgccaggcactgtgacaggcacctctgacaaattatttcaatgatttcacaacagcactactgtttttatccccatttcacagatgaggtgactgagactcaaatagatgctcaaagtcactgagctaggaagtgtcagacacaaccacatccatgtggacagactccagagctggagattcgacctgaatccaaatactgttctccccagaactccagttgtgagacttttaagtggagcttggagattaaggaacaacccttttggggtcattcttgctagggctgtatgaagacagcaggtgcacgcaggctactgtgaagtgcggaaccacttggctggcagcctggaatatagaggggcaatcttctcaatgggttgtcagggctaccacattttggacttgctgccaggagacccaggttcaagtccccactctgctgctatctcacattgtgaccttgagtggtcactaatctctcactagatactgggcctcggtagcctcgtctgttaaaggggatgactcaacttgggtaagtctaaagttttctcagctttaaaacgcagggattccatgtgtcacctctcccaggaatatttgtatctgtggaatgaaagaccttttgctgctgtctcagagaagtatttatgcaggtcaggggtcctttcccaatgcgttggactcatccatctggaggagctcttctaccgaagggcactaccttctcaccaggctgtggcagcagaggggttaaacagcatgccctgccctgctccaggcagaagggttgtaggacttaatcacgtttcagcttggctgtcgggctgtgagtcacggttgcactgcgattatgtaagcacgcaggaataggtggcatgacatatatgctgccagcagccacgggcctcgcccttccgagtcaccactactttttaagcctttttttggatacaagtttctttgggttcatctttggaatggaaatggaagcatgattgcagaataggcagaacaggaattatccatcaatcagagagaacccagccctttaagagaagctggaattagaatatggaattcctgagccttgagctggcatagccgagccctggtttatgctcttcctgcctccctccttttttccctcctgcctgtgtgctccacttcctctcctgagactcccccaaggtagcatcactcccaccaggagcctcaggcaggaaaaataaggcccagagaagggactgtccctggggacgtgcactgagtgtgtgtgagggtgcggggcaggaataggagtgccaggagtctacctctggagcaatgcctcccacagtatttctgtaggggaaaggatagaaactcacttcttgggttcctccaatcaccatgcacatgtcagtccttcagctataaatgcaaaggaaagccagaactgagatttgagctttctcaccatctccatggtcagatatctccactgccaaagggttcattccgcctctgggtttatctctttcttcatgcttcttcctggcagtgtcctgttgaagcttaccttcccatctgtgtttgcatccactccctaaaaaccacaagacaaaacaagaaaataaaagcctcctcccctcacttaatccacggttcttttttcttcctgcttacaaatttcttgaacttgtatgtctgtccttgctgcttccacttcttcatctctcatttgtgtctgatgcaatagggcaatgaagtgtccttgtggtccctggtgaccttctcatcgctcaatcccaaggcctttttttagtcttcatccaatttaacctcttggcaacatgtgacatgctgccagccagctgctccctctttctaatgctctctcctcttggcttctgtgacccatctctttactactctgtctgtttctccaatgccctcttcctggtctctcttgacatcttctcttccctgatctgcatgccacctatatggtgtacgtcctcatgtatttataagtaagtaggtgtttatttcttgtctccttcccaagaggatttaaataggtggcacaaatatacactacactagggtaataaaatagggagtaagatgcaactggtggagaattaagatcaaattggccgggcgcggtggctcacagctttaatcccagcactttgggaggcttaggcgggaggatcacttgaggtcaggtttggccaacatggcaaaaccccgtctctactaaaaatacaaaaattatctgggtgtggtggcgcatgcctgtagtcctagcttctcaggaggctgaggcaggagaatcgcttgaacctgggaagcagaggttgcagtgacctgaggtcacactactgcactccagcctggatgacacagtgagactccatctcaaaaaaaaaaaaaaaagagtaagttgtagccataataaatgaagaagataaaacattattccaaaagacactataaaatcattagtccacccaaccaatctgatcctgtgactctcctaccaaaaagattccaatgatgcatgattgtccaactccctatatagcctttcacagtctaatcccagtgggcttttccaggtcatttcctgtttttgagctttgctacaagctgatccctcttcttaaagtgcccccctgtccactttcctcttcttggtgctgcctacttgacaaatagctacttggtttttaagacagcttcaacgtcaccacttctgtgaagatttcccctgcaaaatgtatcactcctttatggtagcaaataactaaacttctgtaaacctcagtttctgcatctgggcaatgggaattataatagaaccctaattcattgtgaggattaaattagacacacatgcaaagtgcttaatatagcacctgggatgttgcaagcatttactaaatgtcagctagtattatacctccttgtaaatggagggaacaatagtccataagactaagatatgttcccaagttaattaggatccaatggtacagttagcctagggcgcaggctactctgtccctgccatatattctctcaaaagttcttcttcctcagttcctggctgtccccttctggaaaatcctttctaattccaaagttgatcccctcaagtataaacactactagcttgtttaactttattggcacacatgtgagcacaggtgcggttcttgaccggcttcagctctaatcctgttgcctcggtcttgctgagatcattgtctctctaactcactactaaaagtctggtctcaacctgtaccaggattgccaaatagattcagaagtcaaggagaaggcatcccatgcccgtagccagctgagtagaggggctgccagccccagccaaggcgtttgctgaccctcagctccaggaaggcctgggtgaccttaagtctggcacacggggcaatgaactgtggtagctgccaggggtgggttcctgagggccaccttctcagcagccttctgcctaccccacctggcaggacatggatgtgcgtgcaggcctgtgtatgtctctctgtgtgcaactctcctctttggtggattcagggtccttgtgtcatttttcaaggtgtcagtcaagaagcatccttagactggagtcagagcctcatgtcttcaaccagtagctggggaaagctcataataattataccaatactaaggcatggctggtattatccaaaatgagaaaagaagagagtaggctgaagaggccaaatagctcccacaaagtcacacagcttgttagtggtgcagacgacagcccagctctcctgaccctgggcgtgggtttttgcgttcatgtctcatgcccctgtcaggaaagaaaaacacacgagggtccttggatgaccatatatggcaccctacaaatgaaagctactgtgttattatcttgcactcgcagtaagtgcctcataagaacatgcttgggatgacatacatggatctgcctcaaggagggaaatctcagaccctggaaagcaggcattgcacatgaaaatgaagaatgggctgagtgagcacatggcagcgccgtgttgggttccagctctgagatctcatgcaggactctctcagcttctctagctgtaacacgagagtttggcagagatcacattaaagttccccttaataaggggttttcatgtggtgtcaaattgttcctctgaaataagtattaaaaaaaattatagtgagcacatggcatcttgactttgtgtggagctgacaaaacacttcccattgtatgttcacatgccaaagcatgtttcattttatcttattttatgtagcacattctttttcatcctccatggtaactgagtacttgattgtccgtggcattttccctctgaagtactccaggtagaacacccatcatgttcatggctgacattttaccacccaaggacctcgaggagaggaccaagtggggtggtctccatcatgggacagataaggacaaacctggagagaagtgtgtgaggccgcaggcactaaaagctccaggggtggcagtcagagagggccactgggagaggtggcacaaactggctgcatgcacctgcgtctggtctggcccacacagtgtttagaagaaattgagttgctaaagttggaaatcaggatatttcacattaaaaatcagggtttggggcttctgctgaaaaatgggcacctttggccagttacctctgtgcagagggtacatactgcccagtccagccagagcccattccacctgctctcctcaacacagtcaacagcatttgtggcaacttctctgactacccagcctcgtgggggctaagtcgtgctcaagaaacttatcaggaattacatttctcaaatgtgatgctgcaatctgatccagttttatttgtgccacaaatggattgccaaaggatgtgaggtttttgcacacttaggtggatcttgttttccagatgaggctatgaaagcagagcttctatgctgggatcacttgtttcatgctaggcactgactgttctaagtgttttaactgccacatcacctcatgcacgagggagctactaatatccccatttcatgcatagagagactgaagtacagaaaggtaaagcagcttgctctatgtcacacagccaagaaatggtcatactgggatgggaaactggtagtcaggctccagggaactccaatacatgctgctataccaaccatctggacacataagagctagtctgtgttctcatttgtgaagggactgccaggaatccctgcctgacagggagcaagggagagaatgcacatgaaagcacttggtaagttgcaatgtgcaccataaatgttagctgttactgataattattataacctgcaggtcaggattctagctgggggcctgtggccgaggctacccagcttgtcattctctctccagctacagctcgggctgcaagaaggggaaagggtgttattagcaccgattcttggaattccaacgtggtatgaataaggaatcaattacaggctacactgcagggtggccgctgaggtgtaggggctggttttcaacagcacaaagacaagtttattccaataccacttcctccaccacagagttaagcccacccatggtccctgctccgtgctgggaggtctaggcttgcccactgccggggagaacaggtggattcacacgccctctccctgagccgttcccagggcatccacggacaggtgtgcattttatggacggcacacaggtgctgaccaagtaagaaagtgggcgctgggatctagtgcaggctctgttctcaagttatgtgccctggtgtgggctgcacctgcaggaggaagtggtgcctttctgtttgaacaaaggtgtgcctgtgtgcctctggggtgtgtactcaactggtctgcccaaaggaggcaccattttttgttcatgcaaaggctccacctgggctagtggaggccgtggttgtgcacctgaaggaggcagacaacagacttcttgctgctcaggaacccacccttacacccagctcctgattcctcatcgaggcctatgctctcctcctctgcaggctcacagttctgtccagtccatattctgccatgactttgtgtcattcatttcccccacccccctacaacctcttctgatccatgacaaggtggcctagggccaactccaagatccaaggcctgaaccccatttgctgtccctttggcctctgtcctgggttcctttcctggtaatctcctaatacccccacctcactgcctgtatctactagttccccagccacaggccagagaattctcctaaatcctggagcaaaactgcagattcctggctatagataacctgcctgaccagacttccaagtgccactatgataatattgcctgatgctgcactccacccacctgtgagtctaaccagcctggtcccccactgttcactgtttgcttccaccagagctggggattgcctgtgactgtgacatcagcctgtcctgcctggctgagtgtctgggattaggttgggccagcaggtcactttcctcaggaccatcacaccctaagggtgaaattgggcttgcttcagaccttcctatcttgtgactggactgtcttgtgattgaataaactgtcgtgctcagacaagtccagagggatgacacagtggaatgttgttcgttacctgggtctgtctgaatattcccagaacacagaaggtgctcaatacatagattctgaaccttgttggctgtcgctgctgcagccatttttacctgaaaggtgatttagaatttctgcaggtgaatgtggtggtggttgcagggagttaaaaaattctccctcttcctactgagatgcacacatgcccccttagaggtgtaccctcttggaatcactgcagagagtttctttgttgacattcactcagaagtgacaagcacatgtctagaggaagggacaggctcctccatttctaacttgctttctgaaccatctctaatgatgtgcttttttactcccatcagcttggctgactgcctttgctcagcagatagttttggggatggaggtggttgcaccccaagcttgctataagcctagattggctctgcagtccctaagattgagctgacctgggctggacacccagcatcccttatccccctcccctaaacccaagttggctggtgatccggaggccaatgctaccctggaaagggccccattcctccctgacagaggcccagggaagccaccagatcaggttggaccagcaggcccctgagaggcactgatgccactctccagcccagaagaggcaggtgctggtcctggaacataaagtcaagcttggggatgtcaggggcattggctccaacacctccctggccctccccttacccacaggggctgacagggacagaacccattattcctgttaatacatggtctgggaagtgacagggcacatacgaggaccaagccagaggggaagccagaaatcctactgcctggcacccccctctccaagtctttttaggagccattctagggcttcgtgggcagctgggcttctctggtgatctcagcagtccaggcttgtgcaagtcccccaagctcccacccacctccaccagcctggtggggccctgactcattcccgcctgattgggcaaccagcttttggagactgaccttggaaatagtagcagtgaggccggctggaagctaactgggaacagcatccataggatttatgctggcctcagcaaggcagtgtttggtgaagtaggagacattggactatactgtctttcttcctctcggtctcccaccatgcccctcctcccatcctctggaatcctccggcccatatgctgctgcctttcactccctagtggtcagatcttctacttgggggtccccatccagggcaatgctcgctgctgaagatcatctgtccagctctcctctcctcggcttccccactagaccccattcctccgagcgtccctactcccctctgtgcacccctggccacatctaatgcccctaaccctccttgggcccccaccctttcacccgtcccacctttctgtgtatgtcctcttttcttcacccccatccctctagacacacacacctttttttgtgtgttttttttttgttttgttttgttttgttttttgagacggagtctcgctctgtcacccaggctggagtgcagtggcacgatctcggctcactgcaaccaccaccttccaggttcaagtgattctcccacctcagcctcccaagtagcagggattataggcgcttgccaccacgcctggctaatttttgtatttttagtagagacggcgttccactatgttggccaggctggtctcaaaatcctgacctcaggtgatccgcttgcctcagcctcccaaagtgctgggattacaggtgtgagccaccgcgcctggccacacacaccttttttcggcattctgatttatttcctctcaggtagctgttaggttgaaaaggcactgataatctaggtcactttacttggagaaggaaatcattgttgtgtattatctttcctggtagcatctgcatccctaactgtaggaagaactgaaagaggtctaccatggtaggattgcagacattaggtgaacgggagaaatttgcagttagaagagtcttcctgttcactatcaaatcatgccatatactgagggaattacccaaattgctcaagagtggctctttcttctcttcctttggtctccatctctccaggcttctaaaaccctgagttgtggcgatgcatgttttaaaacgaggtcctactgaaatataggctaatgtgtttgaggtctggtaaaatgttcagaatgtttatatgcactctggtgtatcttggactgtgcttttttaattcagatgctgtctgatttttaaacggattgtgggtgaaaaagaaaagaaggggaaaagcaacaactttctgtaagcataataatgatattttaacttgaaattgatcaagaaagggctggaaaacactttctatgaatgcttattcaaatgtcccaaagaatcttgatgaattcttataaatgaattttatgattactctgtagtgagctgtgaaaggaacacagctgcagacagaaaaactaggaatgttgctctggactaggtgatatatgctaatgatctggacagccgtacctagccactttgccatagaaaagctaaaggattactgatatgtaatttttataactgttctgcttctatattatttgggggaaaaatgggattttgccaaaggctgacttacactgtgatattcctgaatgtgatgtgaatgtgtaattgcaactggaatgtcctgcctgaaggtagtagggggcccatcgcctgcatgcaacagtgccctggaatcccagcccaggatttcagctcagtctgtgcagcaggctgtcagtttaggtttttgtcgacatctgtgatctgatgctcagatagtcagagaataccatgaaagacacacgggggcctggaaattgccctgtttaactgttgggactacagttatctcattgcagtgcctggtgtgttttctgggccagttttgatgtttgagttgagatgttagaggtggttagcatggtgactgtataggaaaaacactcctttccccccatatattctcagataattataagaattcccctcataattcttcatttatgacaccagatatgtgagctcttctgacaccaaccaattctccaacactccaggataccaactgggtgtcctacaatttaactcaattctaacgctatttataattaatgcagtccccacaggttaagggctcagtcctaccagattgcctcctacttcagatgccaatcaaaagtagtacatccccaggttacccactctcctgtctgacttggctacaagtcgggagttcccacaacctcctccccaggtttgataatttgctctgacaaattatactcacagaacttggagagagacttatgtttattggcttattataaaggatatgataatgaatacagatgaacaggcaaatgaagaggtacacagggtgaggtctggaagggtctgattgcaggagcttctgtctccagtgagtcagggcacaccaccttcctggcacatagatgtgttcaccaacccaggtctctgaaccctgtactttggcgacttttattaggcttaatcaagaaggcatgaatggttattaattcaacctctagcccctcttctttcctggaggataggggtggggtgtggctgaaagttccaagcttctaatcacggcttgggctttttggtgaccggcttccaccctgaagctgtccaggagcccatcaagggttgcttctttagaatgaaagatgctcctatcatccatgaaattccaagagattaaaagaaaaaaaaaaagaaattccaagagatttagtccatagcttccatctctaggttgctcatggtctacatagctgttgaaatctaggaataacatttgtgttctaggcaggaagtagaaggaggtgaggaagagtaaaaaggaaggtgcaatctccagctgcctgtgtctctttaaagagtctttttctaggccaggtgtggtggttcacacatgtagtcccagcactttgggaggctgaggtgggcggatcatgaggtcaggggttcgagaccagcctggccaacatagtgaaaccctgtctctactaaaaatacaaaaattaggcaggcatggtggcgggcacctgtagtcccagctactcaggaggctgaggcaggagaatcgcttgaactggggaggcagaggttgcagtgagccaagattgtgccactgcactccagcctaggcgacagagcgagactccgtctcgaaaaaaaaaaaaaagagtctttttctgtgcgctatgctccccctaacagcttctactcatgtttccttagctaaaataatgtcacatggccacactgttttaaaagaggctgaaaaatgtggtcattcctgataaagttggggttttgttactcaggaagaacaggagagtagtactgggtaggcaaacagtctgtaattgttgtctaattatatctgactcaagaaggttgtgcttttgggtagtcttgaatagatatttttctatgctgaggatttgggagatgctaagtgagctgaaaagtatctgtatatatacaaagtccatggatgaaactgtaatcaggtttaaaaattaatatggcccttcaatccctttacgagtcccttgatcactgatctaatctgtttggtcagctttgaaaacaatggctgagggtagttctggtttaaaatggcacctgattaacagcctttaatatagcatctctcaggctgggcgcggtggctcacgcctgtaatcccagcacttcgggaggccgaggtgggcggatcacgaggtcaggagatagagaccatcctggctaacatagtgaaaccccgtttctactaaaaatacaaaaaattagctgggcgtgatggcgggcgcctgtagtcccagctattcaggaggctgaggcaggagaatggtgtgaacccgggaggcggagcttgcagtgagccgagattgcgccactgcactccagcctgggcgacagagcgagactctgtctcaaaaaacaaaaacaaaaacaaaaaaaaaaaccagcatctctcaacttttcaataaaatatctaggaagccatggcagggagtggtgaggagaaagctcataaccagcctcaaaactaaatctaatggacagtgctgacccagaatttcagaggaatctttaatgcagatgaatgatggttaacttcaattcatgtggctcatgaaacagagcttacctgaaaactcaagaccattcagacatcaccactgtttagctcttcactcaaagacccagctgtccctctgctgtgggtcctgtgaaccaatccatattgattctcctcctccttctttgttatttgtttgcatctatttaaagacagcagaaatcccccagaagttaactagagagtaaatagtggagttggggaggtgcatgtacgtgtatagacattaaggtaaggaaccacagtagtacccctatcctgggtcatataagccctacaagtaaagagctgctagagtgggtatggagagaaaaagctttgttggaacccgtcggaactatagcttttcaagaatcacgttggctgaaagtatgaggtgcagagtttaaatggatgaatacccagcagaagtcaggactggactgcatgttatgtactccaatctgctcttcagctgtgtggctgagaatggagtttgaccttcacacaaatagaaatggagctagggaaaaatccacacacataatttgttgtcaaatactgagttagatagcattctccttttaaaaatgtcttaaacatgactgagaggcagtctagcattgatactctggagccagactgtctgggttcaaatcctgactccaccacttacagctctgtgactatgggcaagttacctaatgttgatgtctcagcatttgtatttgtaaaatgaggttaataatgcttcttacttcatagagttgttgtgagattgcatgagtcaatacatagaaatacttggaagagcacacagtaagcactcaacaagtgcaagctgtattatgatgatgaagattatgattttaaaaatcataagatcataagagaaagaatcaatataatatgaaacatataaataaattacagaaacaaaggaatgggaatagcagattgaagattcagagaccaaatgtattttcaaaaataatgtaaatgcaggttctgaagaaaattttaggaggctgcttgatatcctcagtaaagtaaaagaagatggggtctttatgaagcaggacataaaaccacaaagagatagaataagatggcaaaatattaaaatgcacattgaaccaataaagaacagaattgataacacaggagaggaaagcagaaatatgtgaagaacaagcttgaaaagtcctccaagaatgcagaaagggaaaaaaaaatcaagtgagagaataaatacagaaaatagaaaatcgagacatgactcagaacagaacaaatgggatagaaataattacttaactatggtataatataaaagaatattttcagactgccagaaagagccttatatattgattaaaagtgatttcctccttttgtatcaagtcgatggaaagagactcacatttaggcacaccaggcaaaatgagcgaagcattcaggctgaggaggcaagtttaaaaattaaactggctggctgggcgtggtggctctcgcctgtaatcccagcactttcggaggctgaggtgggtggatcatgaggtcgggagttcaagaccagcccaaccaacacggtgaaaccccatctctactaaaaatacaaaaattagccgggtgtggtggtgtgcgcctgtaatcccagctactcaggaggctgaggcagaagaatcgcttgaacctgaaaggtggaggttgagccaagagtgtgccactgcactccagcctgggggatagagctagactccatctcaaaaaaaaaaaaaaaaaattagactggctgtatatatctcctctgtaatattaaatgctaacaagagataaaagcataattgtttgccaatgatattattatccacctggaatatgtaacagaagcagcagaaaaaatttccaggattaataagcaagttcattatcatgatcagtttaaaactaatatttgaaagcaataattttcttatttcctagcaataaaagtttactggggtgctgggagactgaatgacacctttgatagactcatggagcatggacacaggcgaaggaagcctgacaagccctcctctctttagactgagaccccaaagggttgtctgcaccctaggagtaacgttgaaccagaagtaaatagaccttcagagggggtgcaactcagctttacttatccagtctctgaagctggattaaagtgatcccagggtatgagtgtttccaggcacatggcagaagtaacataaatttgccctgggaaaaaatacaatagaggtttaattcaccaggaagatataacaacactaaatatgtatgtatctaataatattattgtttgagctaagtaatagcaaaaatactgtgtatccaaacttgagggatgcagataaaacttttcctacaggaaaatatgtatgtaaatattaatatatatgtataatgtaacacttatatattgaataatatgtaaatatatatatattttttaacttgaaacacaaacgctttatttaaaggcgcatctcaattccgtgtggcgggcaaaaaataaaggagcagattgtgacagaccattcccatcggccatgcgggcgaacccaacgtccttttacattgaagaacccaacggggccttttacattgcggatgatggaccggctcgtgacgtccatgaatttcacgcgcacctgtgtgcactgtccctgagagccggtcctgcccaggaccttggtgaccctggccagcttgataggctgcacacggctggtgttcatgatggcggcgcagcgacgatgtggcggagaggtaaatatatattatataaattaacttaatatataaaaatacataaatatataaaatgtgtatatatatataaacaagctaaagatgggagaaattagctagtagtatcaagatttattacaaaactatagcaattaagattttgtcatattggttcaaggatggacaactttatcaatgaattaaaataataaaacagatatgtgaaccattaattatgtcaaaggtgacactatagagcacaggtgaaaggaatgtcttatcaatgaatgtgtggggatatttagatacccatttggaaaaaaataaagcttggctttcgcttcatacatacacaaaaacaaaatgtaaataagtgattcttttaaagaaaaggcaaaacaataaaagtcttagatggtaatataaaagaatatcatcatgatctcagcataaggcaagactcctcaagtagaacataaaaagcactaaccataaagaaaaagactgacatatacaactgtcttagtccattttgtgctgctgtaacagaatgccacagacgaggtaatttatgaaaaacagaaatttattctctcacagttctggaggttgagaaatccaagatcaagtcaccagcagcttgtgtgggccttcttattgccttcctactgcatccttacacggcagaaggcagaaagggcaagaggcaagagagagtgagtctgctcccaccagcacttttttttttttctttttgagacgggtctcactctatcaccaaggctggagtgcagtggtgtgatcatgactcaccgccatctctgcctctcaggttcaagtgatcctcctacctcagcttcctgaatagctgggactgccagtgcatgccaccatgcccagcttattatttttgtattttttatttttttgttgagacagagtttcaccatgttgcccaggctggtctcgaactcctgagctcaagtggtctgtctgccttggcctcccaaagtgctgggattacaggcatcagccattgccccggcccccacaagcatttttaaagtggcattaatctattcatgaggacagagtcttcatgacctaaacacttccccaaagatcctacctcccaacactgttacattggggattaagtttccaacatgcgaactttggtgaggaggaacaaaaacattcaaaccatagcaatgactatgttaaaataaaaacttctgttcatcaaaaataacattaagaagtaaaaaagaagtctgggctcggtggctcacgcctgtaatcccagcactttgggaggccgaggcaggcaggtcacttgaggtcaggagtttgagaccagcctggccaacatggtgaaaccctgtctctactaaaaatacaaaaattagccgggtgtgatggtgtgtgtctgtaatcccagctacttgaaaggctgaggcaggagaattgcttgaacccaggaggcagaggttgcagtgagccaagatcacaccattgtactccagcctgggtgacaagagagaaactccatctcaaaaaaaaaaaaaaagaggaagtaaaaaagagagccacagaggaagaaggcatgcaaaacatttggcaaacaaagggcttgtgtctacaatatgtaaaggtccagagctcacaggatcttagggtatgtttataatttactttggtagataatgacagttttctgaaatggttgtgccaagttgtaacctaaaatgcaaaggctggagccaaagtttcagtgaatgcagatacatcacaaaagctgagctaagttagcaatcttgagacaagggaagagcagctagagaaaacctggaaaacaatgaggtggaaatggtagtggcaaagcacaagatagaaatgaggaaacttacacaagaaaatgaaaataaaggttaaaacagattaaacagaaaatggtagatgtagaaaacagtcaaaggagatccagcataggcataattggcttccctggaaaaaaagagaaaatcaaaacaatgcaaaataaaaaatatttaaaatataatagaagacaggtgatttcttataaagttagatgtgcacttaccaaatgacctggtaattctacccactcctaggtattcaccaagataaaacatatgtccacacaaagacttatatatgggctgggcgcagtggctcatgcttgtaattccagcactttgggaggccgaggtgggcagatcacgaggtcaagagtttgagaccagcctggttaacatggtgaaaccccatctctactaaaaatagaaaaattatctgggagtggtggcacatgcctgtaattccagctgctcaggaggctgagacaggagaattgcttgaacccaggaggcggagtttgcagtgaactgagatcgtgtcactgcaccccagcctgggtgacagagcaagactccatctcaaaaaaaaaaaaaaaaattcatatatgagcactcataaaagttttaggaatttgacaaaaatggttccatagctcattcaaaagaatagattttaaaataatcaataagatttaaaaagtgataatgaaagagctttcactatcaacatttaaataatattttacaattaaagtttttaaaaataaaatgttatactattatagaaataggcaagctgatcagtagaacaaaataaataggctgtaaacttgtgtttgtgtgtttatagctaataagtgtgatgcttaaatcagtgggaaaaagtattaactatttaatatagagagctagtataattattagtgccacatgtcaggagctaatgaaacttctgcaaaggaccagctagtaaatattttaggctttgtgggccataccatctctgttgcaaccacttaactctgccactgtagcatgaaagcaggtacaaataactatattacattctaagtaatttttaaaatttcaaacctctgtttttaaacacttgaaaataatacactgacaaatatgatggcttgcttttatgtaactggcacctgatagaattaaaattgacccaaataggtcaccaaaaatatattttacctgacaaattaattaacatgggttagggtcaggatgcgaggcaaagaaacaggagagtgctttggacaatgagaattaagtcactgatctctcattctatatagcaattctcctgtcttacaaacatgtcctagtgtctctctcatcttaaaagcaaacaacaaaatcctctttagtcactctttatcccattggtatatccatttctacaaagcatcattgcctgagtgttcttatgtattaatatatatttgtttatttattatttgcctttctactctaggaactgtgatccatgagggaaggatttttctccctttctttctttttttttttatttttatactttaagttctagggtacatgacaccatgtgcaggtttgttacttatgtatacatgtgccatgttggtgtgctgcacccgttaactcgtcatttacgttaggtatatctcctaatgctatccctccccccaatcccaccccacgacaggccctggtgtgtgatattccctaccctgtgtccaagtgttctcattgttcaattcccacccatgagtgagaatatgtggtgtttggttttctgtccttgcgatagtttgctcagaatgatggtttccagcttcatccatgtccctacaaaggacatgaactcatccttttttatggctgcatagtattccatggtgtatatgtgccacattttcttaatccagtgtatcattgatggacatttgggttggttccaagtctttgctattgtgaatagtaccacaataaacatacacgtgcatgtgtctttatagcagcatgatttttaaagcatttttctttcttcctcactgaaggagacattttcaatttacattctgacccatagaaaatagaaggtttctaaatgagcttattttgtatctggctgcctaaagaactcttcctacctattcctccattgaagaatcacaaacaagtgccttgggaggaggcgcaagtctcagggatccagaccataatctcagagctagaatgtaagggtaagaaaatatgaatgacccttttgggagggattgctaaagaagtaacattcagtagttggacatttgattgttctatcaattgcagtctgtcagctttatgtcgaaggcatactcatatctctacaagagccaatgaacttccctgtcagaccttgccacacacactttggaagaggagagggaagagcagaaagaaagagaagaggaggaggaaaagaggaggagctttgagagagttcaaagtcagggagacaagcgggctacagtggtagaatcagtgagggattaaaatctttcctgcgttagttcctttttcctgttgatatttcttgagattctttcttttgagccctcctggtacttggtcctcttcctctagggcagttcacttaatgaaaggctctctggcctggggtaggccctggccaactatgctctagaatgtagaaaaatacactattaattgagccaagattaagtttatcccaggattaagtttaggcctggatttattctaggctttgggctaggagatccaaaaatttcattatggttcatgtttagccggctgagctcacaatgtttagcaaatccatgtgaggatttgggcccaaagtcctgtagtgacaaacactttacatttgcatatttttaaaggagctcatggaagagatgagtagccgaccataactttggggatttggtgttataggaattgctccctcacttgctacggggaaaaatgaatactatatgaccataatagtttgctgaaaattgtctctgctattcctgccaaaaatggatggagaagattatttgagagaagaaaatatgaaaatggatccccttgaagaaatatgagagaaggaagctaatccttggtgacagaataagagacactcaaactgacattaagaacacacaagtagtccagagagtggaaaaatagctaaacttatatgaaggtgcttgatacaagggtatgtcatgttctgaggcctgacctttcctgagaagctgacaggcatggcatttatgatggaaaaacaaccctggaggcacagaaaagctgatggccacagactgcaaagggatcaattagagagaaaactgctctctggtacagaaagagtgtttagaagagaaatgggcatcttggtgttgctgtaattatcccctctcttttctgagtcaccaatttctcattctgtgcagcaattctgctgttttacaaacatgtcataatgtctcatcttaaaaacaaacaacaaaatcctttttagtcactctttatcccattggtatgtccatttcttcaaaacactattacctcttatgtatgtatttgtttgtttattgtttgccttcctgttgtaggaactctgatccatgaaggcaggatcttttttttcttcttcactgctattttgtcctagaatagtatttggcacatagctggggctcaatacatatttcttgattgaatacaagaagttgagtggcatgaagatatgggatatagtcatccaggtagaaacagatttctttcaaaggtaattgtagtttccaaggacagatacactgggctgacctctgaccctaggagtaatagaaatagcaattccataatccagttggttatagaccaggaatgacaaacacatggcatgcatgttgccgcttccccattctgctttcaggacagacatcattaatctatcacagcacttgttcctgaagagagtggttactgcctccctgattactgaatccatagcacaaatggaaggataaaattttgcatggaaagataggttttggagatcctatcaatatgaaaggcctaggttcttctataaataatgttgcttgaccattaattccagagtgtgactatggaaaaggaggaatagttgcatggctttagttttgtcttttctaaacaacctaaatgacaccacagttcaatcaccccacatgtatcgatcaaggggaccaattggagagctcagcatttagccagggacagatgccaaaattcagccaagaaaacctgccaaaaaaaaaagtaatgtccaaaagcacaggacagagacatgctctactggccatgactgggagctgtaactcaccttctcagagagctccagggaagtgcctggacaggacactgagaatgaaagaaaagcacgggtgagaccaaaacaggggcaactcttaccctatttctgaatattttttatggggaaggaggcaaagaggatgagggtaatgggggatgttgccttttattaaagtgcgggtggaacgaatacttgacttgtaaagttgggacttactacaactagcacaaaatcaataagaaaggagagtcaacaagtatttacaaagccttcaatggcctgcatggggatcagtgccaagaaacagtctttgccatggctctgcctcctccttgacccaaagtaccactctttattatgcaactggcacacgaattgcctccagaacatgagaacactactcatggccagtgtggggaactcaggccaagacacagccttctgcccaaggaagtggtctgaagtaactttgcagaattcttgtcaagatagttaacattgtcaagcaaacaaacaaataaaaccgctgagtagaagccaattctccatgtgcttagactccctgttcttgtccctgctcctgacctcacaatgagcatggggccctgagatgacctccaagagaggctaggaaaagggtttggctagacgttggtcagattctgccctctccctccaggagaggaagaatcagtctgaagcaggaccacatgagaccaagaaaatgggtttgtgtgtctcctctgggactggcactggattcacaaaggagatgaaggatagaagtagggggaggtggctaggcgtggtggctcacacctgtaatcccagtactttgggaggccgaggcgggcggatcacaaggtcaggagttcgagaccagcctgaccaacatggttaaaccctgtctctaatgaaaatataaaaattagctgggcatggtggttgcgcccgtaatcccagctactcaggaggctgacgcaggagaatcgcttgaacctgggaggtgtaggttgcagtgagccgagattgcgccattgcactacagcctgggtgacagagtgagactccatctcaaaacaaaaacaacaacaacaacaaaaaaaaaaaaaaaaaggaggaggaggtatcaagagagatctgtttgctcaggagaatctgtgtgggagctgagtcagtcctcagattgcaatgggataggaataatgccttccagatcttctcacctggatcacttccccatcgtcctccatctcacctgttgtccttctccccttctccctttctcaattttctctgcccttcagtgtctcaggtgtctgtattcttcaagaagccatgccctgtccctaatttcccctccacccattacatcgtcatttcccacacccaaactgcttgggccacattgtctacaatggccacctcctcgtaacatccagatttccagacactgtgcaaggcaacttatagaccttgctgcctttagtcctcctgacaacaccaacaatgtctcagtgagccagccattatctgcctcgtgttaggaagctcagagatgttgagtccctttctggaggtcagaaattttaagtgctagagttgagattcaaacctagcagtgtctgctcttaatctctagaggttttctaaagtgtgaaacttagaagacaagagttctatgagatttaaaaaggaataccatagaagaattggaaaaaattatactttacaaataaacattatgtacttggtcttgttattatgaaaaaaaaccctgcctctaaacatggcgagatatatcttgcactaccagtatttcctgatggggctgctgttggccttttagtccaagcccacacactgtagagtgtttagtatctgtggtcctgtcagccaaaggccagtggggtcctcagtgtgcacctaaaagtgctccacatgtgtaaatgtcccctgagatatgaatgttactaccttcagttgaaggtaactaaccctggaatgtaatgaccataacgtcagggactgtgtctttcttactcagcattgcagccccaacatatagctcgtagtaggcctttagtagatattagaaagtcatctaatgcatgtgtaatgtgtaattattgataataggcagtatttaaccattacctaggatgttatctgatatgatctcaatgaccatcttgcctatacagttttaacatgtctgcaatattattcaatgttcattatgtattagacacatgaatcaaattttggtcatttcttgcagcaattaaattatcaggttactttatttcaagcatgaagctttctatctcctgagctccttgatgaaaacttgacttataaagctaagacttcctataactagcacaaaatcaataagcaaggagagttaacaagtatttacaaagccttcagtggcctgcatgatccccatgtctgttgtttccctgtctgtataccctaaattataatagtgcttcattttaaatgtttgggctaagatgcctatggacagttaccaatcaacacaaagaagcatccggctgtctcaccctttgttgcttttgattctctctcatgaacagttctgagacctccactgtcctcttgttatttttattcctaatggtgatacttctcctacttgcttcctccgactgtctaccttgtcatgttgactccttccttcaggaatgctcttctcaaatctgaagatacaatctgaatagaaaaataggtgtggaccactggtggccacttatgtgcctacatgtctgtagtcattcattttcaatcttgagtgaagacacaaaggtctatgtcagccagcccctagctggagtttcctttgtctagttctgcatctgcctcccaagaatctattctttttgctcttctcactccctcaccctctccctggtatcagtgtctctgatatagacacaggaataggcatttatggaagatcagaaggggagaggagtgcagttctggtcccagagctacccagcagggaggaacaggccttgtgggggctgacctgacttagccagagaggcatcaggctgccaggaaaatgagggttgcagccatctggggacaaagttaaggcaagctgtctggaagatcaggtggggagaggagtgcagttctggccccagagctacccagcagggaggaacaggccttgtgggggctgacctgacttagccagacaggacatcaggctgccaggaaaatgagggttgcagccatctggggacaaagttaaggcaagctgtgggctgaaagggagcccagtgggagatgaggcacagagaggagggagctgggataaagagacttagaaatgcaggcacaaagccagcacagaggctgtcctgggtagcaagccctgtctacacaactagagtcattgaagaaggctttcagaagaagctgggactggatttgcggcttgaagaaagggtaggatttgtagagttgaagaggagtataacgagccacttcctgtgaggtgaaactacatatcactcagtgatttacatctaaactgggcatttatgtgttatgattgactgaaatcacctgtgggctaatcagcccagccatcaggctgagatgctggctcacaaaggcagctgagggaccttcccctgcaggaagtgaccctgtgcctgatttacactttgcaaggtatgcaattgttttcacttgctctaaacaaattgaccaaatccagttcagcaaatgagatgactccaagcacaaggtttctctttgaaaatgattgagaacatgtttgcatacagtgtttacaaagttgaagcaaactatgctttgaatgaagagagaatatgtctccatttcttcgctgagtgtgaaatgagaggggggtttgttagcccgactccagcagagctcttgcccataggaagcctgagatcaagggtcacaaactcaagtgtctactgtgaaaataagataaataatgaaacaagacaactgtgatgcaacaggaaattgtggaaactctggctaagccaagagcatacatcctatttgaagacggctgctattctctcccctatttgcatccatgcaagaatgagagtccactatgaccaggttttctaatttttcaagagaagccagaaatgctgatttttttttggtaagaaactttctaagctaaggagtattgtatgggtgccttctgctgtgggccacctgtttccagtctctgttctagaggctacctagttatggaagtcacctgtaactgtccctatttgttctggaaggaagagtggacacttgtaggaaaaagcccagactcctagcctgacatggaagacctttgcctacttctctagacttttctttttgtgctgtgctcataccttgtgccccagccctgctgagctaactgtagcttgcctaatgtgcgtggaacagagattcaatcccaatcttcacctaaacacttcacctaaagaaaatggaaaatggagtttcagtgtaaggctgagctgagattgtgtggaagtttaaaaatatgtccacatcttttttactttctttccattaggaggtgggcttgaaggctgggcacggtggctcatgcctgtaatcccagcactttgggaggctgaggcgggcagatcacctgaggtcaggagtttgagaccagcctcaacatggagaaaccccgtctctactaaaaatacaaaattagccgggtgtgtggtgcatgcctgtaatcccagctatttgggaggctgaggcaggagaattgcttgaacctgggaggcggaggttgctgtgagccgagatcgtgccattgcactccagcctgggcaacaagagtgaaactccatctcaaaaaaaaaaaaggaggtgggcttgaaaatggattagggctgggaagggtagttggggatggaaggggagatggggatggttaacgggtacaaaaaataactaaaaagaatgaataagacctactatttgatagcacaagagagtgactattgtcaataataactggctgggagtggtggcttatgcttgtaatccttgcactttgggaagctgaggcaggtggattacctgaggtcaggagtttgagaccagcctggccaacatgatgaaaccctatctctactaaaaatacaaaaaatttagctgggcatggtgacaggcctgtaatcccagctacttgggaggcctgaggcaggtgaattgcttgaacccaggaggcggaggttgcagtgggccaagatcccgcactgtactctagcctggtcaacaagagcaaaactcagtcttaaaaaaaaaaaaccctatacatttttaaataaagagtataattggactgtttgtaactcaaaggataaatgcttgaggggatggataccccattctccatgatgtgcttatatttcacactgcatacctatatcaaaacatctcatgtaccccataaatatacatacctactatgtacccacaaaaattaaaaataataaaaaaaaggaaatagattgggctttgtgaccaggtcaaccaagacagtaggtggaaatgatgccaaatgacttttgaggctaggtcaaaaaaggcaatgcaactcctaccttgcttgctgcaactctcagctggaagccctcagctgccatgcaagcaggctaccctgaaggcaccatgctgtgaggaagcccaaactagcccatcaggagagacaccatggagaagttctgaggggatgtaatgagaggcagagacaccccaccagtcctcggatgctccagctccctgctcttctagctccagccaccacctgactgcaactgcctgagaaaccctgagccagaaccaccccgctgagcccttcccaaattcctgacttgtgaaaattgtgagagataaaattattattattataataagccactaggttttgtggtgatttgttatgcagaacagcttcaaaggagaactcaaagtttaggcagaggcggaggcagatgtagtgtctagtgcctagtctagtctgctgtccttaattctgtgcacttgactcttcacgtaccagccaaattcctgatattcttctgcataaatgccagagggagccaggttggttggctgatttagttactgtcactggtattgaaaacctcatcgggtacctcagccagcctgagtctttgggttaggtgcccactcatccaatcagtagccactcttgtagaaggccaacctgtcccagttcacctggttaggggcctgtggccatggccctttccatgtgaaggggaagttggggtggcaggtgtctagtggatccacctggcacctgtggtttgttgtcgtgtctttccaggcttgtgctctatgctttagaatcatccctactcccaatacttactcatcttttgagtctcaattatgcattaccttcttcatgaagctgggccattccccttggagaccccctgtctctttgcacaccctccctactaaagagagctcactggcttccccatccatctttcccacaaagctgaccatcctcagcttattcatctcagtcttcctaatgccaggctttgtggctggctcatagcaggggctggataaatcattgataaaacatgaatagatgtgtttagttgaaagaggataaagggaatcataacatcagctactctggagtgtggaatgcttttgatgtctgagttgggaggctaggttctgtttcactgcctcttgcagtagttgataccagttcattgattatgtcgttctgttacctgcagtaggaacagatcgtgtcctaaaagtgtgtggtctggaacttgaagcacattttccctcatagaaacaggttagtggttttcaaattaaaaataaaataaacccaaaaaatcatgaaaaaaaaattctacaagaaactgaacttggaaagtcagctttgaggtggtttgaagttaacaatggactggtctctaagctttggagggataggggaagatgaaagtgttggggaccccagagctgccagtcagttaaagggcactcagatgctgttgtcccaaatatataagtatgggggatgggggatccaggaatatatttaatttttaaaaacttcactactttatgtttaaatgggtaatacacaatgatagtacagcttttataatatttttatattttagtaacaatgtttttacttcaaatttaccgtctatgggaaatgttgaaaaagaaaaggccacatagttttctctacccagatttcatgcacagtaagctttgcttatcattccacacattattttgagtctagctatttcctcccctctccactcctttgacctatttttaggtctagaagctaaaaaaaaaaaaaagattgtctagtgaggacctagtagctggcagccctgagggtgggtgtaccctggggcctcagccctggccttaacaggccttaggtgtcgggggtggtgggggggagggttggggattccaatccatattctgttaaaggaaccctcccctccctctttctgggtgaggccaaaggctgcccagtcagctggcctggcctgagaaggctaagatagtgcaggcgctgtggttccccatctcctctgcttccgtctcccacacacttacagtttggtcctattcttcccaccccaagctgctctggggctgccaccctcataccccgaccccagatcccagccccaggcagatcattaggctgcagtcagtcctggttctttgccttcctccctaccaacttctgactgtgctgcagaaagcagataactgaaagccactcaatatacctagaaggcagggccataggatgagcttggcctttggagtagcagaccatggttcaaattgtagttgaaaccccagctctgggacctgtttgctgtctgaccacgggcaaatgacttaccctatctgtgctacagtttcttatctgtgaagtggagaagaggataatgatctactttggagggcattgggaattagagaaaatgtatgtaaagtgtctggtacaatgtggcctacaactgcccctaataaatgtttattgaggccttatcctcagctttccaggaaagctggggagggtttccctctggatctccttgtgctcatggggtcgggactctaggctggaggagcacagatttccacaatcctgtggtactcatatgtccggtagagcatcaccttcatatttagagtcttcttctcctttcttgcgttaggatcttcatggattgcaacattgcaccctttacctaaatgaaacatcagtgcatataactctcctcccattttcaccaggttaaaacaaaaattaggatgggcagatgccagcccttgctggagacccaggcttctgcatgaatgactatccataaagcatttagatgagagaatgtgagggaaagctgctgtccaagatcttctctgctggaggatgggacaatggtctcacatgctcaggaaggtttgtaacgtggggttaagcacgctaacatggaagttgaaactcctgggtccaaatcctggcttttctagttaccagccaggtgcatcagtttactcatctgttaaaagcagaggatgatgatgctgatgaagaggatgatgaagatgaagatgatggtacccatctcctcagggttacagaaggtgaattgaattgatgcagtgagaatggagtacactggactcactcatgaagtatgttagctgctatgttcatgctttcccccttggttctctgtgtagctagtgatagaaatatcaagctttccaacaagactgtcccttaccacgttttctttcttttgttagcctttagatttttttctgattataaaggttatatatgctcaagacaaaccacttataaaatgtagaaagacaaggctgggcacggtggctcacacctgtgatcccagcactttgggaggctgaggcaggctgatcaccaggtcaggagatcaagaccatcctggctaacacgatgaaaccccgtctctactaaaaatacaaaaaaaaattagctgggctggtggcggccgcctgtagtcccagctatttgggaggctgaggcaggagaatggcatgaacctgggaggcggagcttgcagtgagccgaggtcacgccaccgcactccagcctgggcgacagagcgagactccgtctcaaaaaaaagttgaaagacaaaaagaagacaatgaaaacacacatcatattaccgctccagagatgctgtgaacatttttatgtattaggaaatagatatttatagtcattagtatagtatgtaaaaatgagagcctattaaaacgtgcagcagtgacctatagaaaccaaaggtaaaaaaaaatctgtgtttgaaatctgtttgttgcctgtccaagtgctcactgcagctccccagtgtgttatggagcacaggttcttaaaactagtgctaggcctacagcctaacttgggagcttgagagaagttcaaactccctggctgcacctgctgaatcagagagcctggggtgggcacagcaatctatattttaacaagccctccagaggattttgaagtctgttcaaatttgagaaccattcttagaaatcaaagttctagcccaggtgcggtggctcatgcctgtaatcccagcactttgggaggcccaggaaggtggatcacttaagcccaggaatttgagaccagcctgggcaacatagtgagactccatccctacaaaaaatatgtattaaaaaaattagctggacatggtggcacatacctgtaatcctagctacctggaaagctgaggtgggagaatcacctgagcctgggaagtcaaggctgtagtgagctgtgatcacaccactgcactccagcacgaatgacagattaagttcctgtctcgaaagaaagaaaaagaataaaacgggccaggcactgtggctcatgcctgtaatcctaggactttgggaggccgaggggggcagatcacgaggtcaggagtttgagaccagcctgacctacatggtgaaaccccatctctactaaaaatacaaacattagccaggcatggagtcacgcgcctgtaatcccagctactcgggaggctggggcaggagaatcgcttgaacctgggaggcggaggttgcagtgagctgagatcacgccaccacactccagcctgggtgacagggtgagactccatctcaaaaaaaaaaagaataaaaggaagaaaggaaggaaggaaggaaaaagaaggaaggaagaaagaaagaaaaagaaaaagaaagaaagaaggaaagaaagtcaaagttctggaattattttgagaagttaaacaatagttaagaaactcttgctctctaaggtctcacaaatttcaagctatgcatttaaaataggtgctgccgaaaaagaatgaaccctggaaaacattctacttgctacactgagacaccatattaaagacagcattattttaaatgtctctggactgcttttaaaaagaactttgggtcatgcatctaattcccttctaacttctaaaatggaaagtagtttcctatggttggcatctatcatatgtagttatagacagacctactctgtgacaccatagagtactcactcatttcttcgtttgtcattcattcaaataatcaccattcagctctttgaagtatttattctctaccagtttctggcagtcctttttgcattaggaaagaacagatctgttttattttcagattttattttaaaaatatgtattttcaatggtatttggaagtttatacttgcaagggatttgagtgaagtaggagatattttctctagaacattaaaagtgtctgaagaccccttgaccctctcccacactagtgccaagacaagaaaacaggatttttctgctctctttgagttctagtctctaggtacaaaggaattacatctcagttactggaaagtttgcagaacagaggaatggcccaatgtctttgagacattttagggcaataccagaagtcttggaagaagagagctaaataaaagtcatctggatccccaaagaccacagaagatggcttgctcaaaataccactactgagtttggcttcagtcccagacaagattctagactagattatttaaaataataacaataaagtttgggagacttttggaaaagcagcaattactggcattcagcctgagattttaaaaacaaagtatgtctgcttgacctttttctttctttgacattgtttctagactcatttattaagaaaatatgataggcacaaggcctggggcataatagagactcaatcaatatttgttgactgaatgaatagggcattttgcgaggcttttgataagatctttcataaactgattgataaagccacagcataatgcaggctggaagcaagggcaaaagctgggttagaatttcccagaaaatatcattaataccatctgggaggcagagtcctaatgttgggccatcacccctgagaaagctctccatggcatggatgcagtatagagaacaggctcatcaaactgaacataaaattgtgctgggcagggcagcatacacgctgagggatgaaatccagatcaacagactactgagcaatttttaagcccctccttattctccctaaatataaataatacatattcattgtatgcaatctgagaaatataggagagactaaagaagaaagtaaaaaagatttcatgaactcccgtcacctgaatgtaaccattgctaatattttagcatatttctttacttagtctttgtttaacttatacatactttatctagatgtgttaatttcatatcatcctttcactgaaacgaaactcttttaaagcataatttgtaatgattatatgatagttcattatatctatgcgttgacttacacatcttcatttgtagtaaccaaaacaaataattgtaccaaatatcaatatagcattttactgaggcccagatactatttaaagtgctttaaatgtattagcttttcagtcctcacaataactctgagaggtattatcgttatccttattttacagatgaagaaactgaagcaaaaagagtttaagtaatttgccccaaatcacccagatactaagtggtgggagcagagatttctctcttttgaagtcggtgttggtattggaatgactgacatttattaaatggtattggaatgattgaaaagccatttggaaatacatggagttgattttcatatcgcattttaccttagtacaaattccagataaatcaaagacaattataaaagatgaaatcttaaatatacaaaaacagtgattctcaatgctggctgagctttagaatcactggggagtctatttaagaattaccagtgttggccgggcgcggtggctcacgcctgtaatcccagcactttgggaggctgaggcgggtggatcacgaggtcaggagatggagaccatcctggctaacacggtgaaaccccgtttctactaaaaatacaaaaaattacccgggcgtggtggcgggcgcctgtagtcccggctactcgggaggctgaggcaggagaatggcgtgaacccgggaggaggaccttgcagtgagccgagatcgcaccactgcactccagcctgggcgacagagcgagattccgtctctaaaaaaaaaaaaaaagaattaccagtgcttaggcctggcgtggtggctcacgcctgtaatcccagcactttgggaggccaaggcaggctgatcaccaggtcaggagatcgagaccatcctggctaacacggtggaaccccgtctctactaaaaatacaaaaagaaattagccgggcgtggtggcgggcgcctgtagtcccggctactcgggaggctgaggcaggagaatggcgtgagtgaaccctggaggcggagcttgcagtgagccgagaacacgccactgcactccggcctgggcgacagagtgagactctgcctcaaaaaaaaaaaaaaaaaaaaaaaaaaaaaagaattaccagtgtttaaggccgggcgcggtggctcacgcctgtaatcccagcactttgggaggccgaggcaggtggaccatgaaatcaggagatctagaccatcttggccaacatggtgaaacctcgtctctactaaaaatacaaaaattagctgggcatggtggcgtgcacctgtagtcccagctacttgggaggctgaggcaggagaatcacttgaacccaggaagcagaggttgcagtgagccgagattgcaccactgcactctaacctggcgacagagtgagactccatctcaaaaaaaaaaaaaaaaaaagaattaccagtgtttgccactggcccccacttccccccacagctatttaaatcataatcactggaggtaaagctagaaatttgtattttttaagtatgcgttatgaacttttttttttaactttaagttctggtatacatgtgtagaacatgcaggttacataggtatacatgtgccatggtggtttgctgcacccatcaacctgtcatctaggtttatattttcttgcattaggtatttgtcctaatgctctccctcccctggacccccaccccccgacaggccccggtgtatggtgttcccctccctgtgtccatgtgttctcattgttcaactcccacctatgagtgagaacatgaggtgtttggttttctttgcctgtgttagtttgctgaggatgatggcttccaacttcatccatatccctgcaaagggcataaactcattctttttttatggctgcatagtagaaattggtatttttttaaagttcctgttgattggaatgcagccagggctaagacataacgacaaaagggacagattttttaaaacctgagaaaggagaaagcttttctatgtatgatataaacctcaaaagttctaaagaaaaaactgataaattcagtagtggagaattattgtttaatgggtacaaagtttctgtttgggaagatgaaaagtcctggagatgcatggcggtgatggttgcacagcaatgtgaatatacttaatgccatcaaactgtacactcaaaagtggctaaatggtgtgtttcatgctatgtatattttaccacaattaaaaatggcattacaaaaaacatcataggcacaatccaaatataaatgacagattggaaaaaataggtaactcattataaaaaggggcttatatataaacagcttgcatgaatcaataagaaaaagagcaacccaatgtaaagatgggtaacagatatgaacagttcacagaaaagaaaatataaatgtttcttaaacatatgaaaaaagccattcacactaaatgtaagagaaaataaaactacactaaaatatcactgtcacttagattgagaagtataaaaacagagttggggccaggcacaggggctcatacctgtaatcccaacactttgggaggccaaggcaggtggatcactagaggtcaggagttggagaccaacctggccaatgtgatgaaacccgttctctactaaaaatataaaaattagctgggcatggtggtgctcgcctgtaaccccaactactcgggaggctgaggcaggagaattgcttgaatctgggagggaagtggaggttgcagtgagcagagatgactccatctcaaaaaaaaaaaaaaaaagttggataactcaattgttggtaagggcctgaggaaagagccattcttattatttgctgatgggagtataaattggtgcattttctatggtgggcacatttgggaatatcagtagaaatttcaaatgcacacacagcttgatcccataattccacatctaggaatttatcatacaaaaatattcatatacaaaatgacacatgtacagggtgattaattgcaattatttgaaatagcaggccaggtgcagtggctcacgcctgtaatccctgcactttgggaggccaaggcgggtggatcgcctgaggtcagaagatcgagaccagcctgaccaacatggtgaaatcccgcctctactaaaaatataaaaagttagccaggcgtggtggcgggcacctgtaatcccagctactcgagaggctgaggcaggagaatcacttgaacacagaggcggaggttccagtgagccaagatggtgccactgtactccagcctgggcaacagaaggagactccatttaaaataaaaataaaaagaaatagcaaaagggggatgcaaacatctactaatagaagagttgtcaaataaatgttggtatgtccatagtacatactttggggtactctgtggatgttaaagaaataaaatctatatatgctaatatggaatgattggcactatgtgaaaacagcaagtgtaaataagagaagggttatataatcacataactctatgcatgtaagaaactagcaagaaaagttgcctctgggatataaagacgtttttcgctgtgtgctttttttttctatttttttttaaaccccatgaatgtatctctccaagataattcttttttctttaaataaaacttcaccggggagggccagaaccatataaaacggtatctagaagtaccatttgttggccgggcgcggtggctcacgcctgtaatcccagcactttgggaggctgaggcgtgcggatcacgaggtcaggagatcgaaatgatcccggccaacacggtgaaaacccatctctactaaaaatacaaaaaattagccgggcgtggtggcgggcacctatggtcccagctactcgggaggctgaggcagaagaatggcgtgaacccgggaggcggagcttgcagtgagctgagatcgcgccactgcactccagcctgggcaacagagcgagactccgcctcaaaagaaaaaaaaaaaaaaaaaaagaagtaccatttgttgtttctgctgctgtttgctaaacgcttgggggaagacttgagtatgttcaggtgatggagggataacagcagtagaaaggaaaaggctgatggagccagttatctgaggaggaggacaagagggaaggcaggatcaggaggaggcaggcattagctttgggcagaagcagacacacctccttccctgagatggacgaggtaaggggaggattcattcctaaagagataaaaccagggccctgggtggggttgatggagctcctgcctcaaggcctctattatctatggaaaatattagttaggttatctgctcctagtgagggaggagatggtggccaagagggcatgaggactgtggttaaaatggtaaagcagctattgttgaaggccccataaacctgggtgctggcagtctgcgtggctaagaagctttctctagcggttttcaccaactgggagcctgagcagggggccggaaggaagtgaagaagggaaggggccagtgggttgaggacgttagacagtgagcaaggtctgaaactatgtgggaagagggtaagcagttctatcctatggttgcctgtttgtctccccagtgaactggaacccccctcctactcccagggcacttttcatagtccccagggcctgagtgggtgcttggtcatgggacacagttcaagaaatgtttctcaaattacttaatcgaccctgcaaatacaaaaacagatgaataaacgaaccctaagtcttagcacttcatcagtgctgcgagaaggcctttatcccatctggcattatccagcttatttacttaccttgttcccaagatttgtttgctctttccaatggtgatagctaccctcaagggaaggagacactgaggttatgtgtttaaagatgctgcaggctgtgatggcaaatactttgcaggactccactgtagctcctcctctttcctaacatcactttcatcactcgtgtttgaaatcccactctcagtggtccatggctgcatgcctctcaaagtgggtgtggggagtggggcagggggatttggaaggagggttctgcagagggaggggagcacagcaccctgggagaggtgacacttggttactgatgtcttagtactggtggtttgcagttgaaagggagcagcaaacacttggtgtgggaggagtaaagaggcgaggctcttaaaagcaatctgatgatcaatgtgtgtcctctataatttgggggaaggcctacccttcctccactccaggctctgcttttctctcacctctatcagcagaggaacttactgtagtctgggagggtctctccttcactcagccattcttcccactgtagttgagcacttgctgcaggcccagcctatggcaggcggaggaatgcagaggcccctccttccaaggcccacagagaggagccttcagctccagctggttcaatgtcccctgattgcctttggatattattatctgaatccgggattaacaactcctgaaccctgagcaagtgagagacagcagtgccctccagggacctggcagagtgcacatgccaggcagcacgtagctgctacggcaggcatggaggcgttgccatggaaactgcccaggcggcctttccactcacaacctctaggttcctttgtttgtgtcatccgtttctaggagatacatgcgaggctttctctcctcctttttctcatccctggaaagagttgtggaggagttgctggtgaatggggtgggagaagtcaagtgcagcccgggtgggaaaacagctgatgaatgccagggtttccagcgacctgtggggtagtggctcacagctctcagctctgctgctctggtgggagaagcccctcatcggcgattacattccaccagagccgctgccctctcctccctgcacccacaggctgcgaggtgctcaggggcaatcaggcagagctggatttgctgtaccaggcctgggtactccgaggcagtgaggtacagttaagagagcactgaaatcggagtcaggaggcctgaattttggccctaatcctggcacagcataaccttaggcaagtgttttccatcctcctggctcagtttgctcatctggaaagtgagagggctggaatagaacaataattccaaagtgctgcgtccgaatcatctgagaagcagatgcaagctgcattacacaatgcagatttctaggcccaaccccagagattcctattaattatgtctgggtggggcctggcaatatgtattaagggaatgtaaattcatttcattatgagactctgttgacacgcttgagataattagagacacttgaaagcagtcacaccagaactgtgaatcactgaattagaagtaaatgtcaagtacacttgaataatcgaacagaatatactaagactatgttatctgattagttccaagcctttatggcaacgatgccacttatctcattatgaaatgtctttcagtacaaaaaaaatgaccatcattgaaaacttctcaagcaggcatgacctcacagtgtcctttagcatcaggaataaatgggcactcatccagcctctcccaggtgaccgtcacctaccgaatgccacagctatgctgcaagaggtggggcaaagaacagcacacctagctttcttgaaactttccttccttcacttcagtaaatccatttcctctaggtctttcttgactcttcaacttttcatttatttattcagtaaatactgattgtatgagtgcaatcagactctgctggacactggggatacagtggagggcggggtttgtgggccaaccacaggttgatgtcatgagtgctgtgaaggtgccatggagtgcctaggagggggtcccaacccaaatatcttcttgcccttctcctgtctctaagtattgtcactttctaaaactcattgatatgatttggctctctgtccccacccaaatctcatcttgaattatacccccataattcccatgtgttgtgggaggcacccagtgggagacaattgaatcatgggggcggtttctcccatactgttctcatggtagtgaataagtgtcataagatatgatggttttataaggggaaacacttttcacctggttctcattctctctcttgctgcttccatgaaagaagtgactttcgccttttgccatgattatgaggcatccctagccacgtggaactgtaagtccattaaacctctttcttttgtagattgcccagtctcaggtatgtctttatcagcaggctgaaaatggactaatacactcatttttgtgcaaacctacctaaaatggcatttattggcagaatattggtgcagaacagggatggccatgaccagcagactggctggattgcaggtggccccagcagggagactctcacagttggtgatgagagaagttcacactgtaggtcagtcagcatcaagaaggttcaagcagctgggaagtgatgaaaaccctggtaggcaggtgagagcttgataggcaggtgttccactaatccagcagtggtcatgtggattcagcctcagtgttctgggccaggactaggatggggctttgtccagagagactgggagactgagcaggggatacaggcatggacacagacatgggcatgatggggaggggtagtggtcagtgaaggattccttgaagaagggatgtctgagctgaaacctgaagactgactcagaagtaactagacaaatagaggaggaaatgattccaggaagagggagcaaaatgtgaaggctcgagagaagaagctaccaatgcctgctatctgaacagaatcaatgagttgcctttctacttagattgaatgagagctcagaaaccttcacacctggagagtttggccaggccctgaaagacatcaagaagtctgcaaaggggacagaatccaggagtgacgctccttcctacctaaagagaatattaataacctttgcatggttgtttggaaggtcgtgaggtggccaattttcaggctcttctctctcttagggatagctaggtgataggaaagaaaacaagaggctcttatatattttacttccacaaagtaaaagtggaatccccataatggattattttgctttaaacagtattttaaaaaggtaagaaaagaaagaaaagcagatattaaaagcatttcccagctctttactatttttgatgctcttctttccttcccgtggatatgaattttcttatggtatcacttccccttggcctgaagaaattcctttaacatttctcttaggtggatttattgatgagaataaatccagttcttatttgcctaaaattttttttaccttcaattttaaaggaatttttactaggtatagaattatagtttgacagttattctttcaacactttacagatgtggttctgttgtctctggtctcttgtttctggggaggaatgagttgtcattgttatcactagttctctgtatgtagtgtttttcctccttttgtactttttaagattttatctttctcttttgttttcagaaatttaactgataatatgattttctttgtatttatcccacttaaggtttgatggacttcttaggtctgtaagtttatgttttaaataaaatttggaaaaatttttgtccatgcttctctaagcattctttctgtataattttctctctcatctctttctgggattccaattgcttgtgtgttagacttcatcttgcaaattgttgagactctattcattcctttaaattttttttccattgtgattcaatttggataatttttattgaactgttgttaacttcaccaattcttgcttctataatacattgtttaatctttatttcatccaatgagttttttaaaatttcacatattagaattttcagttttgtaagcctcattttgttttttattagcatttcatttctctcctgaggcatctcattctttcgtctatcacacccatccataggtgctttaatacatttatcatagttattttaaaatcctgtctgctgattcctatatatgggttgccaagatgtctgtttctattgactattttcacttgcttatgggtttcctgcttcttcacaagtaagtactattcattatcgtgcatattacattgtagagattctgggttgacctatcttactctgatgaggatagagttttgttccagctggcagttactgaaggatcaccttgtttctatgaatatttcatttagactctgtatggcaagtctattttactctgaatcctaggtttaggccttagtcttgagacgtggctcttactgctaagttatggcccttctggagtttcactgtaaaactaaggccctctgaattagtgagatttcttcaaactcagtctccccagcactagacagcaatggaaatatctgcacaggctttcagcctcccatttgttgctttctactggctttcttggacctttccctgaacatgtacagttcagagtcatccaaggatttgaggagaatttgcacacagatgttgggcttcctcctttgagactccttccgttccaggatttctctctcaatatccagctgttttgccagtcccaaactctgacctctgactccttagcccagtaagactgatgatttctgcctgagctctatttccatacactacactacacaatccttaggggaaaaatgggataaatatggatctcatctgctgtgtttttcttcttttacttttattttttggagacagagtcttgctctgttgcccaagctggagtgcagtggcatgatcttggctcactgcaagctccgcctcccgtgttcatgccattctcctgcctcagcctcccaagtagctgggactacaggcgcctgccaccacgcccggctaattttttgtatttttagtagagacagggtttcaccatgttggccaggatggtcttgatctcctgacctcatgatccacctgcctcgacctcccgaagtgctgggattacaggcttgagccactgcgcccggcttgtttttcttcttttaaaagtcaaatcctcttaagtttctgtatgttcttcacttctcgccaatgctttcaaataatttttttaaaattttgtctggagtttaaattatcaacaggagaattaattcaatatagaattactgggacagggatagcatggaagttgattttattctgtgtatctgacttaaaaggctgtgattccaaagcaaaagtggtaagaatgctcaaacaactaatttgggtagtaggggagtttaagagccaaacccggactttcgtagagtctaaaattggcattcaggacagtgagcctggagagcagttaggaggctgaggtctttgtgtgggcatgtgttgaaagctcattttagaggggtggtgatggaaacagggatggtacaggagggtttagctagacaagaaagacctgggtctcactgaataaggaggaaaaaggagaaggaagagacagaaattactcttcagttttgatcttgaaagacagaagggcacgactcttgagaaaggcatggaaattgggaagggatgttacaggcgaaggtgatgaatagttcacagggaggaggcagtgttgaaggtcagttagggtagaggtagtgatctctttttgggagagtgtagagagagccatgtggagacccggggactgatcctgagcaaatactggcatttagaggatggaagaagaaagtagaacctttgagagaaccttctctggaactaatctagaagaggcatcagagaggtagaaggggatctgtaggagaatctgttaagaataaggagacctggagagtgcggaaagctcagaggcctaaagtggaggagtggggacaagaaaagaccatcagaggcaagcaggttgctggcagtgacagtggtgagaacagaagtcatcataggttaaataggaagtgagcttagttactttaaaaaaatcatctgcctttaatgcagtcctatccctcatccaccagctctcccaatctcaggtcaggctctttgttgcctctgggagactggcagttgcagttgttgccaagtggcatttacaggctcagctccctgaggattaaccacccagaagaggattcagctctgaggacagagagatgagcacaccagttgagcagcctaacctccccatgtttggaagataaatgcttcccatcccagaattttaatttgagctttccaacctttcctgctttccaaacatttggctaagatgatggataacatttaattgtatacgtgtcttcctcaaagcattttaaacaaccttctcctaggatccaaattggctggagataaggcaggagggagactttgttccttaagcaccattttcccttttacaatctcatcatcagctttttggagctggtctcaggtgacattaacgtagagctggctgtggacacagcaggttctgggccctgattagggtgcccctcccaagctaaaagactaaggcatgaattaactgagaataagggtgagaaaagaggaggtggagatgctttctggggtccagtttgatgaatggagaggtcattaagcaagatggagaatataggaggaatgatgtgtttggagaagattatgacctcagttctgaactgtttggctggaggagtctgtgagatccagatgctactcagtagtcaatgttatctatgagttagggttcggaagagagctcaagggtggggataaagagtaactgggacatagactgttgggcatggtgtctctggatgcttggttgagttgctccagtccttcccaaagtccttcccatggattaaagaatgcgtcctaaacaacctggatggagaacaactctaagcagaattttcagaattgaaaaagcccccagcagagggtcaggacaggtgggttctaatttcagctccattttaacttacagtgtgacccaaagcaaatagcttcttgtctctgggacttgatttcctcatttgtaaaatgaggggatcagctttcgtcgtcttcctccactagcgcctaggcatccatagcactgtcttaaaggggtccccaaatgaggtaggttagaaggaattagacaccttgacagaatacaatcaggccttagagccctagaaagaaacttggagtggtatccttgagagcaatggaaggaaatagtactttttaccaacttgctgagtacttagaatgcaccaggcacagaggagggccctccgcttccgcttccatcatgtttcctcctcacaatgctgagcttctgtggcttagagagtaaaggagttaggattcaaatccagggcctcctaattccacaccagtgctggtcaacaccagacatgaaagaaagaaaaagctgagaagagggatgggagccagaggatcatttggcataaaacctgtcttttcctttgatcctgtaaacgttttttgtttttgttttgttttgtttttttttgagacggagtctcgctctgtcgcccaggctggagtgcagtggcgcgatctcagctcactgcaagctccgcctcccggattcacgccattctcttgcctcaacctctcaagtagctgggactaccggcgcccgccaccacgcccggctaatttctttttgtatttttagtagagatgggggtttcaccatgttagccaggatggtcttgatctcctgacctggtgatccgcccgcctcggcctcccaaagtgctgggattacaggcgtgagccaccgtgcccggccaatcctgtaaacattttttgatgctgtataagtaatcagtaatagaatttaaagaattataatttcaattttattttagattcaggggctacatgagtaggtttgttacatgggtatattgcatgatgctgaggtttggggttatgattgatcccgttacccatgtggtgagcatagtagtcaaaagttagtttttctttttttcttttttctttttttttgagatggagtcttgctctgtcgcccaggctggagtgcagtggcacgatttctgctcactgcaacctccgcctcacaggttcacatcattctcctgcctcagcctcccgagtagctgggactacaggcacccgccaccacgcccggctaatttttggtatttttagtagagtcagggtttcaccgtgttagccaggatggtcttgatctcctgacctcgtgatccgcccgcctcggcctcccaaagtgctgggattacaggcgtgagccacagcgcccggccacaaaagttagtttttcaaccttttcctccccgactctttccccctctagtagtccccagtgtctaccgttgtcattatgtccatgtgtacccaatatttagttcctcgttataagtgagaacatatggtattttgttttcgttcctgcattaattcacttaggataatggcctccaggtgcatctatgttgctggaagaacatatttttgttctttttttatgactgtgtagtattctatggtgtatatgtaccacgttatctttatccagtccaccaccgatggacacttaggttgatcccatgtctttactattgtgaatagagctgcatgtgtcttttggtagagtgatttattttcctttggatatatagccagtaatgagatttctgagttgaatggtagttctaagttttttgagaaatctacaaactgctttccaccatggctgagctaatttacattcctaccaacagtgtgtaagtggtccctttctccatagccttgtcggcatctgttttttgacttttaataatagtcttctgcctggtgtgagatggtatctcaatttggttttgatttgcatttctctaatgattagtgatattgagcattttttttcatatgtttgttggccacttacatgtcttcttttgaaaagtatctgttcatgtcttttgctcactttttaaatggggttcttttttgcttgttgaattgtctaagttccttatagattctggatattagaccattgttggatgcatagttttgcggatattttctcccattctgtaggttgtctgtttactttgttgatagtttcttttgctgtgcagaagctctttcatttaattaggtcccacctttcaatttttgtttttgttgcaattgcttttgaggacttagtcataaattctttcctaaggctgaagtccataatggtgtctcctaggtttttttctaggattcttatatttaaatctttacatttaaatctttaattttttacatttaaatctttaatccatcttgtgttaatttttgtgtacggcaaaaggggtctagttttattcttctgcacgactagccagttatcccagcaccatttattgaatgggggagtgctttctccattgcttatttttgttaactttgttgaagatcaggtggctgtaggtgtgtggctttatttttgggttctgtattttgttccattggtttatgtgtcctcttttcataccagtaccatgttgttttggttactatagccttatagtatagtttgaagtggagtaattagatgcctctgactttgttctttttgcttaggattgctttggctatttgggctcctttttagttccacatgaattttagaatagtttttttctaattctgtgaaaaatgacgttgctagtttgataggaatatcattgaatctgtagattgctttgggcactatgggcattttaacaatatttagtcttctaatccatgagcatggaatgtttttccatttgtatgatctctgatttctttcagcagtgttttgtaatactctttgtagaactacagattctttcaattccttggttaaatgtattcctaggtatttctttttgttgatttggctctccagcttgaatgttaattggtgtatagaaatgctactgagttttgtacgttgattttgtatcctgaaacattactgaagtcatttatcagttctaggagccttttggctgagtcttcagggttttctagatatagaatcatatcatctatgaagacagatagtttgacttcttttccttttacttttttctcttgcctaattgctctagataaaacttccagtagtatgatgaatacaagtggtgacagtgggcatctttgtcttgttctaattctcaagagaaatgcttccagcttttgcccattcagtatgatgttagatatgggtttgtcatagatggctcttactatgttgagacatgttccttcagtgcctaatttgctgagggtttttgtcatgaagtgttgttggattttataaaaaaaattctgtgtctgttgagatggtcatatagtttttgtttttaattctgtttatgcggtgaatcacatggaatgatttgcatatgttgaactaaccttgcattccaggaatgaagcctatttgattgtggtgaattaactatatgattgctgctggattcagttggctagtattttgttgaggatttgtgtctatgttcctcaggaatattggcctgtagttttctttttttgttgtgtatcggccagatttttgtatcagggtaatgctggcttcctagaatcaatgagtaattcctgctcatcaattttttgaaataattttagtataattagtaccagctcttctttgtacctctggtagaatttggctgtgaattcatctggtctggggatttttttgtgtgggtaggtgttttcattactgattcagttttggaacttgatattggtttgttaagaatttcaattaggatgggagagagaaggtagctcaaagtgatgattattctacctgcctcaaacacagtctgtaccttcctgttggcccaagacttgagagaaattttcacagcaatggagccttgcataattagatattcttcctctgcagattgggatatagaaaggaggacattttcatttaatgagaggatcacacatggctaagaacagaagttaggagttaggatagagatgtgttcttcaccattaatcctacctatagtaaagtgtgttgcactacttgtctcaatctgggttcaatcagggaagctgaaccactgtgagtattgtggattaaggaatttattagaggaactagaccttatgcaattgtgagagaatctggggaaacacaggtttgtgaagggaagttgaagaatcagaggaagagtcattgactggcccttgtgctggcaaatgaactgaaacttgcagggaaatctggaagccaggcacgttctaccgttggtgtagaagtccatagaaggtggtggactcagagtagcctctgcagatttgaagtaaactctctgatgatggggcctgggcttactactgatcagcaaggttgacaatcaggaaagagctagaaggagagctagtcacagagtggggtgcctgcctgcacctctgtggtgtctctcacctcctctgacatatgacaaatgcagagcttgatggctgtggcttctgtcccccacctctcactcagctgtacctctgacccaggaccatacaggtgaggggttctgtgagacagagttctcaacatagccaagttgatgctagaaccattgagcacattattatagtgatgtaatataattgatgattgctttggtttgtttttatatttactaattcatattttgcctcatttcaaaataggatttttgaagcagcttagagaaacattagaaattgagtgaaattgtaaaaggaagtgatggaggcagagaaaaatgtgtagggcaataaaataattcaaacttagtggcagtgttcaagaaatccatctaagagcctgtttcattgaagatggggctatggattgggctcagagcatcctcagagccaaagcaaatattttgtgacaaagatcatcacaaggggagtggcaaagattttcctgatcctgtgaactaagggaaatatctcctaggggtcctcaaaaatatccctttgataaggtgtcttggaaccattcagtgaaatctgtgctctgaggaattaaaacaaggaagacctggcatgtgctctaggctttcctggcctcatccagaccctatcctgccagaaagcggccaggagacaatttctaaacattacagctatatgattggatggtttgtatattcttcaagctaggagttgatgagctttttcttcttcttcttttttttttttttggagatggagtctcgcgctgtagctcaggctggagtgcaatggcgtgattttggctcactgcaacctctgcctcccagattcaagcgattctcctgcccgagtagctgagattacaggtgtccaccaccatgcctggctactttttgtatttttagtagagacagggtttcatcatgttggccaggctggtcatgaactcctgacctcaggaaatccacccgccttggcatcccaaagtgctgggattacaggcgtgagccaccacgtccagccgatgagcttcttctgtaaagggcgagatagtaaatattttaggctttgcaggtcgctaggtctctgttacagctactcagcactgtcattatagcataaatgcagccatagagagtctgtaaacaaatgagtgtggctgggttccaataaaactttatgaaggaacactaaaacaattctaatttccatgtgtcacaaaatattaattcttctttacagttatttccgaccatttaaaattgtaaaaaccattcttagctgtagactgtagccatacaaaaacaggcagcaggctggatttggcccatatgccatggtttgtgcacccctgtttcaggtggtcctccataactgattaacccatttcccgtttagaaaaaaaagtgccgctcgctgccagcgctcatttaatttgatgtaaatatgctttttgatgctgaagcaaagctgaccgattttcagtgtgaaaataaaatataaaaactgttcttggagttatttctaagcagaacttgtctctaatcctagtgtaacagaaatgtatatgatgttacactaggattagagacaagagcattctcggggcaaacggaaatgagttaagaaagtgggaggcggctgggtgcggtggctcacgcctgtaatcccagcactttgggaggccgaggtgggcagatcacgaggtcaggagattgagaccagcctggccaacatggtgaaaccccatctctactaaaaatacaaaattagcctggcatgggtcccagctactcgggaggctgaggcaggagaattgcttgaacccgggaggcggaggttgcagtgagctgagatcgcgccactgcactccagcctgggtgacagagcgagactctgtgtcaagaaaaaggccgggcacagtggctcacgcctgtaatcccagcactttgggaggccgaggcgggtggatcacgaggtcaggagatggagaccatcctggctaacacggtgaaaccccgtctctactaaaaatataaaaaattagccggacgtggtggcgggcgcctgtagtcccagctactcgggaggctgaggcaggagaatggcgtgaacccggaaggcgcagcttgcagtgagccgagatcgtgccactgcactccagcctgggcgacagagcgagactctatctcaaaaaaaaaaaaaaaaaaaaagaaaaagaatcttcttaagggtggggaaaattacaaactacgctgatcagttagagtggggcagaagcaaatcacaatggtggaatgtcatcagttaaggctagtttcacgtcttttgtggatcttcagttgcttcaggccatctggatgtatacgtgcaggtcacaggggatatgatggcttagcttgggctcagacgcctggcagttacctggagatcactgaagatccctccactggttttgatggaccgacaggtttggggccgtgacctgtgctttgctgaaaccctgcctggctccagagtcagacagatgccaagtgaggtcaaaagcaggtgctgtataaaccaggacttcctctccatggatggctaggctggcattgcaatagcaatgtgggctgacaccccgactttctgagagtgagggggcagaggtagaagccccaggaaggcagggcctagtaggcaaagtgaataatgaggtttccacttcagcagtacactcccctaagcaagagggatggaggccgagctcaaggcctggctcagagccagatgcttgggagaggactagagtctcatgggggtggtgatggtggtgtcagcacttaaagtactatttttctattgtcaaaattgccttcagaggccctcaattttcccacaaagtctaatggttggccgggagcggtggctcacgcctgtaatccctgcactttgggaggccgaggcaggcggatcacgaggtcaggagattgagaccatcctggctaacacggtgaaaccccgtctctactaaaaataccaaaaattagccaggcatggtggtgggcacctgtagtcccagctactcgggaggctgagacaggagaatggcgtgaacccaggaggaggagcttgcagtgagccaagatcgtgccactgtactccagcctgggcaacagagcgagactccatctcaaaaaaaaaaaaaaaaaaaaaaaatctaatgtttaggataaccatgtcccaccctatttagaaattctcttttgctcactaacatttaagagctactaatatggtggcacaacactgcaaatgtaatgtatgccactaaattttactcttaaaatgagtaaaattttaaattactcattttgtaatttttgttatgtgtattttagtacaagaaaaatgataaattgaggtaaaatataaaaatgcatatttatgttacatttattttaccaccaccaccaaaaaaaaaaaaaaatcactgaactggacaacaggacgtgaactctgtgtggatgtgggcatttaaagaattacccttttactgtctaacaggagggtgggtgggcaattccaaagagcttttgcttgtctgcaggagttattctattctgactttttttttttttttttgacggagtctgcaaccgctgcctcccagtttaagtgattctcatgattcagcctcctgagtagcttggactacagatatgcaccaccatgcctggctaatttttgtatttttagtagagacggggtttcaccatgttggccaggctggtcttgaactcctgacctcaagtgatctgtccgcctcagcctcccaaagtgctgggattacaggcgtgagccaccacacccagccctcattctggcttttttcattttgaactttttactatggaaattaaaaacaaaacaaaacaaaacaaacaaacaaacaaacaaacaacactcaaatagtgaagagaatccagcaatgcaccgtctttgagtctgggacccagcttcaacaaccattaaggtttgttgttctttttatttatttatttatttatttatttatttttatttttatttatttatttattttttattattatactttaagttttagggtacatgtgcacattgtgcaggttagttacatacgtatacatgcaccatgctggtgtgctgcacccactaactcgtcatctagcattaggtatatctcccaatgctatcccttccccttccccctactccacaacagtccccagagtgtgatgttccccctcctgtgtccatgtgatctcattgttcaattcccacctatgagtgagaatatgaggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatataccgagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttctttttttttttttttgctttaaatgttgttttatttattttgtttgtcacttcaattaagtgatcagaaggtacagacaatatataaacattacaaatgacccaaaaaaggctgagtggttccagccaacataacaggttttcataacagaatgaagacatcttatttcttgatttcatctgaccttatagcttagctgcatgagctaaagctgtgttgaccaacacagtagccaggagccacactgaaacacactactgggcacttacaccttggctagttcttttttttttttttttttgcccttctatcttttttattagtttaacattaaaacaattgagccagtgacatttttatcctctgatatgtctagcctagtaattattcaataaatgtgtttttatttatttatttatttattttttgtttcttttgtttatttatttatttatttatttatttatttatttattttttttattgttcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggataagaatttttcttagtacagagcaaaatgaaaagtctcccatgtctacctctttctacacagacacggcaaccatccgatttctcaatcttttccccacctttcccccctttctattccacaaaaccgccattgtcatcatggcccgttctcaatgagctgttgggtacacctcccagacagggtggtggccgggcagaggggctcctcacttcccagtaggggcggctgggcagaggcgcccctcacctcccagacggggcggctggctgggcggggggctgaccccccacctccctcccggatggggcggctggccgggtggggggctgacccccccacctccctcctggacggggcggctggccgggcagaggggctcctcacttcccagtaggggcggccgggcagaggcgcccctcacctcccggacggggcggctggccgggcgtgggggctgacgcccccccacctccctcccgaacgggacggctggctgggcggggggctgaccccccacctccctcccggatggggcggctggctgggtggggggctgacccccccacctccttcccggatgaggcggctggctgggcagaggggctcctcacttcccagtaggggcggctgggcagaggcgcccctcacctcctggatggggcggctggccgggcgggggggctgaccccccccacctccctcccggtcggggcggctggcctggcgggggctgacccccacctccctcccggacggggtggctgctgggcagaggggctcctcacttctcagacggggtggctgccgggcggaggggctcctcacttctcagacggggcggttgtcaggcggagggtctcctctcttctcagacggggcggccgggcagagacgctcctcacctcccagacggggtcacggccgggtagaggcgctcctcacatcccagacggggtggcggggcagaggcgctccccacatctcagacgatgggcggccgggcagagaagctcctcacttcctagatgggatggcggccgggaagaggcgctcctcacttcctagatgggatggcggccgggcagagacgctcctcactttccagactgggcagccaggcagaggggctcctcacgtcccagacgacggacggccaggcagagacgctcctcacttcccagacggggtggcggctgggcagaggctgcaatctcggcactttgggaggccaaggcaggcggctgggaggtggaggttgtagcgagccgagatcacgccactgcactccagcctgggcaccattgagcactgagtgaaccagactccgtctgcaatcctggcacctcggaaggccaaggctggcggatcactcgcggttaggagctggagaccagcccggccaacacagcgaaaccccgtctccaccaaaaaaaatacgaaaaccagtcaggtgtggtggcgcgcgcctgcaatcacaggcactcggcaggctgaggcaggagaatcaggcagggaggttgcagtgagccgagatggcagcagtacagtccagcttcggctcagcatcagagggagaccgtggaaagagagggagagggagacagtggagagggagagggagagggagagggagagggaaagggaaagataaatgtcttcttttgagaagtgtctgttcatgtccttcgcccactttttgatggggttatttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggcgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccatgcatctatatctctgttttggtaccagtaccatgctgttttggttactgtagccttgtagtatagtttgaagtcaggtagtgtgatgcctccagctctgttgttctttttttttggagatggagtttcactctttgcccaggctggagtgcagtggcataatcttggctcactgcagcctctgcctcctgggttcaagcgattcttctgcctctgcctccctagtacctgggactacagacatgtgccaccacacctggctaattttttgtgtttttttgtttgtttgtttttgttttttgagacgaagtttggctcttgttgcccaggctggagtgcaatggcgcgatcttggctcaccgaaacctctgcctcccaggttcaagcaattctcctgcctcagcctccggagtagctgggattacaggcatgcaccaccactcccggctaattttgtatttttagtagagatggggtttctccatgttgaggctggtctcaaactcctgacctcaggtgagcctcctgccttggcctcccaaagtgctgggattacaggcgtgagccactgcaccctgcatttttttgtgtgtttttaatagagacaggtttcacctgttgaccaggctggtcctgaactcctgaccttaagtgatccacctgcctcggcctcccaaagtgctaggattacaggcatgagccactgcacccggcatgttgttattgttaatatacccctccagtgtttttcaaaattctctcagtccatccagagcatgtcaggaaaagctcaagcaggggtctaaggtatgagcgggtgaaacctattctgcagggaggtagatgaaaaatgatctgagctgggaatagagtgaatgccagtagtcactgggcaatgggatgtagaatcccagctctctacatcacccagttcctgaatctagacactttcaacttcaactgtggtcttgggattggcagcatccatacaacctgggaggttgccagccttgcagaacctcaacccctgcccagacctgctgaatcgaaaactctgcgggtggggctcagaaacctgttttcacacacccttcagagattctgttgcctgctcaaattagagagcatcttcaacagcaagtgaggtgtatgggaatgtaggataatatccccaactacatgattcataacaagttgctgatagatgaataaagaaaagacagttggaataaatgagcagttgaagtaaaattactgtattattgggggaataaatgagcagttggagtaaaattattgtattattgggggaataaatgagcagttggagtaaaattactgtattattgggggaataaatgggcagttgaagtaaaattactatattatttattcatttatttaacacacatttgttgggccaggtgttattctggcactgtggatataactaaacaaaacggacaaaaactcttggccttgttctcgtggggaaacttaataattgagataaaagaataaaagatgtgggccaggcacagtggctaatgcttgtaatcccagcactttgggaggccgaggtgggcggatcacgaggtcaagagatcaagaccatcctggccaacatggtgaaaccccatctctactgaaaatacaaaaataataattaaaaaaatacaaaaatttgctgggcttggtggtgcacgcttgtagtcccagctacttgggaggctgaggcagaagaatcacttgaacccgggaggcggaggttgcagtgagccaagatgacgtcactgcactccagcctagtgacagagtgagactccatctcaaaaaacaaataaataaataaaataaaaataaaagatgtgatatttaaaaggtgaaaagtgatagagacaaacaaagcagggaggggaaatgagcagcctgtgggtggggacagagaaagggtttgctgtgtaccaaaaagtggctaaagaaggcctgtggaggctgggcgaggtggctcatgcctgtaatcccagcactttgggaggccgaggcaggcagatcacgaggtcaggagattgagaccatcctggctatcacggtgataccctgtctccactaaaaatacaaaaaattagcagggcatggtggcgggcgcctgttgtcccagctactcgggaggctgaggcaggagaatggcgtgaacccgggaggtggaggttgtagtgagccaagattgcaccactgcactccagcctgggcgacagagcgagactccatctcggaaaaaaaaaaaggcctgatggccgggcgcggtggctcacgcctataatcccagcactttggggggccaaggcagctggatcatctgaggtcaggagttcgagaccagcctggccaacatggtgaaacccccgtctctactaaaaatacaaaaaattagcggggcttggtggcgtgtgcctgtaatcccagctactcgggaggctgaggcaggagaatcgcttgaacccaggtggcagaggtttcagtgagctgagatcgcaccactgcattccagcctgggtgacagagtgagactctgtctcaaaaaaaaaaaaaaaaaaaaagttctgagtgaaaaagtggcaattcaataaaatcctgaaggaagtgagggaggagccatatgtgtacctggggaaggtcatttcaggaagcaaggggacagccggtgctagagtcctgaggcatagcactaaggaggcaagtgtggctggagcacagtgagtaagtgggggagagctgcaggaagtgtggccagattgctaacagcggacatgccgtaaagggtctcacagacattacgaggactttggctcttacactgtgtgagatgggaagtgtattaattttcttgttgctgctatcataaattaccacaaatttcgtagcttaaagcaatgtagatttattctctttcagttctggaggtcagaagtccaaaaacgagtcttctatggccaaaagcaaggtgtctgcagggccagttccctctggagacttcaggggatgatccagtccttgcactttccagctttgagagcccactggcactccttggctagtagctgcaccactccaaactcggcttctgatatatctccttctctgacttggaccctcctgtcttcctgttttaaagacactcatgatgacattgggtccacctggataacccagaataatctctccatctcaagatccttaatcacatctgcaatatcttttttactgtgtaaagtgacatcatctcaggttctgtgaaataggatgtgaaaatatttggggagagcattattcagcctaccacaagaagccatcagagctgtgacagtgttatgtgctttctaagagtcattacagatactgtgttgaaaattgttttgggtaggcaagagtagaaacaggaaaattagttattatatcaaagtccatctactctttaactcctaaggaccttgtaggctgttcccacacaaatgagcatgtaattctgttatgggctgaattaagttctccaccctaatccatatgttgcagcccaatccctcagtacctcagaatgtgactgtatttggagactgggtctttggagaggtaattgagttaaaatgaggccattagctaggggttcctaaaacactctgactaatatccttataagaagaggaaatttggatacacaaagagacagcagggatacgagtacacagagagaaggccacatgaggacatggcgagaaggcggccatctgcaagccaaggagagaggcatcagaagaaaccaaacctgccaccctacaccttggtcttgacttccagcctccagaactgtgagaaacaactttctgctgtttaagccacccactctgggtatttgtttatggcagccctagcaaactaataccaattttaaatgctttcctgaaacccagacacagaccctcctcttaatcccctagttcaggattcctgtcaggaaaggaagtcacctagttggccagatatttttgaagcaatcctccctacatcctaggaatgaacaattgaaaagaaaagtcttttgctcttcaaaagacactgttcagaaaatgaagacaaatcagactgggagaaaatattggcaaaacacatatctgataaagcacttgtatccaaaatatataagccacctaaataaaacaccagttaaccaagtaggtaaaagatctctacaaggagaactacaaaacaattctgaaagacatcagaaatgacacaaacagatggaaatacatcccacactcatggattagaagaatcaatatcatgaaaatgaccatattgcccaaagcattctatagattcaatgcaaattctatcaaaatgccaacatcatttttcatagacttagaaagcaatcataaaattcatatgaaataaaaaaagaagaggttgaatagccaaagcaatcctaagcaaacagaacaaatctggaggcatcacattacctgacttcaaattatgttacaaggctatagtaaccaaaacaatagcatggtagtggtatgaaagtagatacatagaccattggaacagaatagagaacccaaaataaagccaaatacttacaaccaaccaatctttgacaaaatgtacaaaaacataaactggggaaaggataccctattcaataaatgtgctgggaaaacaggatagtcacatgtagaagaatgaaactggatttatctctctcaccatatacaaaaatcaagatggattaaagacttaaatctaagacttgaaaccatacaaattctagaagaaaatctaggagaaactcttctggacattggcctaggcaaagaatctgtgactaagaccccaaaagcaaatgcaacaaaaccaaaaataaataaatgagatctaattaaactaaaatgcttctgcacagcaaaagaaataatcttcagagtaaacagacaacccacagaatgagagaaaatatgtgcaaactatgcatctaaccaaggactaatatccagaatctataagaaattcaaacaaatcagcaggaaaaaacaaataatctcatcaaaaagtgggcaaatgacatgaatagacacttttcaaaagaagatatacaaatggccaacaatatatgaaaaaatgctcagcatcactaatcatgagggaaatgcaaattaaaaccacaatgagataccacagccaaaatggccattattagaaagtcaaaaaacaatagatgttggcatggatgtggtgaaaagggaaggtttatacactgatggaatggaaattaatacaacctctatgcaaaacagtatgaagatttctcaaataactaaaagtagatatatcattctatccaacaatcccaccacgggtcatctacacaaaggaaaataagtcattatatcaaaaacacgtctgcactcctatgtttatcacagcacaattcacaattgcaaaaatatggaaccaacctaagtgcccatcaatcaatgagtggataaagaaaacgtagtttatatataccatggaatactacttagccataaaaaagaatgaaatcatgtctcttgcagcaacttggatgaagccggaggccattattctaagtgaagtaactcgggaatggaaagccaaatatggatgttctcacttataagtgacagctaagctatgggtacacaaagggaaagagagtggtataatggactttgaagacttaggaggagagaggatgggaaggggataagggattaaaaactacatattgggtacagtgtatactacttaggtgatgagtgtgctaaaatctcagacttcaccactacacaattcatccatgtaataaaaaaccacttatattccaaaagctattgaaataaaaaagatgtatttaaaaatgtgagcaaaagatttgaacagacacttcacattagaagagatatggctggcaaataagggcagaaaaagatgctcaacattgttagtaattagcaaattgaaatcataatgagatatcattacatacctactaaaggacataaaaaaatctgatgatatcaagtgctgacagaatgcagaagtgctggaattctcatgcattgcttatgggaatgcaaaatggtatagccgctttggaaaagcagtttggcaatttcttataaagttaaagatattctttacacataacccagtcttaaatattaaaccaagagaaataaaaatatattttactgtatgggaatagcagctttactcataatatctcagaactggaaacaaaccaatgtccctcaactggtgaataaagaaaccatggtacatccacaagatggaatcctactcagtaataagaaggactgaactattgataagtggaactacatgatctcgaaagcaatatgctaaatggaggaagcagacataactggcagcatactgcatgtcccatttataagattttttttgaaaaaacgaaactataggggcatagttcaggttattggttgccaggggctggaagaggataattaccctaattaagacaacatatgcagccgggcgcggtggctcacgcctgtaatcccagcactttgggaggctgaggcgggcggatcacctgaggtcaagagttcaagaccagcctggccaacatggagaaaccctgtctctactgaaaatacaaaaattagccgggcgtggtggcacatgcccgaggctaaggcaggagaatcgcttgaacctgggaggcggaggttgcgtgagccgagatcatgccattgcactccagcctgggcaacaaaagcgaaactccgtccaaaaaaaaaaaaaagacaacttatgcaaaagtgtaaaatgctacatgagaagatattatagtattgtgaaacatcgacaaaccttcctcaggaaggcaatccgtgggagagaatgtcttttatcacctttcttgaggcaatggtgcctgctgtcttacactttggcatttaaaaggaggcccttgagagatttatttgcaagctttgcaccaaagtgacttgctagcaacttacaaggtaacttctttcactaagttctttctttccaggcagttatcctgtggcagttgtccaccatttctgctcctctgaggagcagaattagaactgattcttattttatttttttatttctttttctccctatacttcaatggatgcaaatcttattttattttttatatggctctgcatttaaaaaaacaaaagcatagaaatgcgtatagttggggagagtttgggaaacctcaagaagtcaggtgtggctagaagttggatatatggggaagtggcaggagatagggcaggagctccatgatggccgtaaaggagattgtgtctgtggggtcctttttgcaaaggtccttacagccattctgctccgggtttaaagcagtggatctcaatgtgttacacccagaccagcagcattgaccttgcctgagagcttgttagaaatgcaaattctcaggccccacctcaaacattttgcatcaaaactcgaatcaggctcagctctgtgttttaatgagcctgccaggtgattttttatccatgttgaaacctgaaaaccactggcttaaaatatttccaatttgagattggaaatctcccaatttggctagctccccagtgagctagccaaaaagccagctgccttcctgatctcttagcccatcctcttgtacagggtcccctgtcttggttctctaaaccccagagaagccctcttctctgaaataatggcaaggaggtaagtacttgcctctgaatgaatagatgggattttatttacaggcaaagaagcgtctgggagggccgcacttcacagtgcttgcccaaatccatatacttctctctttgggttaaaaagacctagaagtaacccagaagaggtgctcaggaggcactgggtcatctagtgctaggatgttacaatgtgttctctgctgtttctctagattatgtggctcttttctgtctgttcccattatctaaggacagagcatcccactctgacctccctgcagaacaaggaggccgtggctgtttgaaattgccgtgaaccctcaggggcagctccaatgcctttgactttcagacccctcacctggaagccatctctgcttcaccagaacttactttactcccaatttctacctgggattactgcctgtgtgtcttgttttccttacagtctaaagtgcttagcatatgggaaagaacccaataaatgataattactatttttggtgggttttttttttttcattaaacagggagaaaagagggaggaaaccctaaggagagggacaattagagccagctacataatttgcggggccccgagcaaagtgaaaatgtgaagcttggatgctggaaaaactctctccttcccatgggcccactcttccaggccatgtctgataggtaacccccaagaggttgcaacctccttgcagggacatgcttcaaaactgagatggttgagaggacccactgagtgacttgccaaacacatcatcaccagggcacttgcaaccgagggcacttgcaatccagggcagggatggctgttaccttgtcctgcaaggagcatgcccaaccctgatcctccccatttatgcacccaatccctggctgaggctggagggcaatggaggaataacattgttgtcactccggcagagggtggtggctgtcacagaatgggaaggaaaatattggcctcaggttcaaggatcaggtggctaataactcatcccagggaggtgttgggaggtgaccacacatgaatcatctgaccatatcaccttgtctcattagtgacatctatggcttaccaaatagagccaccctcatgggcatatgccccgggtagtcacacagggccatgctcagaagggccccatgcttgatgtgatactctgctgttgccatcttgaaattctaatgactttatctttgaacttgtgtttatttagtgaagtccaacaggacaatgaagcacacgtgtaaacagaggaggaatgtgtgtccgccattcctttctgccccatttgcctgtagtattcacgagaccccatgagcatagaatctagtggactcatggcatgtaggagtttaatgaatacaaggaagtgcacatgagtgcaaattaagtgtggtatatctataactgagtaagtaggggatattacagccctagatgccacaccttctgttccaactagaacttgcttcaaatacagagagaaggcattttaagaaaaaaagcaatcaaggaacctatcattttttcttactgtaccagtcaaccactcatgctgaataagatgacatagaaggaaaggaaaagattgcacaacccatagtttctcttcccttcagtccttctttccccatcagtaagcctaagatagtattagaatgtgcacgtattgagaagtggtacaaaaatagttgagttcgttttgcacagcatttctactgtcctggtaagaatgaaatacacatgcacatttgagctttgaaatacaaactgtgggccgggcgcggtggctcacgcctataatcccagcactttgggaggccaaggcgggtggatcacgaggtcaggagatcgagaccatcctggctaacatggtgaaaccccgtctctactaaaaatacaaaaaaaaattagccgggcatggtagcaggcgcctgtagtcccagctacttgggaggctgaggcaggagaatggcatgaacctgggaggcggagcttgcaatgagccaagatcgcgccactgcactctagcctgggcgagagcaagactctgtctcaaaaaataaaataaaataaaataaacaaactgtgtaattttaatgatttcgaatatgagttaaatgtgcttctttgcatttaaaactggcattgccgggcgcggtggctcacgcctgtgatcccagcactttgggaggccgaggcaggtggatcacaaggtcaggagttcaagaccagcctggccaatatggtgaaaccccatctctactaaaaatacaaaaattagccaggcgcagtggcaggcacctgtaatcccagctacttgggagactgaggcgggagaattgcttgaactcagagggtggaggttgcagtgagctgagattgtgccactgcactccagccagggtgaaagagtgagactccgtctcaaaaaaaaaaaaacaaaacaaaactggcattggacaatataaagaagaacagtaaaatttatgctaataatttaaattttaaattttctgtacttagaatgacactagtagtaaatgaaaaacaccacgacgaatcaacagagagaaagtggaagaaaaaaaagccttatattttagtatctttaatggcccttactctttgaacaaagggtctacattttaattttatactgggacctacaaattatgtagctggccctgccccaatcatccaggacttaccctcatgtcccacaggcttcctttctaccccaagacctggcatcatgctctgcaatttcggcattcatttgactgatccatattccaggtacataatgctttggaaaagggaatgtgttatattaagacacaaagttgtatatgcatgaaaaacttataaaaaatgatctgattttagacaaggatatttatctcaacactttttataatagcaaaaatttggaacaacatatctgttacaatatgggagatcaatttattaaatgaatttatgtccatgcagtggaatattttgatcctttaaaactgatgtcagagctacatatttattgaatggaaaaacattcttgctatattaataaattttattttattttattttttctgagacagtgtctctgcactcaggctggagtgcagcggtgccgtctcggctcactgcaagctccgcctcccgggttcacgccattctcctgcctcagcctcccaagtagctgggactacaggcgcctaccaccacgcccggctaattttttttgtatttttagtagagacgaggtttcactgtgttagccaggatggtcttgatctcctgacctcgtgatctgcctgcctcggcctcccaaagtgctgggattataggcgtgagccaccgcacccggcctattaataaattttaaaagtaggttacaaaccagtaaggatagtgtgctaccagtttgctataaaagtacaactgtggctgggcacggtggctcacgcctgtaatcccaagactttgggaggcccaggtgggcggatcatctgaggtcaggagttctagactagcatgaccaacatggtgaaaccctatctctactaaaaatggaaaaattagctgggtgtagcggcacatgcctgtaattccaactacttgggaggctgaggcaggagaatctcttgaacttgggaggcagaggttgtggtgagccgagatcgtgctattgcactccagtgtgggtgacaagagcaagactctgtctcaaaaaaaaaaaggaaaactgtaaccatacactacatatgcatttaaagtatctgaaaggacaaatataaaaatatttacagtaattgttctagattataaggttatagcttttaaaaaatctatgtcttctagctttttctcaatgaacatgtattacttgcataaataaataatatgtttggtttttggtttgaagtctctgtttcagcttcattaggctaaagatgtttggacaaactattctttttttttttttctgagatggagtttcgctcttgttgcccaggctagagtgcaatggcacaatctcagctcaccacagcctccgcctccgaggttcaagtgattctcctgcttcagcctcccgagtagctgagattacaggcatgtgccaccaagcctggctaattttgtatttttagtagagacggggtttcttcatttggtcaggctggtctcaaactcccgacctcaggtaatccgcccgcctcagcctcccaaagtgctgggattataggcgtgagccacctcgcccggccagacaaactattcttttaaatgtgattatcacttaaatcagtagactttgagtaaagcagattacctttcattatgcagtgggcttcatccaattagataaagtccttaaaatttaataacataaggccgggcgcagtggctcacgcctgtaatcccagcactttgggaggccgaggtgggtagatcatgaggtcgggagatcaagaccatcctggctaacacggtgaaaccctgtctctactaaaaaaaatacaaaaaattagccgggcgtggtggagggcgcctgtagtcccagctacttgggaggctgaagcaggagaatggcatgaacctggtgggggcggagtttgcagtgagccgagatcacgccactgcactccagcctgagcgacagagcgagattccgtctcaaaaaaaaaaaaaattaataacataaaattaactatcctagttgagtagctgaaaaaattcacatttttattaagaagtatttattaagcacatagaatatgtgatgtgttgagagcacaaagttggataaaacctagtcctttcccccaagaagctcctcatcttttagaagaaggtggtcaaagaagcagacaataataatacaagatgataagagcaatggtggaaaggctcctggaggtgagtggggtgttatcttttttttggggggagctacaaaatttgatataagtctatgaaatgaaccataagatcaaggagcttatgtctgaatccagacgcagaatgaaccaacctcatgactaaagttgtctaggatgacacagaacttggtttagacaaaaaggtgacactgaactgcatctaaagaataagtagaaatgctcatgaagggggaagaggacagtgcattccaggttgagaatgggacgatggggtagcacacagcatgagtcgaatcagagagagcatggtgcatcaggaatttgtgttactcaagtgggaaaagtggggagagccacaggaaagattcttgagatccatgaagcaacctatatttactgggagtctgctattgccaggtactgagcatgtgtgtgggtgttggggaggggggatggagtatgaagaagagtgtggtgtttctgccttcaaggagttaacagataggctggacacacacacacacacacacacacacacacacacacacacacagagcattctgcataggctggagtgatccgagatggttttgtccattgtagttgtatatgtcttgtgtctggggtggaagatgggagtagaccagggtgaaggggagggacaatagagaaagggtgcagccatatgtaagcaaaggttcaaagaaggctcagaggagcccagtttccactaccctgggaagaaatcaaatttgctggatagaagagtttgcatcaggaaggaggctagggcagggtggaactgggagagtgataaacaccagctgaagtaacttggacttcatcccgtgggcagtaaggcttgatcaaaacaggagtgtggcaaaattttaggtgtgtaagatggtgatgtgggtgtaggaagagcagctgaagtgtagggattttgagggagggagcaagatcagggatggggcaatattataaagagctttgaacaataagctaaaggctttgaagtttatccttcaggttactagtgtttttccaaaaagttttaaagcagtggcacctgcccccctgtttttttttcaaaataatcttagcagaagttcaaaatatcaaacagaaaccagcagccatcaagtttgcttggttcaaaaactgctgaaagcaatggggattcaaggaagttgtaaactctgatggcagtgtaggatctgattgacaggagagaagctgaaggctagaggcaggttagaaagagatgatgaaggtgtggatggtggagaagaagggagcgagatggatttgaagggtttaggagggagaagcaacagggaggagaggggaagagcccaatcccagccaggaaagagaaagcagagcccttgatggtggttgtggggtgaggttcttggctgccatcagggaggagaacttgaaaacatctggtccagttgtgtggcctctgctacggatggacagtactgcctgtcccctaaactttgttcagtgctgagactttttggaggaacttttggaagaagatttgaattttgagtcttacaaaaagtacaatactgtgcatgtgtccatgcagtctgagaatcagaagtaaaacaactcttctatctgggctgtcagaaaagttttgtttgaaagttccaacacagtgccttttcttttttaatttttattttaagttcaggggtacatgtgcaggatgtgcaggctttttacataggtaaatgtgtgttaagggagtttgttgtacagattatgtcatcggccaggtattgagcctagtatccattagctatttttcctgatcctctcctttctcccaccctctgccctccagtaggccccagtgtgcgttgttcccccctgtgtgtccatgtgtctatgtgacacagttcttggtattgctaacaaaaataagcttgagtcctgggctaaaatgacctatacagatccctgactgtcgagaattgtgaaggatttgagattttgctgtacttgcaagctaacaagcctgactcacagatgccaacagaagacagaagactcctgggtcagaggcaaagaacaggttagtacttaagtaatagcagcagcctagtatccctatttttgcattggttcctcaaacctcaatttccacagggtgacaaaagacccaggtaattcttgcacttgttgtgggttacattataagagaggaattccaggcttagtgaactcaaatcttttgtgatgggccaggtgcggtggctcacatctggaatcccagcactttgggaggctgaggtgggagaattgcttgagcccagaagttggaggcagcctgggcaacatgatgaaaccccatctctacaaaaaatacaaaaatagtcaggggtggtagcatgcacctatggtcccagctacctgggtggctaaggtaggaggacggcttgagccggggaggtcgaggttgcagtcagctgagattgcaccactgcactccagcctgggtgacagagggagaccctgtctcagaaaaacaaaatgttttgtgacagacaataagcctacctgaactttgccctgaaaaaagatactatctttgttaatactgggcgtaaacaaacctgaccctgccctggagggagacactataccttccagggctgttagctgcacagacatccttgaaaagatagtctgaaatagaggcagggagtgctccgactctaagatatgcacaaatgccagagacctgtgaagaattgtctcctaacatgacaaggctctgataatgctgagctgaagagaagacacatttctttcactccatatctttttcctccgtggaacccatcatactagatgacttttccagttgacctaaaaggtcaagtcttctctcacactggaattctttgaagtgtctcagatatctgaccactaggtatctgaagttctaccctgaagggaagttctacttgtctatgcatggctagtttaatgatttttcactgaccatgcctttaagttactttgattcttcttacctcaaagctctcagcttctttagtagcttgaaattttgtaaaactgaaccaatcctatttacttggaccaaattgctaaactcaaaattaagaggtctatgaggaacgttcagaaactctcctaaataattttctcaagtttgaaagaaataaaatgcatatagagctttgcagaaagcagttgtaaaatagagcagccaacacatcatggtgaaagatttaatgaggcaattgaagaaagtacttccatatcttgcgggttcttctaagctaccagtcttgttactttataatctcaccacactgaagagtcacactctggaacctacagatatgatgagttttgtcaaaacagctctgcagatgggacgaggaactgtagttcctttgagccagatctctaaaggggatccccttacccgcttctgagtctagaggtctccagcagaggctgcgtcttattgcagtggacccgccttgtatatcaagtgaaactaactttgcttctgctgcaataactgattgaaccagggatcattacccaaaccaaaggcgactgggtatagattggacatcatggagctcaacccattgtgaggtggcttggagaaaaatttagctcttagtacaggtgatccacatcggatgggacagaaaaacccaaccaaatcttctctataaggcatataaatgtcagatccacagagggatgttggtatacccttagtaaacaaagctgtcggtggttcagttctccttgagtcctggttatcaaacccagcatacactgggactcaaacaaacagaagagttgagaagaataaacagatcctgcatgctctcacattcccttgtatgctcatctctatttccaagccatccttgaaatagaaaaacatctttatgtcctaaaacaatttaaggaccttttaatcaatgtgtaaacagacctaggattagagttaaagaggtggaaagtaaatcccacatgcagaagatctgagaccctggagaagaggcactgtgctctagcccagcactctataagcatcaagttaggcagacatctgctggtgaggagagaaaggtagcttcgctgtcggtactgtcaaagacaaaggtgaagacttgctcccagctgctgcaggaaaacattctatagtgtggtccacaatgtatgagagactaaaaaagttcaagcacattaggaatgaaagcttctttgtccacaccccttcagtagaggatctcatcctttcccatgcctctaaatataagtgaacttgacaactcccaaattttacctgcagccagatttctgatatgaacagaaactcatgtaactgtccacttgtgatctccgcttgagttatcacaggcatttcagtttagcatgtctgaaatggaactccagatctatccatcaaatccattcttccccatatttctgtctcaataaagggtacttctcacttgcttaagtcaggaacctggagtcgctcttcatccttcatatccaatccaccagcaagtgctgtcagttctatctccaaaacatgtcttgactccacccgcttttctccctctctacagccatcatcgtttgccagaccacaatcatcttttgcctgtttggctcagtggcctcctaactggttgaccagttccccttctgctcttttccaatccttgttccagacaacagcctgagtgattaaaatatcacccctctgtatttgcagattctgcattcagaaattcaaccaactgcggatcagaaatatttgaaaaaaattaaaaataacaatacaacaataaaaataatgcaaattaaaaaaccaatacagtacaactgtttgcatagcatttacattgtatgaggtattaggagtaatctagggatgatttaaagtatatgggaggatgtgtgtaggttatatgccaaaactatgccattttatatcaggaatttgagtattttggtgtccctggggagttctggaagcaattccttgaagatacctaggaatgctgtatatatacacagtcaacatgtctcttaacaatgaaaatatgtcctgagaaatgcgtcattaggtgattttgtcattatgggaacatcattgagtgttcttacacaaacctagatggtagagcctactacacacctaggctgtatggtatagcctattgctcctaggctacaaacctgtacagcatggtactctattgagtactgtaggcaattggagtacaatagtatttgtgtatctaaacatagataaggtacagtaaaaatatgatattataatcttatgagactgctgttgtatatgcggtctattgttgactgaaatatcattatgtggcatatgacatgtatacacacacacacacacacacacacacacacacacacacactgaaccatgccactgacctgcttagtaccctttagaggcttcccattgaacttggaataaaaatcccaccttcctctcatagcctttcagattctccctggagctgaggttcatctcacgcccccttcatctatgctggccctgctctacttctcacagaggcatgttcttgccaagatatttcctgcttcagtgcctgtgagcatgtggttccctctcctgcaaggctttctggcccccactctgcctggcactgaggcatgtcatgcacattgtattttcatgaacaatgtcccttagagctgtccatcaaggcagccctctttcctgaccacacaacctaaaatcagctgccagcttctcactctcagagaccacattttttttccctcatagcctgtaacacaacttgtaatacatatttatttgggtatttactttttaaatctctcatgcctccttagactgtaagcttccttcaggtaaggatcacacttgacatgttaaccactgtatatctatgggcttgatacagtgcttggtgtaaatcggtgttctgtaaattcttgtggaatgaatgaagtaaggaaaacccacagggcaaggggaacagggtctaacagggctgggtgagagtgaattaagcaaaaatatgacaccaatactgagcaaactccaggcttgagggcatggcatgctggtgcttctctgagagtcccatctgcccaggctcttagaactgtgtgctgatagctctttaagtgagggtaaatattaacacaccaggattaccccaactgtgaactcaacctatgtggtccgagttaaaggccttatctcttgctacaatcaccagacacaaatgaagagagatcagtattctatgcttctctccctcctcccacacttccactccatatcctggtattctttgccctttcaagcttctgtgctctgccttcactatttatttattcttttgcttctcctttctccatgcccaggaggctgccctttctttttggcccctgtattccagagggatctcaggcattctagcccttgacttgggtcaccactgctgaatcaaccgccccattctcatgtctttccttcgggtctttcggacagtcttggctagagagccccagccacctgcctggccctgctgaccagcacaggctcccaccgatcagtctgttatctttgctccctgatcctcactctctgaggctgcacgtagctctctctctagagggagggagagccatttctcatgctcctgtgatttaaaaaggcaggcattactttatcacaaagcgcccagaaaaaccatagcccagaataaaaacagatccctttctctgtggtctctttctgcttcctttttaaacttctctttttttggttgtacatatagtcaacagaaattaaaaccatcagtcagtggatatcaagttactgttggaaaaactactggtagcattatgtgtatatacttttattcaaaatgtcattacatgttatcatgatgcacatactataaacttcaatgggtgtgaaaggtagacatgaaatgttaaatttcccttctatgtccacaccgccccacttccccttagcaagtttcttgcataacattctgaagatcctgtgcatttacaaacatgcatataagtgcactttccttcccctcctcccactcttccattgttctgcaccttgctctgttctctgaacaatatgttctgcatcaggaatccaaaagtgttctaacttttttttttttcttttcaagatggagtcttgctctgtcacccaggctagagtgcaatggctcaatctcggcttactgcaacctctgcctcccgggtccaagtgattctcctgcctcagcctcctgagtagctggaactaagggcacgtgccaccatgcccagctaatttttgtatttttagtagagatgaagtttcaccatgttggccaggctggtctcgaactcctggcctcaagtgatctgcccgcctcagcctcccaaagtgctgggattataggcttgagccactgtgcctggcctcaaaaaagtgttctaagtttttatagctacatagtatttcattttttggacaaatcataatttacattaagaaaatggcatgaaatttcacacatatattacaatatatttatgaataaattcctcaaaatcaaggggtataaatacattcatttttaatttgatagagattgttgaattgccatctggagtaatttatgaccatgcttgttctatacatctttgtcagtatagtttacaaaatttttctattttgctaatctgtgaactgaaaaatgcagttattataattttaatttgcttttttttttttttttttttgagatggagtctggctctgtctcccaggctggagtgcagtggcacgatctcggctcactgcaggctccgcctcccgggttcacgccattctcctgtctcagcctcctgagtagctgggactacaggcaaccgccaccacgccaggctatttttttctgtatttttagtagagatggggtttcaccgtgttagccaggatgatcttgacctcctgaccttgtgaccgcccacctcggcctcacaaagtgctggtattacaggcatgagccactgcgcccggccgcattttatttgaccacaagcatatatttgtatgtttagagcaggggtgtccaatcttttggcttccctgggccacattggaagaagaagaattgtcttgggccacacagaaaatacgctaacaccaacaatagctgatgaactgaaaaacaaaacaaaaatcacaaaaaaatctcataatgttggccgggcgcagtggctcacgcctgtaatcccagcactttgggaggccgagacgggcggaacacctgaagtcaggagttcaagaccagccttaacatggaggaaccccgtctctactaaaaatacaaaattagccaggcgtggtggtgcaggcctgtaatcccagctactcgggaggctgaggcaggagaattgcttgaacctgggaggtggaggttgcagtgagccgagatcacgccattgcactccatcctgggcaacaagagcgaaactccatctcaaaaaaaaaaaaatctcataatgttttaagaaagtttatggatttgtgttgggccacattcaaagctgtcctaggccacatgtggcttgtgagccgtgagttggacaagcttgattttgagcatttatatttccttttctatgaacgcttcataatctgcctattttttcaaatggaacaataattttttccttattgatttgtaaaagttatttatattttcaggaagtttgtttatggtgggcttgtcttgagtaattaaaaaaattttaatgtaattcaattcagctttcttttaaggcatctgggtttttgtgtgatacttaggaaagctttaattacagggtattacgtacattctcccatgattttttctaataatttgattttttacacataaatctttgctccacctgtaatttatcttgttgtaaccaataagataggaatccaaaataaatttttcttcccagatggtcaccctgatgttcctgatgttccaacaccatttactggttaatccatcttttccctgatgacttgaaaaaccaaaactttatcgtatactaagccactacatggctctgggctttttattctgtccactagtctgtctaatcatgtctggtgtcatgtgttaaactctttaacctctactgttatgtcaaaggtgttacaacagtttttaggctagcattggggatggtgttggtatctggcaaagctaacagagggctatatggagactgaatcattaattctggcctaaataactcttcattcagctcagtgccaactactataaaacaggtcctgatacttttaaggaacactggtctgagatgtctagacaccacatcctgctctcagttaagccccacaaccatcctgtgaggtaatgtgttctttggattcttttagtttcaagaaacagactcactgaggctggttcaaatactaagagatattatactgatatgtgtatatgggagacaagaatctcagccatttcatcagaagccatgtcacaagacctcataggaagatctctcttttatttatttatttatttttattttatgagcttgaatacttgaatatagtttttttgtttgtttgttttttgagatggagtcttcctttgtctcccaggctggagtgcagtggcctgatcttggctcactgcaacttccgcctcctaggttcaagcgattctcctgcctcagccttccgagtagttgggattacaggcacgcaccaccacacccagttaatttttgtatttttagcagagacggagtttcaccatgttggccagcctggtctcgaacttttggcctcaagtgatctgctcgccttggcctcccaaagtgctgggattacaggcataagccaccgccccagccttgaatacagttttgagacagagtctggctctcacccaggctggagtgcagtggtgtgatcacttctctctgcagcctcaacctccctggctcaagtggtcctcccacctcagcctcctgagtagctgggattacaggcatgcaccaccatgtcctgccaatttttgtattttttgtagaaatagggtctccctatgtctcaaactagcctgggctcaagcaatccacctacctcatcctcccaaagtgctgggattgcaggtgtgagccactgcacccagcctgaataaatgtctatttaaagacctacttgaaacatattagaattctagcctatgacaagggctagggagaaaaaagggtacaggtatcagggttgaagggtaaaaagaaaaaaaatgaaaagaaataaactacaaatagaggggccctccctgggcagatgacagtgtgctatgcattaaagaatagtgaaccacttacatctgaggtcttttaaaaaattaaaagtcaaaatgtaaaactccaaatgttgggatatgaaaagagtagtaggaaattagatagaggagagcaaaaatggggcaatacaaggaggagatgtaggaggaggcagatgactgaaggagaaccagcatttcaggtattgtatcagtcaggataaaataggttatactgagttaacaaatgacctcaaatctcagtggcttaaaattaaaagggtttcttgctacttgtccgttgcaggtggatggggactctcttccatgttgtcctcacttagggatccaggatgacaaaggctctctctctgtgcttccacgatagccaaagctcaactttttgtgtgcacttgctcaatttttcattggccaaagcaagtcacatgactttatctaactataaagggatatgattatgcaatcctaccatgaacttagagagaagactagaaatatttggtgaatagaactaatgattactacaggtagtgactatagcttttagggatatgagacatagggtgaattaacctgactttaaatgttaggacagaactctgggatgaagtcatgttggctcagaatcagctgatgtccactgggcagtggttgagtcctggtgacaccagctgtctgcacctgttctataggcatgagttagtcctcaaggccttgccaaaggcttagcaatcagtaacacacacatgcatacacaattcctaggagggcatgtcaaccctgatctttgccctaaaaagctggtctctataattaatgattttgttttcagtctaaagagatagtggataagtaactgttgcagaaaaaaaaaaaaagaacagggacatattgttcttttgggtgtttcagctgatactttaatcttaactccctgggctcccatgtccccttgggataccaaacaatgttgcaaatgggagcagccaaccccacattttccttgctggctaaattctaccaatagtgatgtcatgctttgctctctgataagatttagagaagcaattttgtaatgttctcagactggccaataagtaagtgtctcaaggccattttgagtgacagccttctcgttctgcagaagtataaatattaaataaagaatgttagcctcactgggttctgggatgatagagccatataatctattgtaattaaccaccaatttctaaactgtctgtctgggttaccctgaaggaggcagatgctgaacctcagcaactgtgaagcactgacatgggggacattgctggctgtctactacaccccttcttctctctaaaaaaaaaaccctaatattgtttgggatccatcagatcactaaggggaaggtgaccccatcctcagctctcggggtaggtcctgattagtctaatccagggtgtttcagtctcagcactgttgacattctgagctggataattctttgttgtgggggctatagtaggtattagaggatgtttaatagcatccctgccaggggcatgccctagtgcagtttaacagcccaaaatgcctccagatattgtcaaattgttcctgggagtcaaactcccacccagttgagagccactggtataagcccagcatggtaatccttttcctctttccaggtaactggtttaaaaatgggtatgtgacaatttggctaatgagattaaggggaaagaaagctgctgaggggtttcaggaaacatttttttttttccttataagaaagagactcaggaggagattgtgtccttctctttctctggatcttgttgtttacattcgaaacctggtcacactgcagtcgtcttagcaccggtttgaagatgaagccaactcagagggaggcagagccaagagattctctgagaagcagggccagagccctgatgcaccagcctggagcctggcctggagcctggcccactgctgggcagctttttatctgaaacaacaaatatccttattgttagaggcaaagtgtcctgttacttgcatcagaagtgacattctaactgaagtcattgaaaagaagtgtcacagagagaggtcctgctggagctgccagaaacagggccctggctcattcctgctgggacaagtacctttctaattagaaggaatacattgcccatctgtaaagtgacaggagattaggaaattaacttgggttttggcaagttcataagaaggaaactgagctcccactgtctggaggggagggatgaggcagctacgaagatgagaagcagatgctacttatgcaggaagagatatgggctcagagaaatacaaagggatcaaactagtgcttagggggtggaggactcagatttagatgctaagactgacactaactcaacagatctcccaaactctgaaaccaaaacactcacagtcatgtgagagtcctggtttttaccactggctgcactttggaattgcctggggagctttaaaaatattgatgccttggtcccacccacagagttacttatgtattggactggggtgtggcctggatataatctttttcaatttttaaattataatttttgtggattcagatgtctttactactctcgtcctttctactcaattgtgctgccttcataccagtaggtccttttcttaatttacttcaattttgtgtgtgtgtatgtgaagagataatacttgtgactcatacaaggctatacaataagatctctctcccatgcctgtctcccagtcccctaattcttccacctagaagatagtttatgactatacacaggtatatgtttattttattttcagttactctgtatataccaatgatgacttcctatgcacattgttctacatcccctttttaaacttaactgtattttatagatcattctatattaatattttgagagcttatttttatttaatgtgatggcaagttaattttgtgagtatgctgtaagctacctaaccagtccccacatgatagcatttagcatggtctcagtctttctatggcaaaggatgttgcaatgaataaccttacacagcatgtatgggtgtacctataagaaaaatggaggctgggtgcagtggctcaaccctgtaatcccagcactttgggaggccgaggcaggcggatcacgaggtcaggagatcgagaccatcctggctaacatggttaaaccccatctctactaaaaatataaaaaaattagccaggcgtggtggtgggtgcctgtagtcccagctactcaggagactgaggcaggaggacggtgtgaacccggaaggcggagcttgcagtgagcagagatggcgccactgcactccagcctgggcgacagagcgagactccgtctcaagaaaaaaaaaaaaagaagcttctgaggttcaagtgcacaagagtctacaaaatattctcttatttggctgggtgcggtggctcatgcctgtaatcccagcactttgggacgccgaggcgggtggatcacctgaggtcaggagttcaagaccagcctggccaacctggtgaaaccccatctctactaaaaataaaaattagctgggcgtggtggcacatgcctgtaatcctagctacttgggaggctgaggcagaagaattgcttgaacctggaaggcgaaggttacagtgagctgagatcgccccactacactccagcctgggcaataagagcaaaactctgtctaaaaaaaaaaaagaaaaagaaaaaagaaaaatcggattgctgggttaaaggacaggtgtacttataattgatagtgtcaaactgacctcatggaggctgtgttctcccacctacaatgtattcttcccttataatagtgaacaagacacaatgcttgggaacttaaactgtacaaggaactcagaaggctagaataagtagagaaggttaacagtacttcacgaatttcatttcctcttagggaaatctgtttactttaaagagtgcctctttccctatggtaacgtatgttgtcattatttgatttttgttcagctgatgggcaaaaaatggtatgtcgatatggtttaaatttgcattcatcattattctgggtgatgttaattatcttttcatatatcaaatagacatttgttccttttctgttaactctctaatgtgtcccttacccaagggttggatttctttttcttagtaatttgaaaaagctcttttatacagcaggaaaatgagccttttgcttctgatatatatttttgtctagattgttttttgacattgcttaatagagactcttttgtgggtcttttgtgacaggtttttagtcttagaaatggcttcagcagtctaatatttatttatttatttatttatttttatcaccagtctaatatttaaaaagcaaatgagcaagcttcttgctatggtttgcagaaattttgggggtagtcctacttgtttacttttccataggaacattataatcagcctggtttctttttaagttcattatttttacgtggattgcatttaaaatttacagattaacctaagaggaggtgaaattcatgaagtactgttgggactccctatttgttctagttttcttctgagttcattgcacagtggaagtccccaggaatttaatattttttccactattataatagaagaaaatatgccattaacatcttaaaaaaattttttttaaaagacagggtctcactctatcgcccagtctggtgtgcaagcggctcgatcatagctcactgcagccttgaactcctgggctcaagcgatcctctcagaggcctcagcctctagagtagctgggactgcagatgcacaccgccatgcctggctaatttttaaatttggtgtagagatgggagtattgctatgttgtccaggcttggtcttgaacaattggcctcaagttgtcttcccacctcggccttccaaaatgctgacattataagcatcagcaaccgcacctagccctcattaatatcttttgattattaatttggcatcaggattattaaaagctcttcaggtgattctgatacagtgagtggacaaggagcaggaagggagggataagatgggcgctgtggctcacgcctgtaatcccagcactttgggaggctgaggcggatggatcacaaggctaggagattaagaccatcctggctatcatggtgaaaccccgtctctactaaaaataccaaaaaaaacaaaaaattagccaggcgtggtggcgggtgcctgtagtcccagctactcgcgaggctgaggcaggagaatggcatgaacctgggaggcggagcttgcagtgagctgagatcacaccactgcactccagcctgggcgacagagcgagactcggtctcacaaaaaaaaaaaaaggaagggagggatactctgggtcagctggctgtaattcaggaagaagtattttgtcactgatattgtttaaattgccagcctatggtgataattaaaaaaaccagacagggtaaagattttattattgtttataaattctctgcagcaaggcacccatcattgcctgtacccagggccaaccactcactccccttggtacagcctgttctaaagagcagtcaaggttgaaaagcgttgtcttggagtcttccaactctctcccacgtctctccacactcaatcacttcatgtgtcccgttcaggctacctcttacattttcttcacttctttcccctcttctctgtccttctgccatgagtctagtagaggcctccagcatcttttctcaggactctggtttcactctttactaatctatcttccacattgcttccagcccagatactatgtctttaagcactgatgggattctattacctcccatcctttcagctgagccctgtctacttgcccagcatccttcctgccattccccacgaaattatctctctagaccagagcactgcatttccatttggaacaaaccactctcccatgtacctgagactccacatttgctagtcttgacacctggacttttttttcttctattcttttgagacagagtctccctctgttgcccaggctggaatgcagtggcatgatctcagctcactgcaacttctgcctcctgggctccagcaattctcctgcctcagcctcccgaggagctgggattacaggcacccgccaccatgcccggctaatttttgtatttttagtagagatggggcttcaccatgttggccaggctggtcttgaactcctgacctcaagtgatccagacacctgggcttttaatcactgagttcttatagaataggggactggatattacaagcagtgtgtttaggaaactagattcaggatctactaggtaccaggctctgaactaaagattttgcccattctacatcatgatgtccactgtgctgatgcggaaactagggctcagaaaggcccaagaccacagtgtttccatgccagcctcagcatgccaccatgcccttctcatgcggattgttggaggggtatacctatggctctatgtccattaggatgagaagatcaggcatgacaggcctcacatttgggatggccttggatgggactccctggcaacatttcacagtggccttttccttatcttctgtgacactgacggcatctgtggacaggtgctgggttacaccttgtgtgtggagagcataaataatccagctccgtgtcaattgatttatagtcagatttcctggtgctgatttgcctcctgactacttttcccctgaatttaactccaatccagtacagatgtcttattttttaatctttctgatatatttcagatgtcataaagccagtttgtctaagggcattttaaacttagcacattcagtgactgttgcgagtggtggaggtttgtcaggctttgggactggccagcccctttgaacatctttcttatgttttggaacttttctgcattatggctcctcaccccctgagcccactttcccagattctcttgcagcgagggcatgggaatgtgatccaagctctgccaaccagctgtaaagtgccaatttggaaataaataccataagataggaggtgccatgcagaattccttttatcaagggtgctgagagacagatattcagctgtcaaaggtggctgtggcacctccaggctaaatagcatcccatgttcagtgtcaggagtgtgggcagagatgccagcccagtagccatagcaatagcatctcccctggcagagtttagtggtataactcgagcatcactcttggctcagttagcctctgagcctgatcctctggccctcctgaagagcctgcaagggacttaaatattcttcaataaactcattttctgtataaattagcttgaatgggttttgtttgcaactgtgacagataaagtggggtgttgtgtatctgtgtggcttccacttttctaactgctttccattttctttctttcccaatccctcaaatacatacattataattgaactataaaacatagggcacagtattaaatgtaataggatgcatagactcatgagtatttacatgcagggcaggtccaccctcagtcttaaaattttctacataataccatcgcttatgatatgctgcaaacttgataaatcctaattagaaaaaggaatatttggcagttggaggtcatttggcaaagtggtctcttcccaggatatagctccctggagcctgatggctaggctaaggtcagtcatatgtggaaccagcaccagcagtagccttgtgttaagatcaggaagctgcatttgcatctgtcagaccacccttggccaactctagcctgtggctctgtctcttcctccttcagaactccaccatgtataaagacagatacatatttggctcttaatgataggcttttctattctgtaatatttgtttcatgtgttcgtttatatctctgactaaacagttaatccctcaggtgcaagacccacattttgtgtttctttttgtatttcactttgaggagagtgtcctgaacactgtaagggtttactaatctttgctgattgatttccttcctagggctgtggaatataaattacatgaccatctgtctcttcaattttcaacatctctgtgtgtgcatgtgtgtacatgtgcacgtatgtataagagagatctgagattcaataaataataaacttgaggaatggagttcagaggcagaagaaccacagaaacaagtcagccttatgtgggtagcctcccctccgtttgttgtgtatcaattggggttaataacaattttttttttttgagacctgtctcgctctgtcccctaggctgaagtgcagtggcatgatctctgctcactgcaagctccgcctcccgggttcacgccattctccggcctcagcctcctgagtagctgtgactacaggcgcccaccaccatacccggctattttttctgtatttttagtagagatggggtttcaccgtgttagccaggatggtctcgatctcctgatctcatgatccgcccacctcggcctctcaaagtgctgggattacaggcatgagccactgtgcctggcctataacaatactgattccaaccacctcccaggattactgggaactttgtaagagataacatgtacttaaagttccttatgattattatccggttcacatgaaatgggaccacagaggggagtggagaagaggcattaaaactagtgtgtgaagaaagtatcatagctgacccaaccccactggctttggttctacctgcctggagacaatacattttgtagcaccaggctattgaatttccatccgattctaggcagcaggcatcctcctcttcattttccttcacccaccccagccaaatccatcagttccacctctgacttcacaatacctaaacccataaccttcctccctgccccactctcatcttggcttaggtcctagtcttaccttatagcttctgcctctttctgcctttggtctctgacctctttccctccccatccacatggagggcagttatggccctaaaaaagcaaacgcgattgtataatttcctgctttgagaatcttggggccaggtgtggtgcctcatgtctataatcccagcactttgggaagctgagatgggcgatcacttgaggttaggagtttgagaccagcctggccaacatgtcaaaaccctgtctctactaaaaatataaaaattagctggacatggtggtgagtgcctataatttcagctatttgggaggctgaggcaggagaatcgcttgaacccaggaggcggaggtggcagtgagccgagattgtgccactgcaccccagcctgggcgatagagcaagaccctatctaaaaaaaacaaaaaacaaacaacaaacaaacaaagaatctttgttaaatatctaagtctatatatttatggtgtctatatctgaagagggaagcccagttatgaggctgttccagtcaggtgagagataactgggcatatgatctagggtagacagagaaatgggaaaagatttgggaaataatatataaaactataaactctatgtgtgtgtgtattgttacacaacatgtgaacagtagtcatctctaagattcttctatgaattcattcaataaatgtttattgcatgtctgccatgcgtcaggcaccattttaggcactgcaaacttgaaggaatgacagacacagaccctgctgtcttttagcttatcatctattgaggagaggaagaacatagcgaaaataaataggaaatcaactagggccaagtgatagtgacttggggaactatttgagataaactggtcaaggaaagcctgatgaggtagaaggtggggacttgactctggaggtgggggctaagactcgggaccagactctagattagagttccagatttaacacctagaagtcactgcccctttccatggcaatgactcaacaacccgttaccaacctttttctagaaatttctgtataacctgccccttaatttgcatgttaactaaaagtgggtagaaatatgagtgcagagctgcctctgagctgctactctgggcacacggccttatggggtagccctgctctgcaaagaccagtgcctctgctcctgatgtacactgccacttcaatataagctgctgtctaatgccacctgcttgcccttgaatttttttttttttttgaaatggagtctctttctgttgcccaggctggagtgcagtggcgcgatctcggctcactgcaagctccgcctcccgggttcacgccattctcctgcctcagcctcccgagtagctgggactacaggagcccgccaccacgcctaattttttgtattttttttttttttagtagagatggggtttcaccgtgttagctaggatggtctcgatctcctgacctcgtgatccgtccacctcagcctcccaaagtgctgggattacaggtgtgagccaccgcgcccggcatcccttgaattctttactgggtgaagccaaaaatcttcccaggctaagtccaaattttggggcctgcctgccctgcatcatgaggaggtatctgagtggaacgtcaatgaggaggaagaatgagttggagacaggcctggagaagaatattctagatagaaggaaaaggaagagcaaagacccttgggtgagaaagagtttgtatttttgaggaaagcatgctagtgtgaatgccaagcagtattctgtgggaagatctcaggaggtgtctaagggcatggagataagtggtcagatgcacggtctgttttataggtggaattaactgcttgctgatggattgactggctgtgagggtgagtggcaagaaggaatcgaagacgagttagggtggatggcgatgccatttgctgagacaactgggaaagaaaaagatttgggaaaaaaagttgagttcagctttggacatgttaagtgtgatatgctagtcacttcagtggagatgacaaatggcaagctggagaaataagcctgcaactccaggagaggacctcgctgtagatttactatggtgagtcatcagcatgcatatgatataacagtcatggggctaggaagttagtttctcctcagggagtttgaaactgtaactagttcagagaagagggtggagggcagccccgaataccccagcatttaccaatagagcaaacagggactcaggagcctggggagtgaggttagccagaaaccctcagagtggagcactggtgctcttactgagagaggaaggtgtgtccagatggaggatgtgattaactgtcctcaacatccctgagagaaggagtaagacaagggcagggaagagaagagaatgcaagatttggcaacatgtaggtcattatgatgactatgacaaaagcagtttgagctcaattctgtgtggagtatagggaaggagggttgaggacgtgcatttagaagggtacatagttctcaagaagttttgctgagcacatctgtaatcccagctatttgggacgctgaagtgggaggactgcttgagcccaggagttcaagaccagcctgggcaacatatcgagtccctgctttaaaaaaaaaaaaaaggaagttttgctgagaggctagatggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccac

SEQ ID NO: 25 - DNA, 16527 bp, Homo sapiens
aaaagaccagaatgaaattcttgcactttcttcttaatatctaattatctgctcctccttaataaaacagatcaagtatgttttatgcattgttgccttgatatggtcttagttcagtttaatttttcagtattactttttaactataacaaaagtcctgtgttaaaatggatttttattcctcttttctccatctaaaatgtatccattaaattcaaatgaagtatcaaattgtaaaacattaaattgctcagaacttatgtgagttcttttctatttttcatccacattttagtgtattagagattaagtgaggaggtgctgacaaatcaacggtaataaaaaaaaatcagtaaaccagattttgtggggtgtggagggcatgcagatcaaggcgcaaggtggttgagtttttcatgattcaaaagggaccagtaatagtgtagaagtcaattaccagatcatactttgaactgatgttatattgctatattctaataaaatgtcttatctaaatctttatccttttttacttctcatctatccaactattatgaatattttaatatgttgactaaacaaattggtcataatgatatatagagataaccaattttcaaggaattagattttgaatctacagtaaaagacattggccataaattggaagaaagaagattagcaaataacttgatttatatatacatatatatatgttttgttaattattatttacagtttcccacataatttaatgtttttggattcaccttaaaatatctcatagtggtatttttttaaaaaaaacgaatattaagttaatggttaatctttcaatcaaagatatcttagaatgaataaataattaagataaacaattaactgcaaaaatagttatctttgagtagtaagactatatatgattttccattttcttctttttgctggtctgtattttttatagtaaacagattatttgtagagtgaaaaagatataaacaatcaatataattttacctctttctttggtggggagagaatgaattagaatcagtctctgggccatatcttgtaaatatgaaacatttcagagatcggtagaaagagtgcaggtccctgtgctttaggtcatgggaatgcagtgagaggcatggcttggcctggccttggggatctgaaatcaatggagaactctggaagccctgaatagaacaatgaaacctaaaagtacgaaacctgctgaaaggcaagatggtgggtgagcagtcagggaaccccgtattggaaaatatgcaacttttcatggaagttatgcattaaaatattttttaatataagaaaatgcctccaaagtgtaatcatttgagtggattagtcacctactcagttaaatacaaaaacttgtgtaaggggtcgggtggatctcaacacataatagaccttattccagcccatcctggataccccaaaaccctgacttggtcattacacattctatgtatgtactgatacacattctatgtatgtaccgaacactcacatgtaccccataaatatgtaaaatattatgtatcgataaaattttgaaagcctagcaataaaataaaattcaaataatattcccaagaaacaaataaaacaactatagtaaacttacatatagcaaatatgagctacaatagcattaatctgtaaggcaggtgtttattaacactatctttggacgtcagaataatttagaaaaataaactggactgacaactttatttttctttttagattagacttgataaagtgtcttacatggagtctggctagaggatgtttatatatatgatgtctattatcatatatatggcatcctatcaatattgagattattacacaattggccagggcattactcaggactgtgcattttggagtttgccctgctctggaaattgtaaaatattcatgcatttcctttttaaagcatgcaatagctctctgggctttcaaaccatcagctgcgaagagtcatgttgcataaacacactttcccagagtaatcagactcatcagtaatttgtcttttcatcccaggctttccggaaattctgtcagggagaaaaagttcaagtgcactgtggttttctccctttccaatgtttattttataacatttcttcttttgctttccccttaaaaaatgttttccgttgttcaaaacagattcccactgaaagggggcagaggttcaattttatttaaatctctcctcattcccaatgagcaggggttctctatcttcaagctgacaccccctgtagctctgggcagggtggcttctgttcttgggctctgccgttggtgggagccagctgccagcaacacctgcatctctgctggggtcagcgagctcccagtgcctgagagcttcctcccagggctggacactccctctgcatgcaacaagatgcctacagagctgctgcagagacaggctgggaaggatggcaagggtgagagaagggcacaggggaaccagtggcccttacctgtggttttagggttctgtcttctgtcctccagcccgatgagcagggacagctgctgtgcaggcggactgcctggttggatggccccaaccttctgtgcagctgccagccagctgcgctgcccttgtcagtggcgctataaataaggcacgtctggacattggccaggcctaggagataagaacccagcccctggctcccacgtgccttttaaggtctccagattaaagaagcctcagctcccagatgggaaggggctgccatgtcctcgtttgtcctgcctgcttcaaggacacacgaggcctcatattttccaggaatccaaagggtggctaaactgggaaggccaccagcaccagaaagggacctcactttgtcatacaagaggcagagcctccaacaggctgctcagctccacctctgtgcaccccccagattaggtaactggcatggaggcccaggagtgaaaggacacttcccccaggctacacagcacctctgtgagctgggaaatgtggatttctagtgctgcctttggaacgagctctctagcttacaagggcatttgcttgggtgagaggatgttgggaagatcgaacaatcggcttaataaatgccaggcatttgtgaagccgtggagtggaatacattcgcagaaagttctctccctccctatcctccctgctcatgcatgattataagggtttcttgagccatacactgttttctctatagaattaaaacagtgaaatcttcccagagcatttttaaagccatatgctgggagaggaagagaaactgatttgggggaccaacagctcctgattcttccttaatgtcttacttacgagtatgctgaaaaggcactcacccatggcgagggccaacttcttctgaggactatttggcgacagctgtctgcattaccacaacaattctaagcctgcagatttatcccgaggaaagaatagtggatgtgggcagagatacagctgcaaggacatttctcgaagctctttttatcttggaattaggaaaagttggaaacaacctaaatggctatcaaaagggggctgattaaatgagaaatagtatataaaaaagcagaacagaccaatcacagtggcttatgcctgtaatcccagcattttgagaggctgaggcaggaggatcacttgagccctggagttcaaggctgcagtgagttatgaacgtgtcactgcactccagcctgggcaacaaagcaaggctctgtctctaaaaataaaatcaaaaataaagcaaagcaaaacacgctgcaacctttagaaatgtcaaaggagaatatttaatgatataggaacaatacatataattatagattgataataaaaagcaggtcatggcccacgcctgtaatcctagcactttgggaggccaaggggcgggtgaggggggggcagatcacatgagttcaggagttcgagaccagcctgaccaacatggtgaaaccctgtttctattaaaaatacaaaaaaattagccaggtgtggtagtgggcacctgtaatcccagctacttgggaggctgaggcagcagaatcgcttgaatccaggaggcagaggttgtggtgagccaagatcgcgccattgcactccagcctgggcaacaacagtggtcacccttgagggaaaaaggcatatgtataacatgaagttactacacacaggtaagcacccccctcccacacacacacatacatcctgaaaggatgtgccacaaatgtggaaggtgttgatggctggaggaacggatatagctcattttattttcttctttgtcttatatgcaatctctaaattatttacaataatattgtattcttttataagaaaattaacttcatctaaaatcttagtttccgagactcagaagacagctttctgtgtttctgcactaatgaatctcagtttattttaaggttacagaattccttggggtttccccactctttggaaaaacctatgtaaggcccagaagctctttttcatgccaattccaatgatctgatgtagctggacctgtcaaatcctctaagtgtccctgtcaaggcaaaggcaaggcaagaaaagagaaagaaaagaaaaaaaaacactaagagaaaaagaaggaaacagaaaataaacaatataatatatgtaatcataatgtataattttatcacacaggtcacttttatctgacctaacatgccccaatttatgctccaatcaggacattagaaaggcacttaatgggccttttatttaaaggaggtgcatgttctgatgattattttgttttttaaaaattgtttttaacttaagtaatgacctcctgatctgactgtgtgatatagaggaattcttcttttacttccaactcattttcagtgatatgtatgatggaagaggggacccctctcctgacctggctcctgcagtacagagggtccgaaatcctttaattccctcttctgtctacagacaccagcatggggttgcctcccccatgaataggacctggcctaagacatagcacggggtagtttcaatgcttttgtgttgggtcttactgccagaggagcctctatgacagacacagcccagggcagagcctgcaggctgagccccatcctctggactcttatttgaatttgcagtgccaaagccctgcttggactatccaaagtccctctcaagtaagtgctgactgcctacctcagagactagccagctgaaccatggaatgcatcctacaggtgtccagggaagaggggggcttccagtcttaggtcagcctctggagtagggtagactttctcaagagaaggacaagatcaggaagagatggcactgagagtcctaaggaaggacctctcttggaggaagctgggctggaggacaaggaattggggtgcccaaataaaggacttctgaaaggactcaccagtttgcagggctcatctttgatctctgggaacagccccccaaaatgaaagagaggaaaaacagttttctctctacccttcatgagttcttagctgggatgccctggaacacaagacagatcaacaggagaaaaacaaacaagttgaatattaaatagcgtggataccttgtatatccatgggagttacacagtgagctgagcaaatctctagggtagatccaagagggagttgaaactttgggctgaaatatcattttctgaaacacagaaagaatggcgtgggaaaaccctgttatgggggagaagaatgcccagaaaaagcacagaaaatgaacaaaatggatcatgttaagttggcaccttctccatagatacatctcgaaggatttagtcatccttctcttcctggtgcaggaatggagatttcctttacagatgtaaatcctctttgaaagggtaacttttccagcatatttaggggtggtgtatttggtctctaacaacagcatctgttgggactcaggaaacaatagtctttagtatgatgctttggcaaactggctactcagaaggcctcagccgcagcctcagcagcaaggccctctgaccttttccagccttcctatcttccacctcttttcctcccctgaagctttcaaagaaagcggaatcctcttcccaaggcgagtcatagaaatcagaactctcctgcaaagccagccttaaatcctgaaagtattactctacccttttcctacctttctgggcaagagctggctgtaaagaaattctctgagctgccatgtctgaaagtagatcataagatcttcattccagaaggtctctgctctatagctgggaggaaggattgccacacagagaggccaaaaagaatctgaacagacaggccttgctgagttttcccactcagcctgttagcgttagatcattcccttttcatcatgtttccacgtgactgtccatccctcatcaaatctaagcataataatggacagctttccttgggccttttgggcttcattctgaaggctcccatgtcacataaagctttgatgaaataaattttttttctcgaaaggtctgtttctgtcactcagactggagtgcaatggcattatcacaactcacaaaatgctgtctcaaactcctgggctcaggcagtcctcctgccttagcctcctgagtagctggaaccacaggcatgcaccaccatgcctggctaatttttattttttattttttggtagagacagtggtcttgctatgttgcccaggctggcctccaactcctgtgttcaagtgatcctcttgcctcagcctcccaaagtgctgagattatagatgtgagccatcgcaccaagcttattatgcttttctcttgttggtctgtcttttgttagagaagtgttggctgtgaccctgctgaaggcaaggaaaggtattgtacgcttctgcctctatgcagccctgtttgacattcttcctgctccacactgactcactctcacagtcttggggatgggtgagatgtgagggagggtgcctgcctgacattcactacctacagcagacactgtgggaaggagccatatctacagggagcgccgtggccaggacttggggctgtggtcaggactgggcgtgccaaggagaggaactgcccatgaatgtggcacttgcctgtcttttatggtatcataggggaaaggtggacagatactttttggtcatgttttcaaaaacttggagaccaaaactacaaaacagataggtctgaaacaagcattttttattcaattcgggaaatatgtactgagcctccactaggaaccagacactggcaggcacaaggatcgacaggatggagactcacagatggccatgagctcctccagtttatccccagctaccagcctgggtgagggcaccccaccgtgggcagagtctcctgcaaaatctcagcacccccaggccaatgcactaaggcattttgcctgtgggacataaaatcttcttgttcatccatcagtgctattcattcattttttccaagaactgtccatggagcttcctccatgtgccaagcattgtgctaggtcttggagcctcagccctgaacataagagaagaacctcagctcaaggagcttgcaatgaactaactgtgcactgttgtcacagcctgaggctctcaccttgaacctggagcacctttcccttatagtcactgtaggtgccatttaccactgttgccaccaccctcatctttgagggagtcgctgtcactacagcttcttgctcaggggtgggcagccttaatctttctgtgaacctggttctgtggctcctggagcctgccagagctgagctttgtacgtaggatggtacaaagctcagccacctgagtgccgcacaggccactgctgtaagcctagtgctgctgagcctgctggggggtgtttgtgcttcttatctgtcacaagggccagccaggcccacgtttccctccatttcctctatcccacccagcttgactgctgctgggactgcctttccctcctctccctccctgagctgagaagccatggggttgggggtaatgcacctggcccctggctggagggagctgggtctctttcaccatgggcaggcttttccctgctggcttggtggtttgcatgtcagaggaagacagctagccaaggagccagagaaggatagcagagaggtaagaggagaagcacttagttctggggcagagagaatagggttttaggagggagtgcgtggaccgataccattttttgtaagctgaaaagagtgtagaccaaggaaagtgttgtttttctggactggaaagtcctcagatgcagaaccagtgtgtgttggggtgcagaggatgagtggtttgtgaaccgcgttgcctaccaagcgcctgtctgcagaatctggaaggacaagcccagcctcattttcaagtgaatacctttcattgcctaaccactccatttgctattcctgaaacctctacataaacattccttctgcacttcccagaacaataaacaggcaggaacggctgcataaatgtccagtaagtgtaaatacatttatgatcagctctgggaagtttcaacctgaaaaatagcaccaccatttgctggtgtacagaatccaggcacctcttatttttgaacttgtcttatgctgacctagtctgggtgttgaaatgaaccatgttatcctatcagaaaattgacccaataataatctcagtatgatgttaaggagttcgggccataacctggaaagatacagtcccaaagcccatagccctgaatgttgaattcccaaaagacccaaatccccaaagtttaaatccctaaaatctcaatccttaaagatcaaaatctccaaaatataactccagaaaaaataatggaaaattctttacaagacatttgtttacatttttaaaaggggacttattagagaaacatcaaaaaaatgacagaccacttcataggccactaaatacaataaaataggcaataataacatacatctttttacaagcataaccactctaggtatactaatgatagtcgcacaggtataacagttatgagcaggtgatccagattgctaactgtggtcttgtgaactaccatcatggacaacctgccttttgatgagactgatcaaaaactacatgatgccaggcgccgtggctcatgcctgtaatcccaggactttgggaggccaaggcgggcggatcatgaggtcaggagttcaagacaagcctgaccaacatggtgaaacctggtctctactaaaaaaaatacaaaaattagccaggcgtggtggcggacacctgtaatcccagctacttgggaggctgaggcaggagaatcacctgaacccaggaggtggtagaggttgcagtgagccaggattgcaccactacactccagcctgggtgacagagtaagactctgtctcaaaaaaacaaaaaaacagaagaaaacaaaacaaaactacatgatggtcactaccacatatgcagtcaccaaaagaatcaagaccttgagaaactttgtctttcacaaacccggatatagaaaaaggacatgtcttcacttaatgagaatgtacacacataatgcttacatacaaaataacgttgtgataatgcactttcatggagtcaaatttgcaaaaaaaaaaaaaaatgcgtaaaacaaattagaactctctcaaagtctttacacgatttaaacctccagtatggcaatgatgcaataatgaaatacatagcagagagaattgtaaaaaataatgctgacagtttaaaatagtgggaaacaaatttaaaaagaaccctcccccaaataaactaaaaagaaaattcagcatgtgaaaaagtgtattacagggatggattatgggcgattgcacagagatagttcacaaaagctggctgactttcactatcattaattttattttaaagtcttacatcacaaattttcttttaggacatggccctcctcagagaatacattcacctccattttctatatgatgctgttcttttcgaaattcttctaggagtccgtgtacactgacatgagcattccttgttaaattttcccatcttctgtgccatgcgtctaagttgctttgggtacagtgaaatccattctgcacgcacgcctatacagaccacaaatttggcagaaacaacactgttgatcaaacagcaacagcgctgtgtgtcactttgttttaaacattagggttctaggatttaggaattttgatctttagggatttcagcatctgggattacagcgttcaggactgtaatgctttccaggactatgatcagcacctcatgttacgctattatatcttcagcaagaaagtaagcatgcttactgtatgctgaggactgggctgggcttttcaaacatccgctaaattcaggacttcactctgtctcaagtcacatgctaaaaatatacacaaaaaatggaacacaacagtataccaacaggtcagtatcactctgcacattccggatactgtgtacccttgttttgtctccctcaaatttctctctcaaatttatgcgtagagtcttcatccacaccaactgacattatcgatgacagctggtgaccccttggctaaacttatttgtactctagcagcgatcaacaccctcaattagagggacgaaacatgaaccggtgacatgccaagcctcaaataggagctgagggagagcatagagtggaccaaatgccttgctagcccctgagtttatataggaagccactcccagatgtgccctgtcaattactgtaaataatgggctgtaatctggtcaacaagactctaattctagagccatttacaaccaccatgtggcggatcattggaaaagctggggtggaaggggccctgggcaactctgctgctcccccacacacccttgctgtgtgccagggtggttgatgtgaacaagcatcaaaggcctcctttgctgtctggcttctggttgggtttagtcattgggtagaaccagccagagaccaaacacaggagaagagtgaggtcaggtcctcaggtgcccaggtcttccctggataccagttcaggacaaaaccacaaggtaaatagacatttttgaaattaaaaatgtattattgtggtaaacataaaattgaccattttaaccatttaaaatatacagttcagtgacattaagtatattcaaattgctgtgcaactgtcaccaccatctatctccagaactcttttcacttgccccaactaaagctaaaatgctgtccccattaaacagctctccactccctgtccccccaaacccagcacctggtgacccccactctaatttctgttcccataaacttgatcactctagatatcccctctaagtggcatcatacagaatttgatccttctgtgactggcttattttattaagtatacagccctcaaggttcatccatgttgcagcatgtggcagaatctccttcctttttcaggatgaataatactccattatatggatagaccacaacattttgtttattcttttacctgtggatggacacctgcattgtacaaggtcaatatttgctttcttcattaaatcaccaaatacccttcagaataacttcgcacagacataacttaagcatcagaaaaattcagcctgtgtgactcagttaggagaaatgtcagaagagtgggtgtttcatgaagcaggtgcgtatcccagcctagaaatgtaagtttgcaggaaaggtcactctctttatttccttagttgtccaacaccattttgggaacataagccaggctgttaaaagatgcaacgtgggaggcactatggctaagactctgcctgagtatgcggctggaaggggggttgagacagttattttcttcaatcctgtggacatgcagtggttcccagtggacagaggcacacgtctcactgtcagggagccatggagtagcctcagctgcccacatcatgtggactgtgttggagcctggagaaggaaggctgggaccctagcttgggcctttgccttgggtccacttctcagcccttctcctgcctgctctgctccaggttgccagagcacattgccctggagcctcctttctcagcttctggggcttagctgggtggtcccctctctgtgcctatgttggtgtctctggcacagctgtggcccctgccatggtttgagcttcctttgggtgaccccgggccactggcagtggcttttcctcactctcccaattcagcctctcaacacccccatcatccacgcacccggttcctagcataaattccctctgttgaaattgtttgatgtagattctgtttccctatttagacctttttttttttagatggcatttcgctcttgttgcccaggctggagtgcaatggcgcgatctctgcctcccaggttcagacgattctcctgcctcagcctcctgagtaggtgggattacaggcacctgccacctttttttgtattttttgtagagacagggtttcaccatcttggccaggctgttcttgaactcctgacctgaggtgatccacccgcttcagccgcccaaagtgctgggattacaggtgtgagccactgtgtgcggccctattgagaccttttaaaccatttctggaggttgacagattttatgtaaattaaagtgtcattttatatgaagttctgaacaaattaactagaaatataatcccatcctcagaggctctctattttatattttcatgttaaagtgagctcagtgtcctctaagatcagtaaagcgacgctttgagaaggggaattccttaaccagcctaaatcagtgaataggattttgcagagggaattagctaaatacattccaaattagggaagaagggattttgacagctagaaaatgggaaagtccggactgcaaagggtaccagcaaagcagacatggaaaatggagcataaatacactagcctttcgtttaattaatcactttgatgagtatttaattagaagaaaaatctattgtgttagaggagaaaatgtcttaaatttagttagtagtaataaaatggattaaatcagtgagctcatgggactgtgtatccaacagcaggagagccaagagatgggctgggcagctgagggtgtaacagagccctgcccaagtgcctgttcacgtagggcaaggttgggaggggcaggactgcagcacccagtccagtgcccaaagcttccttccatgcacccagggccccaggcacgtaaggcagagtgaactcatgaacacctgttgatttacagcactattacccacttgagccagagatacaacagatgttgagcacccaagacttcctgagcacagaggctcggtgcattatcagctactctgccctttacagtatcacagtgaggtcatcaacaagcaaaggaggttgacattgatgaggggtggagcagcacttggtattatggctagtgctggctcggtagaagacctgtggagaaacttacaaacaaaggatgggctcttttgggcatgtctcacattgtaagtggaacacatttcaccaaaggagtgagttccacttagagtatagaaactccaagtgagccaaagaatggggaggtgggccatgcacgcacaccattatagtgggaggaagtggggtatgtttagcttagaaaagctgctcagatggctctaatgaatccctgcctccacctccaacctctctgagagttaccctcaaagatatttgcaacaatcctctcttaatggcatacgaagaaactagagatcagaatcatttgtgtttgttcctttatcatggtttaccatagatacattatttaagccttaggtgatccaacaataatgtattttgagtttcattcagtcatacattcattcaacaaacccctacagactaccacttaagtgacaggtgctagtgcacacaaccttgcgtattcatttcacactaccttaatgtaatggcttcttattaccttaaaaacccaatgcatctgccatattaagaagagatgtccaaataaaatccatgtttaatgattcattcttgatcccctaattgaattttttttttcttagacggagttttgctcttgttgcccaggctggagtgcagtggcgcaatcttacctcactgtaacctccgcctcctgggttcaagtgattctcctgcctcagcctcccaagtagctgggattacaggcatgcgccaccatgcctggctaatcctttgtatttagtagagaggggttttcaccatgtcagtcaggctggtctcgagttcctgacctcaggtgatcctcctgcctcggcatcccaaagtgctgggattacaggcgtgaaccaccgcatctggcccccgaatttactttcaattagtccctgttttgtctttagccactcttcagctttgtgtaattagagttaaaagtttgagtctggtacagtttgaaaactcttgtctcctgtagaagaaattcctaagaaacaaaacaaacaaacaaaaatcactctgagctttaaagtcccacgaggggttaactttgcagactgcagtcactggcattagcttgcgctcagtacgtgggcaccgttgaagacatgtggacccaggtgtcttggaagcacagccacacagctgctgctgtgttaactgatgtgtatcttctgtgatcatgtcgaagttactcctggcacctaactggtaacccaacccctggcaccgggctggcccagtgctgatggagagcttctataactacagtgggagggatgggttggttttgatcatcttggcactataaagagaatttaggaaagggggtagaaactggctctgtaggcaaagagtagggtgagtgttaacaagcagaacacataggatttttgaacttggaagctggatgtccccctaattgtcagatgctgaaacttacccaacggaatattttcagaagccttagataagggaaggcatcgataatagcaactatgcaggaagacattgaattggactacctgaacagtaaatggcataacataacacataacacacaagggttaaaaagcaaacacaaactggagaaaatattataatatatatgatgaagtattaatattactaatacaaagtttttatacattaatataacaaaagtaatcaatccaatagaaaatttggtcaagtacataaagctgttaatttaccaagcaacaacaaaagacgccattgaccttatgaaaaatgtgcctaacctcactagttataaagaagtgcaggccaagcacggtagctcacacctgtaatcccagcactttgggatgccaaggtgggcagatcacttgagctcagaagtttgagaccagcctgggcaacatggtgaaatcccatttctacaaaaaatacaaaaattatccaggagtggtggtggactcctgaggtcccagctactggaaaggctgaggtgggaggattgctggagcccaggaggtaaaagctgcagagagccatgattgtgtcactgcactctagcctgggccacagaggagaaagtctcaaaaaaaaaaaaaaaaaaatgtgcaaagtgaaaaaaccccagcaatatcaagataccactttttcctaccacactggtaaaaattagaaattggcagaggccaatgcaggtgccgctggaggcaaacagcaactctggtgtactgctggtgtgagtataaggtcagatttctggagggcaagtgtgatagttaattttgtgtcaacttaactagggcataaggcatccagacatttggtcaaacagtactgtgggtgcttctgtgagggagattttggatgagattagtatttgaatcagtggacagagtaaagaagaatgccttccatgggtgggcctcgtccaaatagttgaaggcgtgaaaagaacaaaaggctggccttaccccaagtaggagagaatccttctccctggtggtcttcatcagccatgaatcattgggtcttcttggctgtacagcagactgttggtttttgaactagaactagacatcagctatgcagattttaaacttagcagccttcataactgcatgagtcaattccttataagtctctctgtcgttttttgtatacgtaggtaaatagatctatcctttttcccttgctctctttttctccatatacatatttatatatgtgtgtatatacatatatgtgtgtatatatatatacatatatatgcacacaaatctagaggtctctaagagcagtttaacaatgtttgttaaaatttaaaataagcatgccatttgatgtagaaattccatatctagaactctggtctaagaatatgtttgatag

SEQ ID NO: 26 - DNA, 27902 bp, Homo sapiens
tccaacagtttgttaacttagatttcaacctgaaaccacaagtctaaagtaactatgcaattacacaccagagtctaggtcccaaatctctaatgtattatctgcagaaaattccaaatgtgcagacttcttaacactgagacattaacacctaaattttcctgaacccatgcaaatccttctgagattggcatgtgtgtgcctaccgggaagggcagttgctatcccagttgcctgcagaacttgttggcagtttcactcacctaaggaataatctaaaagtcttaatcagtaattgtagctggttcaagcaaatggacttacacaaaatagtatttacataaatgcaagcccaagtttctcattacgttttttaaaaagcctttattttgatgtttcatatcaatttcacctttaatgcctcccaatacctttaaaattatttttatcatagttaaatgtatacagaaaggtaatgtgatgatttttttcactaagtccgtactttattccattgtgcaaaaaaaaaaaattattattttctatgcattccatgatgtgtaaaaagattgggtagtaaaatataagaaggttctactgtgccaggctcttggtccacatttccttatttaattctcacaacagaaggcaaaaaggtgagtgaatggcccaggacaagtctctgactcctaaccagctggctctcaagagatacttgccaaaggaagaaatggcctatgtataccattcacactttagtatgaatttattcctacagtattatttccactctgcatctgaaatgaaagacaagtgtttcatgtaagctgcaccagtaagagatgcctaagaggctggctggtttttgctgtgcaagtggttcgacgtggggctgcagaatactctggcctaattcagagctgagaacacagacaccgtgggcccaggagtccacctgccttgagtgttgtgactgcacttgggcaggagtggagccaaaaaataaaaacagaagcagccttggcacatagtagaaccttcttatattttatttacttcccaaccttttacatgtcatgaaatgcatagaatacaatacaatttttttttttttttttttttttttttttttttttttggcagagagtggttccccaaggtggatgctattcggggaaatcttgctgatcttgccctcttcccaaatgcatgggaaatattacccatttgtcacacaagctgtctgaggacgcagtagcctgtgaggtcaggggaagagccctggctcctctgaaccttcctcttggtagcacaggccatggcacttcggcatgtcagatctaagccagaatgcaacctcctcagtcacccaccctgtgagctgtgggctggcagcctgacctctctgagcccaggcgggtgaggaaccctgcccaggtccgtgggggggtggaaggaccagatgtcacgtgcctggcacatcctgagtcccacttcatgtcctttccctcaccctccgtgttccctcagctgagctgggcccaaatcttcatcccagggaaatgggacccagtgaccaactgggctgtgctactgcaggcacctttgaaatgagcccaggggaagcagtaagaaagcagcaggctatgcttggagaagcgcccgtcctgtccaccatcgctccacctttctccatcactccttacctgacctaccccaacacaggtggccagaggcaggagggctccccaacagctcctacaggtgttccctgcagcttccagccaattctcacagagcgacagctgttcttctggcctttgcttggggtctgagcccaagcacatgtatccacatgtgcgagttcaggctgagctcccacggtgggcagcaccttttgtgtgtgtgcctgtgcatgtgtgcacacatatgtgtgaactgtgcaggctgtaatttccaaaaccaaatttggctttttttgatttgtaagttatttacatcaacgaattttaaagaagcataaaatgaaattaagttaaagttttagtggatcacctctgaaaaagaaaaactttcattctgtgaaattggatttctagaaaattccaggattccccacagttaaaggcacaaggcagggacaaattctggccatgtcacatgcagggggcatgggtagtaagagtgggaaatggggttcggggctcagttccccagcaccttgctcttcctttttctgactctcctggtttgtcttttctggtgtctgtgagcccctcaagggcagaggccatttctcattcatcctagcatccagtacccagggcccagcctgtcatgaggaggtgcccagcaatctgagcgtatttaagactgggtcctgattctgtcttttgtcccctccttgggttcccaaactctctgtattctgctccttcacatttaaattgacccccaaacaggatctcccagcctccttggagatgtgggctccatgcagggatgacagaggctggggtctggagccttcccccagtgccaccgagctggagcctgctgagtttgcaagtcatcacggagaatcctcggctccttcggagataccacccctgggcctactctgggttctgagatggcagccctagtgccaacctcatccagaagtcatcactccctgggggactgtgagggtgtcatcgaatatctgccaatctgctgacaagtagacatcccaatggccatggagaaaacatccgtgcaagggctttgatcctccgaggctccatgagaacactgctattataatagttactaagcctaataaaaagtataatgatagaatatatatcacgatgttgacccaaaatggcaatgtttagttcttagggaattcaaagtacacaaagtccttgagaaggacacagctctcaaagagactcaggtcacctccctgcagtcgtcaccctccccggtagccagtgcaggcacaaggatctgccactccctgcttaaaccctacccccttccagagctccccattccctgtgggaagtcacaggaacacccaatccttgtgagccagaccttggcccagactctcgccagtcaccagccagctggctgctgctgttccggtgcccttcctcatgctgttcccagcggactctccccacaggctgcccttcatcctccagagctccaccagggtgatcgtagaccagaagggtccaggtgcttgaccagcaatcattctagtaacttttgggaggtcacactttctaggaggcctctagtaagtccctcccctccacttccagctggggccggtgacccctcaccctaagacgtgaggcctctagatctgtcttattctgctcccagccttccaggttctggagagcaggaggccctggcccaggaacaggcacccagcagatgctcagcagccatgtgtgcaacagaactaaatcttccagctttggctgaaagcaaacatcatggctgtctcagcaggcacgtgctcccagggttgtgtccttcctggaagatctcagcttctcccacatctgtgtctcctgaatccacaccaaaggagcctcgttcagaagggaccccaggacagggcacggacacctgtaatcccagcactttgagtggccaaggcaggcagatggttgagcccaggagtttgagactagcctgggcaacatggccaaatctgtctccacaaaaaacgaaaaattagcaaggtgggtggtgcacacctgtagtcccaactacttgggaggctgaggtgggaggatcgcttgagcctcacaggccaaggctgcagtgagctatgatctagccactgcacaccagccgctgcaacagagtgagaccctgtctgaaaaaataaataaataaaaaataaaaggaaggagccctgggtttgattcgggcctcacgatgtgccctctcactgcacgaaagtggcccaggggcacactctgcccctctctaggaggtggtagtgacctgggagggccttggagcggatctttgtgtccctcagtacatggagaagtaaactgaggcacagagagacgggcatgtgtcccagatggtgggagccagtgctcgctggggcagcccctccttggacccagcggcagaatttcagcagcaggtggggccaaataatcgggtccagggtgagagaaacacctgtgtaaatttgtcttatagggccctggagaggaagggtaggagctggggcaggtcaaggtgcccctggaagcttctagagacctggatacacaccagacagcagcggctgatgaaggaaacaggtgggcttttaacaaagtgtggacagtcacgattctttccctgtagccctgggaccccaatgtccttagccacggtccctcagctgccccgggagccgccagcatgagccggtgtcccgttttagcgcaggcgtgccctgggacactgcgggcgcccagtgacccgactgagcaaaaaggggcttcaagtggaagcccctcttccaggcacctccgtgtcactcctgcgcctgcatagggtgccttcccggtaagatcctgagagtttgcacgggccggtccgggctcccggctctgcccacctgatgtcactcgaggactgcccctcccggccttcgcgcggagcgcgggcgccacccagtggtgcattcgagtaaccgaacccagctctcagccagatccccgcctccagcgggctccccagttattttctcttaaaaagggccttaactctatgttgaataggagtggtgagagagggcatccctgtcttgtgccagttttcaaagggaatgcttccagtttttgcccattcagtatgatattggctgtgggtttgtcgtagacagctcttattattttgagatacgtcccatcaatacctaatttattgagagtttttaacatgaagggatgttgaattttgtcaaaggccttttctgcatctattgagataatcatatctcaatatggtttttgtctttggttctgtttgtatgctggattacatttattgatttgcgtatactgaaccagccttgcttcccagggacgaagcccacttgatcatggtggataagctttttgatgtactgctggattcggtttgccagtattttatcgaggatttttgcatcaatgttcatcaaggatattggtctaaaattctcttttttggttgtgtctctgcccgcctttggtatcaggatgatgctggcctcataaaatgagttagagaggattccctctttttctattgattggaatagtttcagaaggaatggtaccagttcctctttgtacctctggtagaattcggctgtgaatctgtctggtcctggactctttttggttggtaagctattgattattgcctcaatttcagagcctgttattggtctattcagagattcaacttcttcctggtttagtcttgggagggtgtatgtgtcgaggaatttatccgtttcttctagattttctagtttatttgcgtagaggtgtttgtagtattctcttatggtagtttgtatttctgtgggatcagtggtgatgtcccctttatcattttttattgcatctatttgattcttctctcttttcttctttattagtcttgctagtggtctatcaattttgttgatcctttcaaaaaaccagctcctggattcattaattttttgaagggttgtgtctctatttccttcagttctgctctgattttagttatttcttgccttctgctagcttttgaatgtgtttgctcttgcttttctagttcttttaattgtgaagttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttacttacccagtagtcattcaggagcaggttgttcagttgccatgtagttgagcggttttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccacttggtgcagagctgagttcaattcctgggtatccttgtgaactttctgtctcattgatctgtctaatgttgacagtggggtgttaaagtctcccattattattgtgtgggaggctaagtctctttgtaggccactcaggacttgctttatgaatctgggtggaagttctggccagggaaattaggcaggagaaggaaataaagggtattcaattaggaaaagaggaagtcaagttgtccctgtttgcagatgacatgattgtatatctagaaaaccccattgtctcagtccaaaatctccttaagctgataagcaacttcagcaaagtctcaggatacaaaatcaatgtacaaaaatcacaagcattcttatacaccaataacagacaaacagagagccaaatcatgagtaaactcccattcacaattgcttcaaagagaataaaatacctaggaatccaacttacaagggacgtgaaggacctcttcaaggagaactacaaaccactgctcagtgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcatgctacgtgacttcaaactatactacaaggctacagtaaccaaaacagcatggtactggtaccaaaacagagatatagatcaatggaatagaacagagccctcagaaataacgccacatatctacaactatctgatctttgacaaacctgagaaaaacaagcaatggggaaaggattccctatttaataaatggtgctgggaaaactgactagccatatgtagaaagctgaaactggatcccttccttacaccttatacaaaaattaattcaagatggtttaaagacttaaatgttagacctaaaaccataaaaaccctagaagataacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcgacctacaagatgggagaaaattttcgcaacctactcatctgacaaagggctaatatccagaatctacaaagaactcaaacaaatttacaagaaaaaaacaaacaaccccatcaaaaagtgggcaaaggacatgaacagacacttctcaaaagaagacatttatgcagccaaaagacacatgaaaaaatgctcaccatcactggccatcagagaaatgcaagtcaaaaccgcaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgagtatatacccaaaggactataaatcatgctgctataaagacacatgcacacgtatgtttattgcagctctattcacaatagcaaagacttggaaccaatccaaatgtccaacaatgatagactggattaagaaaatgtggcatgtatacaccatggaatactatgcaaccatgaaaaatgatgagttcatgtcctttgtagggacatggatgaaattggaaatcatcattctcagtaaactatcacaagaacaaaaaaccaaacactgcatattctcactcataggtgggaactgaacaatgagaacacatggacacaggaaggggaacatcacactctggggactgttgtggggtgggggaagggggagggattgcattaggagatatacctaatgctaaatgaggagttaatgggtgcagcacaccagcatggcacatgtatacatatgtaactaacctgcacattgtgcacatgtaccctaaaacttaaagtacaataataataaaatttaaaaaaagggccttaactctgcagtgagtaatagctccacgatcttaatgtaaaagcggcaggattgtttcctctcatggctgagggaatgtcaccgggtaggttcctgccaggtgtgatgatgcaaatcagtaatgatccttcataggctttcaaacctacttcaggcatacttgcacatgtacctctcacctgcaccttggcataaccttaccgtcttggacagcttgggccatcataacaaaacaccagatgacttaaacaacaacattttatttctcacagttctgcaggctagaagtccaggatcaaagtgccaggggattccattcctggtgagggctctgtccctggcttgcaggtggcagccttgtcactgtgtcctcacatggcagagagtgcgagttctcttccttttcttttaaggacactggccctattgaatgagggtcccatcattatgacctcacttaaacttaattgtctcctaaaaactctgtctccaaatacagttgcattgggggttagggcttcaacatatgaatttgggggctggcggcggggacacaattcagtccataacccccaccttgacataactacaacttaacatgatggcgccttgacataactacctcttgccatatctaaaccttgaagtgaatgcaccttgatgttgctacaccttgttgtaattacacctaacctaactgcaccttgacttaacctaaccttggaataaccccttgacaggatggcattagccaccctgatgtaactacaccttgacatacggtgtaggaatccttacgcatcccaatttatgaacaaaaatttgagtctttcagcagtggcatgactttcctgagttggcaaagccagaaagaagcacaaggggcctccttcatgttctccttcctgcttccctgatctctaaatttggagcctgggtcaggtagcttgtgggagttgaccctgagagagtcattccccatgctcccttcttcctaaaagtgacagcatgtttctgagatgtgaatcctgtctccttcctactgctgctctcaatgcttcacttctgataccagaagtgcgggcattttccccacaccaaccacttctccaattcttggaacaccaattaggtgtcctataatttaactcagttctgatactatctacctggagttagcatcagatcccacacattacaggctcagtcccacaagaccactcccatttcagatgccaaattctagtccaggttggcacctgtgcttctgaccaactataaacttgaggtttccacaaccccctctttatactggatagtttgctagaatggcccagagaactcatgggaacagtttagttataaatgatacaactcagggatgcaaagacataagaatgacgggtgcatcaaaatctcagaactcaccgctatagcacttgtccacgcatccaaatgctgcctgctccccctagactactgacataataataataaaaaggataaaactcagggacagccagtggaagagatgtatggagccaggtatggggaaggggcatggagcttgcatgccctctccagacacaccaccttcccatcacctccacatgttcaccaacccggaagctctcccaacaccatcactttggaggtgttcatcatgttggcatttttcaatggaggcttcattttgtaggcatgattgattaaatcactggccactggtgattaactccatccccagctcctctcccaaaccagaagtcggcagtcagtagggctgagtatttcaaccgtctaatcacacagttggtttccctcacaaccagcaccatcccgaggccacccaggagcccccaccctcctagtcatctcgttagttacaaaaagccatatatcactttggagatcccaagggttttaggagctccatttcttattatatgtcacaatgtcagtcttcacataagaagcaaaggcagaggaaggagatgccctgagcagagctgctccagccagctccagcttcctccagggggaaagtgaagacccctgctccatctcactcaaaggccacagttgctactcctggcccccaaatcctgctgcttctccagttcagctctggcatttttaaagccattgttctagcagttccctcagaacaggtcctcacacacaggtccttggggctctgggggcacttaacacatttttatcagcactatgaagaaagaaaagaacttttacctgaggtatgagagtccatttaaattatcaggcccagagagacaataaaatgagatagtaatcaaccttgagctacgtattcagctcttgaaactgcttgccaaggataaggagccataaattaacctaataaagccacaccaggcactaaaccacgcagtatggcctcacaatgtagagccaatcatgaatcaatgttatttctttcttttttttttttttttgcggtggagtttcactctttcacccaggctggagtgcagtggcgcaatcttggcttactgcaacctctgcctccctggttcaagtgattctcctgcctcagcctcctgagtagctgggaaaggcaccaccaccacgccctgctaattttttgtagttttagtagagacaggatttcggcatgttggccaggctggtctcaaactcctgacctcaagtgatccgcccgactcggcctcccaaagtgctggcattacaggtgtgagccaccgtactcagcctcaaggttatttctataaactaatgagaattcctgatggatttatatcggcccacttgttgtccccgcttttgcctttaaaaaacttcttataacaaagacccaatgaagctcatttccaagcttacttgggtctgagtcttccaggcagctgtccttactttggctcaagtaaactctttatattttacgcctcaaactcttccttttaagtcaacacctactagtgctgggcccagagccaggggtggcctggaatcaagctgggcccttcctcagctggccagccttccctacagccaagacatccttggctgtgcatgattcatggccctgtagggccaccaaagctggaccgggtcctggcagtggcaggccagtctcttcctctttgtacagatgggaagctagagtgaaagaaactaattcaccatagtgcaggccaaggagaaaaggaaagaagcagagaacatcccttttcccctgagatgtagacagtgggttgggggtgaggactaggagggcttaagagccagccatgtcatccgtccctgtagcccggctgtggctcttgcaagtccccattcctgtgaacagtgtgagcagagcactcagagctgaggttggtggggtcaggggtgggtgctgggcatagggaagggcaaagatgataaaaacatccaagaaccaaattcctgctcatggaatctcatagtcttgtgagggagaccagcactgcatgagtgggtaacgcagcacagcacagcacagcacagcacagcacgcaacccgggtgcagaggtgtccaaggagccaatgattgattaactgcacagaagggctgggggcgttgaggaagactttgagattaaaagataacaagagtttttcatatagacaagaagagggcttcatgttcccagggagagggaatagaatgtccaccgtgtgcacggacgcaacagcagggctgagctggctgcagctgccatgctgacactggaccatcagggctgggcgatgcgggtagcaagagctgcagctggacataaggcaaggtcatacctgtcattaaggcatgggaggtcattttccaaaaggttcgaactttatcctgagggcagggaagaattgggggccagagatgggcagaatctgaccatggctgagagactggcccaagtctttggagatgctgcctgactctgggatgtaggttctgcagtatccagtggtgaaggtgtgggcaggctgggaggtaggaggaagaagaccaattccaggtccattctggaggtagagtctctggatcaggcctgagggaggaccatgctttggagggaaggccctggtgggcctttggaggaagtggaaggtgggaaagagtacttctaccaggctgcagtgcattcagctgcatgtatcgtgagctgaccacggtgggaaacggattttgtcatcttggacttcttacaaagttcaagcaaagaggtggctggtgttggtcgaacagctgccagcatctgggattctatttttgccatctctttggccatgaagtccttgtccaaggcaggaagaggaggtggcagtgtagtggatgtggtggtatcctgcccaggtcacctgttcaagccaaggcattccctacagctgctggggagagcagctgctacagatgccttcacccctgcctgggaactacctaccggctgacgtgagagacaaaggctctgcccactttactcaaggcagggcagctgcagggccaaccagctccagaactccctgcagtgtcagccacagcctcagttgcaacctcattgccagccagcttttcccactgccccctcatttgtcccaggtgcatcttccaaaagcccccgcagtaaacttcctgcatgcacagggctctccgtctcagactttctgtccccagaaagtcagtctaagccccgtatcaggaaagcaaccccagccctggagcagaccttggcttctgtctcagtggccagaattgagccctggctgccagggagcccaggcacagtataatctcaggagtgtgctagcaaaggagaaggcaggaatgggtgtccggggcactgactgtcacagaagtttcagacacttaaaaccacacatttaatttatcaaatcacctgagaagacagaatgcaccgggacagttaatgttcctgggatgatgttttgcatgttccgataagctgggtctgtcctttaaaaacttcttatggctaaaggttgagatgaggaagaaaaggtggagaaatacagaggttggcatttaagaaggcataatctaagtgttgactgccatgtgttctggatgtgaaatctggactgtttcctcatctgtcagttgaggacatgatgcctctaaggagtcgccatgacccagcaagggaggcccttcaggggatggagatcctagatgtggactcagaaaccagtgtgtttcctggaccctcctggcaggtaagttagaacagaagaggcatctacgtggtgccttgactgaccccaggtattttgccactaattccaacattccttctctgagaacacaaacatacataggagatggaggggtttacaatcccatttcatacctatacacagagtcctgggccactgaattagtaaaagttcatggtgattaagcctctgcacgggggtggtccagtatcaccatggaaacatcacacccttctcccagcccaggaagtgatggagggtgatgggtaggcacggtgtcaggaatcaggcttggacacaggcacatgcagcactggagatgactgatggagggagagaggctctggagcaagggagtttatcacctgctggtgtgccaaggaggaccagatccaactgagtgaatctagcagcacaaattgggatctgagctctgcagatttgggggaggaagtggcaatgctccctcacagtccctccctttgaacaggagctggcctttgactctcaagtccagcatctagttattactgagatgtgcttccctgcagattccttctggggaggcaagtagggctgccagtttcactggggccaaccctagagatcaggatatcatttgtttttcaaattttaacattttattgtgcttttccctctatcttttaaagatcatggcccagttattggccaaagcagaggctctggctgtcttgggacaaagctgccagtcagagctgcttgctcagtgtggggcatctggtgtggctggtgggaccctgtgtctcaaggtactgcaccccagtgcccagcacatgctggggcctcaggagttggttgtgtctgggtctaagtttccccatagccagccagccctgagacaagatgggtgcaggatcctgggaaacccaggggaaaagacgagtgaagaacctggaaaggagaaagcctgtgaagctcacgccagagcccactgttatgggaagtcagggaccccaaatggagggaccagctgaagccatggcagaacgtggattgtgaagatttcatggacatttattagttccccaaattaatacttttataatttcttatgcctgtctttactgcaatctctaaacataaattgtgaagatttcatggacacttaccacttccccaatcaacacccttgtgatttcctatgcctgtctttactttaatctcttaatcctgtcatctcataaaccgaggaggacgtatgtcgcctcaggaccgtgtcataatttcgttaactgcacaaattgtagagcatgtgtgtttgaacaatatgaaatctgggcaccttgaaaaaagaacaggataacagcaatgtttagggaacaagagagataaccttaaactctgaccactggtgagccaggcagaacagagccatatttcttttctttcaaaagcaaatgggagaaatatcgctgaattctttttctcagtaaggaacatccctgggaaagagaatacgcacctggggggtaggtctatagaaggcccccctgggcgtggctgtcttctatggtcgaggctgtaggggtgaaatagactccagtctcccacagcgctcccaggcttattaggaagaggaaattcctgcctaataaattttggtcagaccggttgctctcaaaaccctgtctcctgataagatgttatcaatgacaatggtgcccgaaacctcattagcaattttaattttgcctccatcctgtggtcctgtgatctcgccctgcctccatttgccttctgatattctatttaccttgtgaagcacgtgatctctgtgacccacacctattcgcacactccctccccttttgaaactccctaataaaaacttgctggttttacggcttgtggggcatcacggaacctactgacatgtggtgtctcccctggatgcccagctttaaaatttttcttttgtactctgtccctttatttctcaagccagccgacacttaggaaaaatagaaaagaacctacatgactatcggggcaggttccctgatagcccactcctgctggggcctctgagaagcctgccaagagcctcggggtgttccctccagaagacaagagcctggggagacccctacgctgagaggagggctgcccctcaaggcagaaagcagcactgcaacagctgtgggtggatggactttgggggtccaggctgagcctctagtgtctgcacgtgggatgggaggccggtgtttgttgagacttggacaagtcttgcagtgtggcaagagacgatggccagtgtgcagcagagagccatgcgggggtcagctctcctcctactgagccctcttcacctctcccagcccctactggtgcactcccatttttgcctaagctgtatgagtttggtttccggaacttgcacccaaactgtccttactgaagtacaaatgacattataaacccgaagccctggagacaaatgtgacctcccttcgctcttgctctagaagcaaggccgggtgggctgggatcccaccctcagagaacttaggttgtgaaatgctccaaggggtgcttttcttgaaattactgacaacacctagtacctgatggccagttccagatgctaacaagatgaagtcgaccaactgctcctttttaccaaacaacttttatttgcatgtggctacttagtaaatagtaatcagtgatcatcctagacagctgccaggcaacaaaaggagagacacatagaagcttttcaaggtatcaggttgcaaaaaaaaaaaaaaaaaaaaaagtatcagagtgatcagaaagtgagcagtgagcagtagtgaagccagaattttctttcccatgactcctgtagttctgtccctgtccccgcaaaccccaggaggggaaaaatgtagatacaaaactgtaaggcctcaaaccagttaggacaagtccctttctcgtaataatttatttcattcccaatgacagaaggcacgtgcagttacagggctgtgccctattcgtctgggtcaacagaagagcacagctttctttagaaaaacatttactttaaaaccaagcaccttgatttgatattttagtgtgcacaactttgcccgttgaggtcctggtgagcccttgcccaaccccgtgggcaccaccattccgccaggcctcggagggccaccgggtgcttaagagaatgtgaggggggtgagtgcaggtggcgcagcgcggttcctgggacatgggtccttcactcctcgctgagatgttgcggcagccttttcttccaatgcggttgtggcaggagaatccacggatgtaatgttttcacctttttccctgagggtgctttctgaggaaccagtccttaagaggtggggtcttggattcctgacccaggcgtccggcagctgctcagtttccgagatgtcagactcatggaggagcaggctatgcccttccctccccattccccacccctcaagccccaggtcttactgtataatgatttattttccccacacgtctaccctcaaaattggcttcatgcaaatttcccttgaatcctaatgctggagaggaaaggggaggggaagtgggagggtggtgggcagggtggcttgaccctgtcagcctcccagggaactcgggaccacggctccccagcacaggctgaacaagtaccaggaacaaggtctatgcatctgcgttagatctgaaggccttggcagcacctcttcaattttaagagaatcaggccgggcgcggtggctcacgcctgtaatcccagcactttgggaggccgaggcgggcggatcacgaggtcaggagatcgagaccatcctggctaatacggtgaaaccccatctctactaaaaatacaactaaattagccgggcacggtggtgggcgcctgtagtcccggctactcgggaggctgaggcaggagaatggcgggaacccgggaggcggagcctgcagtgagtggagatcgcgtcactgcactccagccttggaggaagagcgagactccgtctcaaaaaaaacaaaataaaacaaacaaaaaaaagatcagactgagtattcccctagacctactctagggaagcccatagctgaggcaaaatccccaaacagacttggcattagtggggctaggattctccattagtggagtgagggctttgatgtgagttgtctagaagagcaagttcatggtcagataattccaagagacagttgttttcccaggaaaaagaaaagcttcctcctattcagcagagtgaatttaaatgtccaaacaaagtgtggtgtcatcgctcagtctgcaaggacgttctgttaatcccgtggacgttttagtggatcttccgtttgtcatccagatggcaaacgttggaagctgcttttggggaccaataattggagctttcaaagagcatttcccccttggcctggcgcctgtgcatcagtggtaatagatgctgaaggcatggagaatgtagagcagcgtggcgatgaaggcgaagaactggaaggaggtggagagtgactgttagagacagcagcgccagctcctgcccacccctcaggtaccctcagccccactgcccaggaggccacgcatgaccctgcctcctcgcctcctgcgtggcctgagggcagcaacccctggccaacaactccctcttctggaaactctccatcagggcctccctggggccgtcctggtgtcctgccccgactgcagtctccacctcatctgcacctggctgtgaagcaggctcacctccaccacagctctgggcccatatcccacgctgacctcctgcccgaggcccgctctcctctgcccacctccagcaaatctgtgttctgaacactcctacagctcccctcgctggcccagaactctgccctgagcggctgcttatcagctcctcgtgaatgttcagacatcctccagctcttcctggctcacactgagcccctgacgtttcctcacaagcctgacaagcccagtgggccccagggtcctcctctcgccccactccctgagcctgacccctgtggcccctggctcctcctgcctcccttgccagccatatgcaaagccaccccaaaggctactgatttccctgcctagctcttgggacattcatttttcccttgtctcagccaccggcatccctcggcaggactcctcatggcctcacttgtccacttcttcctgccctgcccctcgaatctgctccaccatttgggcagggcaggcagaagtggacaagtgaggacacttctcactcatggggagaacacaatcccgttgccccacgttgaagctgtatgatggctctgctcttttctcagggtagggccgtcaccttcaatacctttcaggccctgccaaacatcccagccccactctgccccactgtccactcacacgctcctcattcagtcagtcagtcaacaaatatcttttaaggacctgctttccttcaagagcaactgtgggtataacagtgaagaaaatattcaaaaattcctgccctcatggagcttacatttgagagataagaagcagatagcagcaagatagatgagtagcacatacatgggttagatggaggtaaatgccacccactgtggagtgcactgtgaccctctggggtggccacaagatatttcagctgccttctggcctgtctgcctcccttccctcctcatcaggtgagtttaacttcctaaacttgcaagaccagcaacggcccctgcaatcctccatggccagctgtcccagctacaccaccctcctggctgcccttgagcacacagagggtccttggcaggggtaactgcctggtgggaccttagcaggggtaactgcctggtggcccctgcctccttctgtcctcttgacagggccttccctgatgcctcctcccctgagacctcgacattccactttccccttccctgcttcatctctcaatagttcagccatgccgagggatgcgggccccattccaaaggcagtgggtgccattgaaggattttcagtaggagagagacatctgttccaatttgtgttttggaaaaagaaaattctgcagacagcgtggggggtgtctaagagagaggaaagctggagtgggaacaatagaaggtaaaagaggacccctgaacgtgggtgcacatgtttacagggacacacatccctatcccctgcccccatggctccttccacttgagggctcagggtctatacagcacaagcaaagttaggcctcctgcacgaaacatcctccaggcaagactgctgtccttggccagcccactcaccgaggctgccgaattaatgtagtaaattcttgggtccagcagtttctcagaaacaatcgtggcatgtacttgtaggacggcagcgctcatgtacaggatgccagtggtcccgtggtacaggctgtcctggaaatgcagagcagagccacgcatggccacatcaatcaggtgaacattttcctctctggctacatagcagtaaagaatgagcaaatgaggcaggccagccccctagagtcctgccttttttttttttttttgcagtgtgatttggtttggctctgtgtccctgcccaaatctcatctcgaattgtaatccccacatgttgggggagggacctggtgggagatgactggattatgggggcagtttccccatgctgttctcgtgatagtgagggagttctcataagatctgatggtttaaaagtgtgacacttccctctctcactcctgctgccatgtaaggtgtgccttgcttccccttcgccttccaccatgattgtaagattcctgagacctccctagccatgcagaactgtgagccaattaaacctcttttccttataaattacccagcctcaggtagttctttacagcagtgtgagaacagactaatacagaaaattggtaccaggagtcaggcactgctataaagatacctgaaaatgtggaagcaactttggaactggataatgggcaaaggttggaacagtttggggtacccagaagaagacaggaagatgtaggaaagtttggaactttctagagacttgttgaatgattctgaccaaaatgctgatggtgatatggacaatgaaatccaggctgaggtggtctcagatggagatgaggaacttattgggaactggaataaaggtcactcttgctatgctttagcaaagagactggtggcattttacccctgtcctagagatctgtggcactctgaacttaaaagagatgatttggggtatctggcagaagaaatttctaagcattgaagcattcaagatgtgacctgacttttcctgaaagtgtacaatcatatgcattcacaaagagatggtccaaaattggaacttatgtttaaaagggaagcagaacataaaagtttggaaaatttgcagcctgatcatgtgttagaaaagaaaaacatattttctggggagaaattcaagctgtcagctgcagaaattttcatgagtaatgagggtccccaagacaaaggggacgatatctccagggcatttcagagatcttcacagtagcccctcccatcacaggctcagagacctaggagggaaaaatggttttgtgggccaggctcagggccctgttgctctgcacagtcctggaacacagcactctgcaacccggctgccccagctccagcagctgggggccaaggtacagcttgggccattgcttcagagtgtgtaagcctcaagccttggcagcttacacatggtgttggacctacaggcatgcagaaggcaagaattgaggtttaggaacctctgccatgatttcagaggatgtatggaaatgactggatgtacaggcagagtctgctgcaggggtggagcccttatgaagaacctctactagggcagtgcagaagggacatgtggggtcagaccccccacagagagtccccactgtgacactggctagtacagctgtgagaagagctgtcctgtagaccccagaatggtaggttcactgacagtttgcactggtcaccttgaaaaagcacagacactcaatgccagtttgtgaaagcagctgcaggggctgtactgtgaagagccacagaggtggagctgcccaaggtcttgggtgcccaccctttgtaacagggtgacttgaatctgagacatgaagtcaaaggagattttggaatgtcgacatttaatggctgcccagctgggtttaggacttgcatggggcctgtagcccctttgttttgaccaatttctcccatttggaatgggagcatttacccaatgcctgtacccttattgtgtcttggaagtaactaacttgctttttgattttacaggctcataggcagaagagacttctcttgtcttagatgagactttggacttaaacttttgggttaatgctggaataagttgaaactttgggggactgttgagaaggcatgattgtatttttaaatgtgagaaggatgagatttgggaggggccagtggtataatgatatggtttggctctttgtccccacccaaatctcatctcctattgtaatccacatgtatcaagggagggacctggtgggaggtgattggatcatgggggcagtttcccctatgctgttctcatgatagtgaatgagttctcatgggatctgatggtttaaaagtatggcacttccccctcccccatctctcctgctgccatgcaaggcatgccttgcttagccttcaccttccaccatgattgtaagtttcctgaggcctccctaaccatgaggaactagtcaattcaacctcttttctttataatttacccagtctctggttgtttatagcaatgtgagaatagactaatacacagtgtttttaatgtaatatctatgtcgtaagcaatggcagactaataaagatcagtatatttcagttacgcaaagtcaatcttggtctgaaatattaaatgaaaaattccagaaattaacaattaaatgtgtgcctttctgagtacaatgatgaaatcttgcactgtcccgccctgttccacctgggatgtgaatcagacatttgtctagcatgtctacactgtctgtgccacccatgttagtcgctttgtactcatctgggctatcagatcaactgttgtggcactgcagtgcttgcattcaaagaatccttattttacttcataatggccccaaattgcaagagtagtgatgctggcaatttggatatgccaaagagaagtcatagggtgctttctttaagttaaaaagtataagttttcagcttaataaggaaagaaaaaaaatatgctgaggttgttaagatctacagtaagaatgaattgtctatctgtgaaattgtgaagaagaaaaaagaagtgcatgcatagcaaattcggagttcagtactctctgaggattcaggcatcccctaggggtcttgggacttatcctccggagatgggggaccactgtatactgtcttaggtatgctgaggaattgtttacttcgtatacatgtgataatgtgagaaagtttgcggagtttttttggaaacatactgaagtgtgtggaatagaatggcatgatgtttggtgtttgctttaaaattccttagtggggacaaaggctagatgaaacaaatgtggtaaggtcttgataatgctggaatctgggttatggctacatgagggcctataatacaatattctgtacttttaaatatgtcttcaattgttcagtgtggaacagttttaaatggttttttgagatgacgtgataaataaaaattagtgatgtaatattaaatgaaagcatctacatccaaaattatttgtagagtacaattaaagtatatatatacatatatatacatatatacatatgtatatacgtatatatgtatatatactttgcatataattcatgtgggatatggaagaaataccctgtcgcagggattgtgttagggccttgagaatggagtgatttttttcctactagctttttcttcagtgttgctccaaggattttaccaggaagaaaatttaggggaaacacatcagaatatgcttgatcacaggtcattgtgtattctcctaacagggaagccagtgaaggggaataccaggaattatttacgcttgcagataaatgtcttcattttagcgtggtagtaaaaatggtaagataaaaagtcttggttccataggagcctagcccaggatccctccctgcccagaaaggccaattgtcctcacccaacccagaacgtccacccaggaagagccatgctgctggttcttaccagaactctccaggattcaaatcttttgtaaaatccaaacaagtaagacaacaggaacatcaaggagatgagaaacgaggtgagcgagacatacatcacccatccttgcagcaaggggtatactatgtgggtggcggctaccatggtccagaccaagaacccaaatatctggaagataaaagcataaaagaaggggcttcattagctagtgtggagtatgtttccctttgcagggtgtctcttttctgtctctagttacaagttcaggtgaagttaggagggaaccaagaggaaaatggggaaggaaggctggccccgctgagtcacggtaaagtcaggtccgattgttagaaaattcaaggggttaatgcagaggtcatgaacagagggactctcagccaaatctagcttgtgaatgtgtcttttggctcaagcagtattggcatatacactttttaaacaattctgaataagttcccaatattcaaaacaggatatttcacatggaaaatccagatttgggacatttctttagaaatccatggttctggccacagtgtacccatttctcaggccagagtaggctgaaatgagtagtgactatctctttaaaaagggcctggagtcctcagtggaccacatcccctcaccccactaacctcacaccatgctgtgggacattccctgttgctcactgacactgtgtaattgtttactaatgagatacagcttatttttatatatttgttagccattaatatttcctcctctgtaaagttttttattttttaatcagttaaatattttaaaattgatttttctttttcttattgattcataggaattcttgctaatggtgtggatttcatggactgccataaacattgcaaatatattctgctagcattcacatattttctggtttcctttgattaactaagcccgcaattttaatgcagttgaatatgtcaatcttttcctctattgactatgttttttatcaagtttaagaaattcttctcacgcacaccaacatggcacatgtatacatatgtaacaaacatgcacattgtgcacatgtaccctaaaacttaaagtataataataataataataataataataataataataaagaaatgcttctctattttgagtcatgaagatattcttgcattccagattttcctcctgagataattttccttcttcctggagtgcaacctttagtagtctctttagtgaaggtcagagggtagtagtctgtttgatttattagaaaacgtctttaaatttcccctgacaattattttctctccgcacttccaagatatgtttccactgtgttgtatatttttccataatattctgttgtattctggcttccattgttgccattgaaaagtcagctgtcagttgaactcttgctttgtaggaatctgtcttccttatttggctatatttagtcttcactctgtcttcggcattctgcagtttgtgaaacagtgataccatgtgtcgagatgtggatatctttttattactcctgcttagtattcattctacattttaatatctgaaaattccattcacttggccttaatagcttgattctgcagtttgtggcttccattaacttctattcttgttcacttgtttcctcttatgtttagtgaattttgattggaagctcatgtccgtggaggtagctcagttctgaatgatgtattagaaactttctagaccaaacaacttcactcacttttttttttcttgagagagtctctctctgtcactcaggctggagtgcagaggtgcaatcatggctcactgcagcctccaactcctgagatcaaatgatcctcccacctcagcctcctaagtagctaggactacaggtacatactaccacacctggccaatttttattttattttttgtagagacagggtcttgctgtgttgcccaggttggtcttaaacccttggcctcaagcaatcctcctagcttggcctcccaaagtgctgagattacaggcaagagccactgtgccctgccttcacacccttctgtatagctcagccaaaagatatacaacttcagttctgctttccgaactatatccttagctttctgggaccagcagttcttatcttacaactggccaatacatagacatagatatgtcaccctttcccttctgaggtttccacatgctgttgtctggcagttgtctttggatttatggaatattcacagtcttttaaggagaaaaaagaaaagggagatgagaagccagaagagaacaggaagttgaccacaaggcagagactcctcagcaaggagcacaatcatagctttatggggtgggaaaacaactccagcagcgtggccacctcttaaagcaccagttctggtagcaaattcctccttaacaatcaacatccaagtgaattttggaagtcctaggctggtctgagactgccggagaatgagtcaaagccggcttgtcctagggagggggtggtgaggaacggaagccgctgtcctctggctcccccacaactgtgctgctgagtgtcaatcccagtgacaagggctgctgatgcttcagaaaggtaccaggcctcagctttaaggcgcttgccaagaagccatgagaagtgcattaagatgctggcatatgaacagcacccaaacaatgctggttattagtggttcaccaggtactttacagttgataaaatgcattcactcagactgcctcatttagaccacacaacaattctaactcccttggaaagaccagagaactaccattcgacaccttccactgcttactgccagctcacctgtgccaggcatggggacagcaagggaacctcagccccatcttgccagtcagtgcctgcagtggggtcccggtgcccctcttgccatcagaagcttccctggccagacacagccatatgcacgttacttacatttgcacatttaatctttgccacagtccatgaggtaatactgtaccggaggggattagggcctgaggtcacacaggcagtgcgtggtgggactcagacatggtgtaggacagttgtggttcttgccctaaaaaccaggtttcaaggccaagggcagggccaggtagaggctcctagaatatgccagagggtggcctgctacagtcccagccaaggtctgcctggggcattagaggccttgatggggacatcacacctggagtctcagggagcccatcagcggcctcctctctctgggttccagctatagcttagggatccttgtcctacctttcacaacaggccaggggcctctgagcatttgggaatctgctcaaacgtcatgggaaccttcctgcaatggcttcagtgttgcagaatcaatgttctgcagaagaaagtcactcacttcttatttccacacccctctacctcctaaacaggaggagggaccagagccaagggctgcaggtggattgaaacccagtagagttcgtgatctcatttctgtctcaagtagtctaggttggattccttacagttgtgaaaactttgagtatttgtttttactttttcttaaagctcatatttggctttccaaatttcctggtggcctaaactgctttcccattttaatgtttatttttgtatttcctcagagcgggagatatttttcaacggttggggctggccctcaaagttgagaaatatttgattacagcgagccatttagagcaagtagatttcaagcacaactt

SEQ ID NO: 27 - DNA, 5369 bp, Homo sapiens
ccatgttatccttgcatgctgccattttgtaagcactgacaactttaatttctttttagttatattattttcaaatgtcaagtaacattaaggaattatcaaagaaaaaatgtaaaaattattaacacagaatataacataaaacaagaaagtgttcctttcttttctttctttttttttttggagacagggtctcactttgttgcccaggttagagtgcactggcatgatcactgcctgcggcagcctcaacttccctgactcaagtgatcctcttgctgcagcctctcaagtagctgggactacaggtacgcatcatgcctggctagttttttgtttttgtttttgtttttttatatggcgtctcactgtgttgcccaggctggtctcaaactcctgggctcaagcaatcctcctgcctcggcctctcaaagtgttgggattacaggccatccagcctggtctcgagaaagtgctcccttcatcatgcctatcagtaccatttcaagggcaaccactgtattacctcagtttttaggacttttaatcaagacaaatataagactaaattttaaacagctgagaagaaaacatctagtctaaacatcttattttaaaatctgagggccaaaaagataatataacttataaagttggacaaagctaagacttgaatacctgtttcttatttcttactcaagtaaactttccataatgccatatcactccaatttaccttttgaggaaacaactagctggaatacaaaattctcctaccatacatatgcacatagagaaagtcacaaagtggttggggaagttttatttagtatattctctttcaataaaaatttaaattctcaacgaaatttttcaggtggttttgttttgttttctgtgacagggtcttgcactgtcacccaggctgatgtgcagtggtactatcacagctcactgcagcctcaatctcccgggcttaagcaattcttccacctcagcctatagcatttgctaccacgcccagctaattttctgtagagatggagttttgccacgctgccctgatgtctgcaagtaccaatccccactgtacggctgaggaatcagaatatgactgagatacagctgatttagaggaggtaattgcaaaatgagcctaaaacatctcactgaaccagaaagaaagcacataaagacttatggggacatgtcagaaggccacaggcacaacttgaaggggattccacttatcaaatatgggacaatttgagcatcaaaataaaaataatgttggattacaggcccactgaatagaaaaaatgaaacaatgaagttaggcccaatagctataatctcagctactcaggagactgaggcaggaggatcacttcagcccaggggtttgtatcccaccagggcgacatggcaagatcccatctcctgaaacaaaaacaaaaacaaaaaaaaaaaaaaaaagaaagaagaaaaccatgagtccataaaaacaaagataaacaaataaatcaacaatgggaggaagagaaagctttttcttacagtagaatgtcaactaatgaatgtaataaaattagaaagaccaccattcagcaatcatcaatagaaataattaagtaataattcaaccaagaaaaatcaacaaatgctaaagctagtggatgaaaagtgtgatgaggaatgagttacttagtttcaacacaccatctccaaaaaataatcatttccactcatttttcaaaggaaaaaaaagtaccctttctagtgtagaaagccagcagacaaaaaaaaaagcttaagtcaagtgatccatgttaattaagatcatcagtaacaggcaaattaaaatcatgtacctaactagcctgacttcaatttttaaaaattaaaaaaaagtgccaactggtaaggtaacactgagaagaataccacatcacctctgtgatactgctaccaaaaattgataacctgaattgattcatagggaagcattagacaaatctcaattgagaaatagtctaagaattaactgctctgtaaacctcaaaactgtcgaaatcatgaaagtcaaggaaacgttatggctgttctagattgaaatacatcaaaaagacacaacaactaaatgcaaattataatcctgattgaattattttcctaaaatgagcattattgggactactggcaaaacttgaatgggttctgtggattagatgatataatccacaggttctatcaatgctaacctcctcattttgacagttggattctggatatgtagaaaaatatccttattgatagcaattacaaactaaaatattgtggggtgatgggacctcatgttagcaagttactctcaaataatcaaaacaaatttctttatactggttttgcaacttctggaacttatttcagaagaaaaaaattgtaaaaacaaaaacaaagtgaaaaaaatctattcttctccagtcttatcaagaagcatctctatttttccagttgctcaaaacaaaaattttgagataggcttgacccctctcatgctctcaccttatattccaatccattagcaaatcccattagctttcccttaaaaatatatttcactactccaagccataatcctctcttgcatggattactgaaatagtttcatatctgatcaacttgattttactccaaactctaatataactcatttcctatacaacaataaggatcacccttttaaaaagtaagtcagagaatgttaatgctctctctctgtcagaaagtactggtagtttctctactttgaataaattccaaagtccttgccatggcttacttcatataatctagacttccctacttcttgtttttttgtgttttttttttcttttttgagacagggtcttgctttgtcacccaggctagagcgcagtggcacaatcatggctcgctgcagccttgacctcttgggctcaagtgatactcccacctcagccacccaagtagctggtactacaggtacgcaccaccatgcccagctaatttttgtattttcggtagagacacggttttgctatgttgcccagtctggtcttgaacttctgggcacaagcaatccacctgccttggcctcctaaagtgctgcgattacagccgtgagccaccatgcctggccaacttccctacttttggtgttatattctactacagtaaaggttagatacagaacactgctacttccgccaagactaacacaatggatgatcccatccccaccactgcaaaaaaagaaaagaaaagagaaggttgtttaaataccggtaggctaaaaacataaatatccattacagcttccatggcaatgcactctcacgagtctccattcttcaccccacttcccacatctcacctgagtctgcttcagaatctcttcttccttgtttggctattaaatgccagtgtcatttgaagtttcattcttgcactactactcttttcattctattgagtctcttgaagaaacatcacctataaactaaccctcaaatctgtatctccaatctagacagagctaagcttcaaattccaaattatataaaactagttgttagatattttaatccttggccacatgcttaggatggcaaagcagtaagttaaaaaagagtgcatgcttccctctccctctccctcctcctccccctccctccctctccctctctttccacggtctccctctgatgccgagccgaagctggactgtactgctgccatctcggctcactgcaacctccctgcctgattctcctgcctcagcctgccgagtgcctgcgattgcaggtgcgcgccgccatgcctgactggttttcgtatttttttggtggagacgcggtttcgctgtgttggctgggctggtctccagctcctaacctcaagtgatccgccagcctcggcctcccaaggtgccgggattgcagatggagtctcgttcactcagtgctcaatggtgcccaggctggagtgcagtggcgtgatctcggctggctacaacctccacctcccagccgcctgccttggcctcccaaagtgccgagattgcagcctctgcccagccgccaccccgtctgggaagtgaggagcgtctctgcctggccgcccatcgtctgggatgtgaggagcccctctgcctggctgcccagtctggaaagtgaggagcgtctctgtcctgccgccatcccatctaggaagtgacgagcgtctctgcccggccgcccatcgtctgagatgtggggagggcctctgccccgccgccccgtctgggatgtgaggagcgcctccgcccggccgtgaccccgtctgcgaggtgaggagcatctccgcccggccgccccatctgagaagtgaggagaccctccgcccggcagccgccccgtctgagaagtgaggagcccctccgcccagcagccgtcctgtctgagaagtgaggagcccctccgcccggcagccgccccgtctgggaagtgaggagtgtctccgtccagcagctgccccgtccgggagggaggtggggggggtcagccccccgcctggccagccgccccgtccgggagggaggtggggggggtcaaaccccggcccggccagccaccccgtccgggaggtgaggggcgcctctgcccggccgcccctactgggaagtgaggagcccctctgcccggccaccaccccgtctgggaggtgtacccaacagctcattgagaacgggccatgatgacaatggcagttttgtggaatagaaaagggggaaaggtggggaaaagattgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtacaagatgtgctttgttaaacagatgcttgaaggcaacaggctcgttaagagtcatcaccactccctaatctcaagtacccagggacacaaacactgtggaaggccgcagggtcctctgcctaggaaaaccagagacctttgttcacttgtttatctgctgaccttccctccactattgtcctatgaccctgccaaatacccctctgcgagaaacacccaagaatgatcaataaaaaaaaaaaaagaaagaaatatcatttgaaaaaaaaaaaaaaaagagtgcatgctgactactttgagtcttcagaatgattatacgataaaagtaaatcccttatttggtaaccccttgtatt

SEQ ID NO: 28 - DNA, 2619 bp, Homo sapiens
ctggtctagatttcccggttgacttatcttttctgttcagtcacatgatttggtgtatgtggattttaaaatctctttattataaaatttaaaggctgcagaagttatccagttgctcctaaagaattacaggttgagcgggctgacatggtggcttacacctgtaatcccacactttgggaggctgaggcaagcgaatcccctgaggctaggagttcgaggtcagcctggcaaacatggcgaaaccccgtctttactaaaaatacaaaaattagctgcgtgtgatggcatgtacctgtaaccccaggtactcaggagactgaggcaggagaatcacatgaacctggcagagggaggttgcagtgaaccaagatcatgccactgcactcctgcctgggtgacacagcgagactccgtctcaaaaaaaaaaaaaaaagatttacaggttgagtatccctaatctgaaaatccaaaatgctccaaaatctgaaacttgctgagcaccaacatgacactaccatggaaaatttcacacataaaagtactttaactttgtgtaatgctcaaatgtatttaaaatatttttaaaaattacctttagcctccatgtttaagatatatatgaaacataaatgaattttatgttgagatttgggtctcatctcaaagatagcttattatatatgtaaatattccaaaatctgaaaaaatccaaacacttctcatcctaagcatttcagataagggatattcaacctatataaacaaagttgcttgcattagccaaccagaaaaacaaccaaaaaacactttaccttttccaatgcccatgcccccactcagctctgatcatcagtaactccattgatcactgtgtgctttcattcttcctgtctgatgacagctgtcccaatgggatgggcagagtgtcaaaggccagccagcaggtttcctgtcacctaagaaagcaacggccaccagtgatcactgtgcccccattcagggtctcacaggtctgtacagtcatgctgtctgccttagtagcagcattcagactcaagttacgttgcgacccatggcttaacaggggcctggattgtgatgaaaatcaccatgaatataaggagtcatttgagggtcttctgtctagttgtctgtctctggtggtgcccagggctgtatgggtcctggggcactctgcttacccactcacccactgtgcatcattttcagaagagtaagctgcatcctaatatccctcaataatccaatatgtttcttttcatctctgaattattagaccttcctggaattctatttgcagctgataggaatccaagttctaggtttcctgccaactcttcagtgaagcattttgctcattaaccaccaaaactcattcgggctggagtagtcaaatcccctcatcataggaacacatgagtggagggcaacagtgggtttgcctgccttgttggaatcaggatccttgatttaaggagactctaagagaagctagcaccaagtaacctagtagtaacctatagttgcctttctcagcaggcaatgcctttctcagcatttcctccttcaaggagatgggaagaagcaataaccctaagaaatcatcagtatcatcatcttcctttttctgatgaggaaactaaggcttcagactgttaggtattttgcccaaaggctcacatagctggtaaaagcaagaggcaggatgtgctctcagggccagctgcccacagagccttcggtgggttttgctttgctccttcttactgtcttttggctcattaaaagtaacacaaggccgggcgcggtggctcacacctgtaatcccggcactttgggaggttgaggtgggcagatcacctgaggtcaggagttcgagaccagcctggccaacatggcaaaacctcgtctctactaaaaatacaaaaattagctgggtgtgggggtgcacacctgtagttccagctactgaggaagctgaggcaggagaattgcgtgaatccaggaggcggaggtagcagggaaccgagatcgcaccactgtactccagcctgggcgacagaacaagacttcgtctcaaaaatatatctatacaagcacaaggttaaaaaaaaaagaaaagaaaaatggcaacagtatgccctctggatgcagctctgggccagcccctcttctggtgctacacccacctccatgccaaggggcccgcctggcagcatgagaccctcatatccctgtggtggcattccacatgacagacaagggagggacagaaacatttcctcggcttgcgtcagtgctaggagccctgggccctgagattactgatcaactcctcctccgcacagatctggaaaggaaacgtgaggaaaagtaggctactctagaaggacacacattgaaaagtacatctccttaccactcctggtgctggtactccatgttactgctcagtggcagtcctccaaccctctcctcacccccgagtcctccttagacctgctggtttcctctattccctctagatcccagggtcaactggctctgccccactcggagcacttaacacacattcttggtagggggtgccatatt

SEQ ID NO: 29 - DNA, 14718 bp, Homo sapiens
tcacaaaggttgtccatgttcacatataagcagaaaagtaattaatatctaacaccaggtaatgatttattccttgccggttatttgagatttttctttaccatgctgtttcattccattagcacagtggtatttaagtagaggtgattttgcactcaaggacatttggcaatatgtggagacattttttggttgtaacatctaggagatactgttaacatttactggatggaatctagggatgctgtaacacgtcttaccatatgtgggacagcctccacaacaaagaatcatctggcacaaaatgcaagtattactaaggttaaaaaaaccgtaagttagcataaataataatgaattaagtataagttgcagcctcgctcattctttaattatagtttgtgttgactgtttattttgtgattttattattttattattttaaaactaaaatgatcctagattagatgttatctaatatgcaacagataggtacatctgttctgtttctcagattctgatcttaaagtcattttatcatatagcattggcatttgttttgcaagtttttaccttaattaaaaataaatcaaaggcagcagaaatctgtgtgttttgttgtcgttgttgttaactaaaatgataaagggatcctcagctgttaaatctactttgttgttttgaggtttgacctggccttattccatatatagccatctgccagctggtaaggtggtatctagtaaggatatttaagagtgttgccttgccagatctagccgtaagcaagtcctatatctaaattaacctttgaggctgaaaatcatatagccatctgccagctggtaaggtagcatctgtctaggatgttcaagaatgttactttgctagatctagaggcaagcatgctctctgctaaatttcatctttactggacctccaggatctttaggacttgtattagtcaggattctccagataaacagaaccaataggagtaagtagataggtaggtaggtaggtaggtagatagatatatgtatagatagatacacaaggggacctcagaaagttcatggaaaatgcatattatgaaaaaactctgcatgtttttcaaaaattttttgtgccaaaataaacttgaacaggatctagtttgaggcactaaggaaggctaagacatcagtttgaaaaaagctcctatcaaagcaacatgaattctactaaaattgaagcaagaacaaacataaaatttatagtgaaactttggtagaagaatggtgaaatcattgatgctttacaaaaagtttatggggacaatgccccaaagaaatcagcagttttacaaatggataactcgttttaaaaaaggacaggacaggccgggcatgatggctcatgcctgtaatcccagcactttgggaggctgaggcgggcggatcacgaggtcaagagatcaagaccatcctggccaacatggtgtaaccccgtctctactaaaaatacaaaaattagctgggtgtggtggcgtgcgcctgtagtcccagctgctcgggaggctgagccaggagaattgcttgaacccgggaggcaaagattgcagtgagccaagatcgcacgactacactccagcctggcgacagagcgagactctgtctcaaaaaataaataaataaaaaaggacaggacagtgttaaagatgaagcttgcagtggcagactgcaaggaaatttgcaaggaaaaaattaaccttgtttgtgccttatttgaaggggacaaatgattaacagcaaaaacaatagcgaacatcacagacatctcaagtgattcagcttacacaattctggctgaaaaattaaacttgggcaaactttcatctcattgggggccaaaaccattgcacccaaatcagctatagacgagcagtgctttcaatggaatttttaaacaaatgggatcaagatcctgaagcatttcttgaaaaaattaaaacagatgaaacatgtctttaccaatatatcctgaagacagggcataattaaagcaatggctaccaagaggtggaagtggtccagtcaaagcaaaatggactggtcatggcaacagttttttgggatgctcaaggtattttgcttgttggttttctggagggccaaagaatgataacatctgcttattatgagaatgttttgagaaaaccaaagctttagcagaaaaacactagggagaaatttgttaaagagtccttctccaccatgacaatgctcctgctcattcctgtcatcaaacaagggcaatttttaaagagtttcaatggaaaatcaatatagtcctgatttggctccttctgacttctttttgtttcctaatctttttgtttgtttgtttttgagatagtgtcttgctctgtcacacaggctggagtgcagtggctggcacaatcttggctcactgcaaccttgacctctggggctcaagcgagcatcctacctcagcctcccaagtagctaggactacaaggtgtgccaccatgcctggctaattttgtttattttttgtagagatgagatctcagtatgttgcccagtctgggctcaaactcatgcctggtgacacagtgagactctgtctcaaaaaaaaaaaaaaaaaaaaaaaaaaaaaatatatatatatatatatatatatatatttatttatttatttacgtctataatcccagcaatttgggagactgaggtgggcagctcacttgagcttaggagttgcagacccgcctgggcaacatggtgagaccccttctcttcaaaaaaattcaaaaataagctggataggctgggtgtggtggttcctgcctgtaatcacagcactttgggaggccaaggcaggcagatcacctgaggtcaggagtttgagatcagcctggccaagatggtgaaaccccgtctctactgaaaaaagacaaaaaaattagccaggtgtggttgtgggcatctgtagtcccagctactccggaggctaaggctggagaattgcttgaacccatgaggcagaggttgcagtgagctgagatcatgccactgcactccagcctgggcgacagagccagatcctgtctcaaaaaaaaaatacatatatatatatatatatatatatatatatatgtttttgtacagttatacagtatgttcgtgttttaagctaagtgttttattataagagtaaaaatgttaaaaacagttaaaccacaggttaaaaagtttatgaagtaaagttagagtaatctaaggttaatttattatcaaggaaataaaaaacaaaagtaatgttgtctaagtatagtgtttatgaagtctacagtagggtacagtaatgtcctaggccttcacattcacttaccgctcacacactgacctagagcaagttctagtcctacaagctccattcatggtaagtgccctatacaggtataccatattttatctttcatactgtatttttgctctactttttctgtgtttagatacacagatactattgtgttgcagcaacctacagtattcagtggaatagctatacaactatcctatagtctagaagtaataggctatatcatatagcctaggtatgtaataggctatgtcatccaggtttctctaagtacactctatgatattcatacgatgaagtcacctaacaacaaatttctcagaacatatttctgtcattaagccacacatgactgccttaagtattgttccatgaaatttttattttagttttatgtttacctttgcatttggtcatgattcaaaaaagcatttcttatactatgtttctttctatactaagttaactataaaatggtacatcactggtaatagtgataataaaccggccattttcatgaaaacttagttttatcttggctaggcacagtggcttacgcctataatcccagcactttgggaggctgaggcgggtgaatcccttgagcccagagttagagaccagcctgggcaacatggtgaaaccccgtctctacaaaaaaattagttgggcatgatagcctgcgcctgtggtcccagctacttgggggcctgaggtgggaggatcacctgagcctaggtgattgaggctgcagtgagccctgattgtgctaccgcactccagcctgatggatagagtgagaccctgtctcaagaaaaaaaaacaacaacagcagcaacaaaaaaacccacaaaaacaaaagccgaaaagaaaaggaaacttagttttatcttgacaaagatatctaatttgcttctaagctttttaaattgaaacaatgcatggcctatcttttgaatttgtgagtttgccacccctgaaaacatctaagtagatcatctgtcagagatgttacaggtaggatgaattcctgctttattatggaaaatttgacttctagttctttccaagtaatattttataattctaacttatatatgtggtcctattcctagaaaatgatgtattcttttcatacagtttttccagtggtactgaaaataacctcagcccgaattggctttgttaaacttggaagtttttcaagaaacatgactctagaattctttactaggtcttcgcaaaatatttcgccttgcagtaagaattgtgttcctctcatatctctttttttccttatttccatgctttcccattttattcacatggacaatttttagtcaattagcatttattttggggcttcctcaaaaactctaaattttttttttgagatggagtctcgcttggtccgaggctggagtgcagtggcgtgatctcggctcactgcaacctctgtctcccaggttcaagcgattcttctgcctcagcctccagagtagctgggattacaggcgggcgccaccacgcccagctaatttttatatttttagtagagatggggtttcaccattttggccaggctggtcttaaactcctgacctcatgatccacccgcctctgccttccaaagtgctgggattacaggcgtgagccactgcgcccagccaaaaaactctaaatttacctctttaggaatttcaacctgaccatttgtatctcttcttatattttcagttgttgcaataaattttaactttttttatgttattttataaaattgtttccattcatatatacattttcttttttataacagctttattgggatataatctacatagcatataattcacccattaaaatgcagaattcagtgctttttagcgtatccacagagttgtgcaactgtcaccactgtcaattttagaacatttttcttacaccactaagaagtcccatgtccattagcagtaattcttcattcactccctccccaagcctctggcaaccactaatctactttctgtctcaaatttgcctgttctagacatatcctgtaagttgagtcgtatcatataatatatagtctttggtgactggcttctttcactcagcataatgttttcagggtccatccatgttgtaacatatatccagcacttcatttccttttattgcccaataacattctattacggatatactgcatttcctttatcctttcatcaattgatggacatgcggttgtttccactttttagttattgtgaataatgccattatgagtattaacgtacaaatttttttttgtggacatatgtttttatatctcttgcatatacccaagagtgaaattgctgggtcaggtggttaaggcgtaagagttctttttatggccaggcacagtggctcatgcctataatcccagcactttgggaggtgaaggtgggcggatcacctgaggttgggagttcgagaccaccctgaccaacatggagaaaccctgcctctactaaaaatacaaaattagccaggcatggtggcgcatgcctgtaattccagctactcaggaggctgaggcaggagaatcgcttgaacccgggaggtggaggttgcggtgagccaagatcacgccattgcactccagcctgggcaacaagagcgaaactccgtctcaaataaataaataaataaataaataaaagttctttttatattctggatactagtactttgttagttatatgacttgtaaatttttcccccattctgtgagttgtcttcactttctttatggtgtgttttgaagcacagaagttttaaattttgttgacattctatctatttttccttttgttgtgctttttggtatcacagctaagaagctattacctaatccaggatcataaaggatctacacctatgttttattctgagatatttatagatttacttattacgttttgcgtttctgatccattttcagttaatttttgcttatgatacaaggttaggggatccaactttattcttttatacatggatatctagttatcacagcatcatttattgaaaagggcaattttttccccattgaattgtcttggcacccttgtcaaaaatcagttcaccatatatataagggtttatctctgaactctcaattccattccattgatgtgcatgtctgtctttatttcagtaccacactgtgctacagtctttatttgttgctttgtattacgttttgaaatcaggaaatgtgaatcctctgactttgttcttctgtttcaagattgttttggctattctgggtcctttgcatttccatataaagcagcagcttgtcaatttctactcgaaaggcagctggtgtttgaaagagattgcattgaatatgtagataaatttggggagtattgacatcttaataaatattaagtcttataatcagtgagcatgggatgtctcttcatttgtttagataagattactttttttcagtgatgttttgccattttcattgtgtaaatcttgcacttcttctgttacatttattcctaataattttgttcttttgatgctattatgaatgggctcattttcttaatttcgcatttggattgctcattgctagtgtacagaaatacaattgatttttatatattgatgtattctgcaatgttgttgaacttttattagctctagtaatttttttgtaggttccttaggatttgcttatatacaagcaaatttggattttgtagattccttaggatttgtttatatgcaaatcctaaggaacctacaaaaaattactagagctaataaaagttcaacaacattgcagaatacaagaccatgccatcttcaaacagagatgacttgacttcttcctttctaatctgtatgtctttttatttcattgttctttttctttcttctttatttttactttttgtctcctttccctggctaggggaatctccagtacaagtttggataggtttggggaagccaacatttttgtctcgttcctgatcttcgaaggaaagtttttagtttttcaccattaagtatgctgttagttgtgggtttttcttttttcttttttctttttttttagtatttattgataattcttgggtgtttctcggagagggggatttggcagggtcataggacaatagtggagggaaggtcagcagataaacatgtgaacaagggtctctggttttcctaggcagaggaccctgcggccttccgcagtgtttgtgtccctgggtacttgagattagggagttcaagcatctgtttaacaaagcacatcttgcaccgcccttaatccatttaaccctgagtggacacagcacatgtttcagagagcagcgggttgggggtaagattatagattaacagcatcccaaggcagaagaatttttcttagtacagaacaaaatggagtctcccatgtctacttctttctacacagacacagtaacaatctgatctctctttcttttccccacatttccccctttcctattcgacaaaaccgccatcctcatcgtggcccgttctcaatgagctgttgggtacacctcccagacggggtggcggccgggcagaggggctcctcacctcccagacggggtggtggtagggcagacacactcctcagttcccagacggggtcgcggccgggcacaggcgctcctcacatcccagacggggcggcggggcagaggcgctccccacatctcagacgatgggcagccgggcagagacgctcctcacttcctagacgggatggctgccgggaagaggcgctcctcacttcccagactgggcggccaggcagaggggctcctcacatcccagatgatgggcggccaggcagagacgctcctcacttcccagacggggtggcggccgggcagaggctgcaatctcggcactttgggaggccaaggcaggcggctgggaggtggtggaggttgtagcgagccgagatcacgccactgcactccagcctgcaatcccaggcactcggcaggctgaggcaggagaattcaggcagggaggttgcagtgagccgagatggtggcagtacagtccagccttggcttggcatcagagggagaccggggagaccggggagaccggggagactggggagagggagagggagagcagttgtgggtttttcatagatgcctttatcacattgagaatgatcctttctattcctaatcatgaaatggtgttgtatatttattaagacattaaatacacattgactagtatttatttgctttcccacatagaaaatattattattattgttattatttttcttggagacggagtcttgctctggtcacccaggctggagtgcagtggcacaatcttggctcactgcaacgtctccctcctgggttcaagcaaatcaccttcctcagcctcccgagtagctgggactacaggcgcatgctgccacacctggttaattttttgtattttagtggagatggggtttcactgtgttgcccagggtggtctcgaactcctgagctcaggcaatccacccacctcggcctcccaaagtgctaggattaagaaaatattcttaatactagtctttcaaagttttcttctcttattttctctcttctactttgaagggaaagcagggatcaacgtaagagtgcaataaatatcttttttgaaattctaaacactaaggttgaattgtcactaatttactttatttaaaaatcataaaggctgggtgcggtggctcacgcctgtaatcccagcactttgggaggccgaggcgggtggatcacgaggtcagcagatggagaccatcctggctaacacggtgaaaccccgtctctactaaaaaaaaaaaacaacaaaaaacaaaaattagccgggcgtggtggcgggtgcctgtagtcccaactactcaagaggctgaagcaggagaatggcgtgaacccgggaggtggagcttgcagtgagccgagattgcgccactgcactccagcctgggcgacagagcaagactccgtctcaaaaaaaaaaaaaaaaaaaaaaattataaaatgtggccaggcgtggtggctcacgcctgtaatcccagcactttgggaggccgaggtgggcgatcacctgaggtcaggagttcgagaccagtctggccaacatggtgaaaccccatctctaccaaaaatacaaaaattatctgggcatggtggcaggtgccagtaatcccagctactcgggaggctgaggcaggagaatcgcttgaacccaggaggcggaggttgcagtgagccgagatcacgccattgcactccagcctgggggacaagagcgagactttgtctctcaaaaaaaaaaaaattataaaatgcattgaaagtgggataatggaaatgttttcttgggggagtcacgtacttcatctgggttaacctgttacagagggagttagtctaagtgaatcttaaaattgttatcctcaaatttcagtgatcttttactttatagcttgtatgcttctatggtcccccagcaagaaatcttgtactcattagcagttattcccagttcttttccacacacactcccctatcccagctgtaggtaagtactagtttactttctgtttcagtatcttcacctattttgggtgtcttatataaattgaaatctataaattgtagtcttttgtgattaacttcatggttcatccatgttttagcgtatatcggtacttcctttctttttttttaaactatggcaaatcatataataaaattcactttcccaacaattttcaagtatatagtacaatattgccaacaacatgcacattgttatgcaacagatgcccaggatccccctatcctgcatggctgaaagtctacatccaccaaacacaacttcctacttcaccctccctctagctcctggcaacaaaccaccatttgactttctgtttctgtgagtttcactgctttagatgctttatataagtatgcattatttcatcttttgtgactggtacacttctcttagcataatgtcctcaaggttcatccttgttgtagcatatgacaggatttacttctttttaaaagactgaataatattctcttgtatgtatataccatattttgtttatctgttcatctgttgatgtacatttaagttgcttccacctcttgcctattgtgaataataatgcagtgaacatgtgtactgtggactgaattgtgttctcctcaaattcatatattgaaaccctaactcccagtgtgactgggtttgtagataaggcctgtaaggaggtgatgataaaggttaaataagataaggttggggcctaatccaatagggctggttcctttataagaagaggaagacaccagatcttttttctacactgtgggaagacacagcaacaacatggccatctgtaagccacgaagagagctctcaccaggaactgatggatagcacctggatcttggactgctcagataggtttatacgatctagtctgtggtattcagtagcccaagctgactaatataatggctgtgtgtgtacaaatagcttttcaagattttttacaattcttttatacagtgggaaaactgtattctatttatacccagaaatagaattgctagaacatgtagtagttctatttttaattttttgaggaacttccatattgttttccatagcggctgcaccatttttcattcccaccaacagtgtacaagggtcaaggattccaatttctttatatattcaccaacacttactttctgcctctgtctctctttctctctctctctttctttcctttctttctctctctctttctgtctctctctttctctctttctttcttctttttttttcaagacggagtcttggtctgtcacccaggctggagtgcagtggcgcgatctcggctgactacaacctccacctccctggttcaagcgattctcctgcatcagcctcccaagtagctgggattacaggcatgtgccacaatgcccagctaattgttttatttttatttttatttttggtagagactattggtctttgcccactaaattggaagatatattaccttgtaattgccttcagagcagggttttcctcctttagctcattgacatcttgtaccagataattttttttccagataatttctgtgtgtgtatatggaggagccatatgtgcattgtaagattttgccagcatccttgacaaatgttggtggtactaccgactaataacatagtggtacaaatgttagtggtactaccgacaaatgttagtggtactaccaccggttgtagtgacaaccaaaaatgtctccagacatctccaaatatcccctggggcgtaaaactgcatatcattgagaactttatggccctaaagaaagagatacagttttattctctgctcgctttcttttctgttagtcttgattatttgtcatttacaatatttaaccttgctcagcaaaattttaacctttcaaataaaagaagtaggttactgctttaaattattgctaaataattctcagggcaggtttttctaagtgaatttgaacttagaaacatagaatagagatggatgaaagtatcctcattttatttgtttttttataagaaaatttatttttgaaataatttggggcacatgtgcttgtgaagaaatccgtagatattgagagagatgaagtgttaaagatagtttaattcaacaaatttctaaaaaaataacaaaacctagagaaattatgtaatttgttttttgtgttggtgttggtgtatatagttacatcaaaaattttaaagactttagttagatgtgttctacatgtggaacacttttgtgttgaaatgttttgtggaggtcactagtgatttttagaacactatacatgtactaaaatgttctatgtaatattggatggaatgatccattgttttatttacccttctttttctctagaacttaactctacatttggaagtagtgtatcttacattttttaatttttaataacaaagccaaataatcttctcagtgaattagaaacttatttatttattttttgagatggagtttcacccttgtttcccaggctgaagtgcaatggcacgatctgagctcactgcatcctccgcctcccgggttcaagcaattctcgtgcctcagcctcccaagtagctgggattacaggcatgcgccaccatgcctggctaattttgtatttttagtagaggtggcgtttcaccatattggtcaggctggtctcgaactcccgacatcaggtgatccacctgccttggcctcccaaagtgctcggattacgggtgtgagccaacacacctggcctagacattttttaaagtgtagtaaatatgtgacatactggcaatgttgcatcaccatatacttgaaaatgctatccagatgcttttttgtataggagtcccacaagatatgcaaacatttttatttatttatttatatttgtatttatttatatatttaagacagagtctcccccatcacccaggctggagtgcagttgggtgatcacagctcactgtagcctcaacctcccagtctcaagccatcctcctgtctcagcttcccaagtacctgagactacagatgtgtgccaacatgcctggctaattttttaatattttgtagagacagggtttcaccatgttgcccaagctgatctcaaactcctgggctcaagcagtccaaccatctcagcctcccaaagtgctgggattacaggggtgagccactgcacctggcctatttttagttttttgaggaacctccaaaccattctctgtagtagttttattaatttacattcccaccaacagtgtataagggttcccttttctccagacccttgcagcatttgttattgcctgtcttttgccatgttgccagggttggtctcaaactcctgggctcaagtgatcctcccgccttggcctcctaaagtgttgcaattgcaggcataagccaccatgcctagccctacaaacataattttttttttttttttttttgagacgggagtcttgctctgtcgcccaggctggagtgcagtggcacaatctcggctcactgcaacttccgcctcctaggttcatgccattctcctgcctcagcctcccgagtagctgagactacaggcgcccgccaacacacctggctaattttttgtatttttagtagagatggggtttcaccgtgttagccaggatggtcttgatctcccgacctcgtgatctgcccatcttggcctcccaaagtgctaggattacaggcataagtcactgcgcccggccacaaacaattttatacaaagaatttgaaatttgaaaattaacacaggctgggcgtggtggctcacgcctgtaatcccggcactttgggaggctgaggtgggcggatcccctgaggttgggagttcaagaccagcctgacaacatggagaaaccctgtctctactaaaaacacaaaattagctgggcatggtggcgcatgcctgtaatcccagctacttgggaggctgaggcaggagaatgcttgaacctgggaggcagaagttgtggtgagccaagattgcgccattgcactccagctggggcaacaagagcgaaactccgtctcaaaaaaaaaagaaagaaaattatacattgttgaaataattttatttcattagatatgcataataatttttagctctacaattttatgttcgcttgtgtttttgagtctgtaaatcataatgatgggcctattgggcattcatttcaatatagtattagtgtaacagagcaaagagtatatgaatactcatgatcctaccacatttggggatatagtctgtagaccctttttgtgcccatgtgcacacactcacatacatttttttttttttgaaacagagtcttgctctgttgctcaggctggagtgcagtggtgccatctcagctcactgagcctctacctcccaggttcaagtgattcttccgcctcagcctcctgagtatctgggatcacaggcatgtacctaccacgccctgctaatttgtgtatttttagtagagacagggtttcaccacgttggccaggctggtctcaaactcccgacctcaggatccactcactgcgacctcccaaagtgctgggattacaggtgtgaaccactgcacctagccataaatttttaaaaat

SEQ ID NO: 30 - DNA, 3443 bp, Homo sapiens
caaccctccatttgaacttggatcttaattacaagcatatatttatgaaggagcccttgaagaaaaactgtactgagaaagggaaacatcagcagaagtccttctcccatagccccaaatactgatttcttttcacagcttacaggagtacttgtccttgctactgcaccactgaaattatagcaccttgaggaggctaatttaaagggttacaagacaaaacaaaaacaactataaaaggctaatatcagcccaagtgtgctttcgtgaagtaaagtcaacacaatttcagctctatcgtggcaggccttcgcctcctctgttctcagctctgatttgcatgtttcaggattacattacaatgcaatacttcccactcacgaagtcatagctttgttgaaaggattagtatagaaatgtgccaaattatttaaagatatctgaatagtgagcaaaacattatcatcagatgatacaggaggagaaaagtagctcagtacaacctgtaaaaaagctgtcacagaaatacctttctctctactcatgtggtatgaggagtttgcctatgtgagactattcaaaatatctgtgataattcctggaatcaaaaaatatttcaaatcagtttagctttactcaacttcttctcaatcatggtacaccaggaaagaaagagaaggatatcaaaacatgttctacgcgtctgaggttgacagtttctcagaacaatgtgtgcacaataaaattgaggcaacatcaggaagtaaatggcagagggttcactggagccatgaatggattgctggacagtgtgctgaggacctagcggaagttggagaccatgaatatacagcagcatcagtgtcatggatgggcagttttctctggcagaactccagggttttggatagaaaaggtcaacacctgaacaacactgagttgcggttcggctgagtaggtgcagcagaatgtccaaaggggtgagggagctgagagtatgggcaagagattggctcaatggagcacatggcttccactagcaagcaggaagagaaggtggaaaagagttgtcttgggtctggaaggggctaggtgggagaaaataaagccttaaaggccctagaggtcttgttgaagttgaaggacagatgcaggaggaataaatgagccaggagctggaggatgcatggtaatggtatggacaggacactgcaaacagaaatatcggaagtcaacagttctagggatcactttgtccaacacgcagtcgtgagcaaggctgactgaactggagtgggggtgaggttagaggcagctgaggggacacagccacagtgaggctggagagttggatggatctttaatagtatgttgcattgaaaccagtgtcaccaggacttagaggtggagaagaaaacaaaatcagacatgacagattttgaggaatgtggggatatgacagagtagagtttacggcaggaaaagctcccaaagagtacaattttttacacagatgcaaatgcaaaagaacaatagtttcaagttatattgggaatctagaagaattttccctccccccgccccacacacacacacttgctcacctagttaatttcataccccagatctgtgaccccagagactttttaaaacaaatgacctttctagacagggaagtagagaactacaatgttggtcctctgatccattagcaatattgcaaccttcatactgggaaaaatgaagcaggtagatatatgctaatgaatagacttccaagaaaagaaataaaaatcaaaaaggaaaaacatgaagacaaccctctgggacatttaaatttttcttttaaaggaagttgagaaataatataaaatcctgcatttcagtgaagaaagcaggttggtctcctctttacttctcagctccctctggtggaatactgatttttatggtatgccccgtgaaatcaaaagaccctagaggtctggccaaccttccacattccgagatataacattagggtgtcaggattggaaagagagagaaagtaatcagagaagggagaaacaaggaacacacctgtggaagaagcagcgagaaatagtgaagaaatatgattataaaagtctcacttgtatcacttttaatatttttattgcattaaacatagtctattaccttatattgaaatactgctaaattattaacttgtctttaaattgattttcctagtattgggaataaggtttcattcaaagggggaaagtacctaagacattttactgtagcttttagagaaatcactaatatttctctaaattctgctttttcaatcccaacaattattttcatttttacccgagaaacaattcacctgaggaaatgcactccttctctaataatgagaaagccactttgacagagtttgtacaaagttttgcaaagaggcatcaattccccctgcagtgacagacgcccgctgaaaatactatgggaaaaaaagcaaagtgaaatggtttagattggcctgttgggcataaacatcaaggtctgacaaggtcagtgactccagaagctacaacacatggcagaaaaacatgaccagggcagtctggctgacctctggctcctgaccagagaggaacaagagaagcccttccctgaagccaggtgagtcacggaagtggcagggccttgagtgagccactgcccttcctgtaaggagattgtgtaaaaagtgcccatatggctcctctgcagacagaacttttggacttcctcaacagatatttgcaataaaatccagcttctctctacatcacaccaaatcttctctagggtataaacatcccctataaatgcagagaaccaacaattgaacaaaatattccagtagtggcctgagtaggatccaatgtagtgagagcattactttcatattacttgaggccatggagggccagggaagcacatagaatatggaagcttaaaaaataatactaaggggtcaggcacagtggctcatgactgcaggcccagcactttgggaggcgggtggatcacttgttcgagaccaggctgggtggtctcgagagatggtgaaaccccatctctacaaaagcatacagaaattacccaggcatcatagcattcacctttactcccacctactcaggaggctgaggtgggaggatcccttgagcccgggaaatggaggttgcagtgaaccaagatcatgccactgcactccagcctgggtgagagagtgagcccctgtctcaaaaataataataataataaggaatttgaatagtgtagtggtctcaggaggtactacctatgtggtcttaggcaagttatatcctttatgggcctcagtttcccagtgaatactgtgatgacacctatcttaagctgtctgcctgaatcaaaggagatgtttg

SEQ ID NO: 31 - DNA, 14483 bp, Homo sapiens
tgtgcatttttactccctcaatctacacaaataaaaagaatttaacatttctgcaatgttaaatcctttacaactttaaggatttaacatttttggtagtgcaagtgtactggtgatcaagtctttcagcttttgtatgtctgaaaaagtctttttttttttaacaatatttttttgccaggtacagaattctaggttgacaactttttttcctttcagtactttaaagcaagatatctttcgccgggggtggtggctcatgcctataatcccagcactttgggaggctgagatgggtggatcacctggggtcaggagttcgagaccagcctggtaaacatggtgaaaccccatctctaccaaaagtacaaaaattagctgagcatgatggcaggcgcctgtaatcctagctacctgggaggctgaggcaggagaatcacttgaacccgggaggcggcagttgcagagattgcgccactgcactccagcctgggtgacaacagcgaaactctgtctcaaaaaaaaaaaaaaaaaggtatcttcttgcttgcactgttcctactgagcaatgtaatctttgtctttacgtaacatttaaaaatttttttacacaccaacatggcacatgtatacatatgtaacaaacatgcaccttgtgcacatgtaccctagaacttaaagtataataaaaagtatatatataaaaatttttttttgtttttaagattttcactgtatcactggtttgacaattttgattatgatattccttggcacagttttttccatgtaccttaactggtttgggtatgggcttatcatttttagtttggaaagttttcagccattatttttctctacatctccttcagggattccaagttttcatttactgggccacttacagtcccacagctcagtaatggtcttttcaaatatttttctcttttttcccctctctgtgactcattttgtacagtatctactagtatggcttcacctatattaatcttccatccagcaaagtctaatctgctattattttgatcaagtatatttttcacaccatactttgaagtttttatctctaggagtttgattcaggtatttttttttacatttttcatctttctacttgactttttgaacatataaaatacagttataatgactgttttaatgcccttctctgccaattttaacatctatgtaatttctgggttggtttgactgaatatcctcctcattatgggtcctgttttcctacttccatgcatgcctttaatatttgattagctgctagacattgtgacttttaccttgttgggtgctggatattttgatatttcttaaaattttgagtctttttttgggatgctgttaaattacatgaaaacattttaatctttttttgactcttgattttataatttgtttggcagaatggagccgtctaggctaatcataatctactattaagggaaggtcttcctgagtactcttcacaataccctgtgaattatgagtttctccagcatatttgatgggaacagatactattcctggacctatgtgagttccagacacacttccgtcttaccttttcagatgactcgataatttggctttggataatttcctcacatgtacatgctgattagtattctggagaatactcaaggggtagattctgtagatatctggggttctctctctttgcagctctctttactcaggtactctgttctatgaagtctagttcccttggtgtcacctgactctcagtgccatctccttaactcaaggattctaaagagcccttctctgttctcttccttgagctatggcctagaaactctttcaagacagtaagctggggtaattatagggcttgcttcgttccctctcagagattattgttctttgttgtctgatgtccagggtcttgaaaacgatttcatgcattttatctgcttgtttctttttctggttgtttcaggcaggaagtaaatctagtccctgttactccatcttggccagaaactaatgtcagaactttttccattgtctacctctttatggtaatcacagagggcctgatatagaagggtagtcttttcctcctctctttctccacagactccattaggttttaggtccctaaatccagattagcagaagcagaaagtaagagggcttatttacacttcctagactaagctttgctatccaattcaggttttaccattgctgtgttccagtggttaccagatacatgctcagctactaatatatttgtacttcatttccatttgtacagtagtttttgtttgtttgttacaaaaagtcctttcattttggatgctctggaggaatgaaagggtgaatgataggactccctaaatatcacatcaagcctctaacatcagttatccagaaccttcaaattttagaagtctgtgtgtgtatctgtgtgtgtgtatgtgtgtgtgtgtgtgtgtgagagagagagagagaatgaactcaggcacaaacaccaccaccacaatcacaacaaaactcgtgaaaagtaccaagatacactatgagtgcttggttcaaatgagggaataattctgatagattgaaatgtataaactgctaactttctccataaaattacataagtgtgaaagcacgggagaagcagtaagagaaaagaaagtagaggtaatcagcaaaggtgcaggtgattaaaattaatgacaggagtggtgagttattcccaaggcagaaagggaaatgacctttgaagacacataggagtagatggtcaagaattcaggtgggagaagagaataacaggtgacctgccatcctgtggtcatagaaagtcaaagatatggacatttctattgggataaaggtgctagcagtattattgtggtaagatcataagaggcaaatagtcaaatgctatatcttattggcttctggaggtacattagtagtccaacaaatgtaagaatgaataatcattgattgacagttacatatactctttctggaaggttcaaaatagtccaagttttacagtactattgcaaaagaagcaatgaacaagtcttattgacatagtatgggaaaaaactgatttaaagcagagtctccttcactactgactatacctctatggctatgtaactagaaaaagatataccattacttctatggtaaagccaatgcattaccttataccagcaataaatgtacacacacacacacacacacacacacacacaatatatgtgtgtgtgtgtacagttatcaatatcatgcattggaataatgtaatactgatatggtacagaagcttcataccaaatgtcttctgacatagtcatccactcgtttcttcagttcaactcggcgtgcatcagtgagttcttggagtcctcgccaaggagcaaatagtttctttttcttacggcacttcgctaggaatttaagcgcctggaagaaaaaaaattgaaggtttgtgatttttctcccctaactaatagaactattttctcactacaacatatggtagtgatcacattgcaataatgattaactctgagtgtgtataaggaggggaatgggactgtgacaaaatgcaggagaacagtgacttttaaaatatacagtcttctgtagtgctttttacaaggatatagtcacgtattatttgtgcagtaagcaatgaagaggaaaaaaaagcaatagattctagtctcaattctagtcccttataaactatgattctgggcaaggcacttgatctctagaggacaggttctatgtctatagaaaaaagggttcttaattctacacagcctagatgattgtaaacaccaaggagacagtatatttctgtctgaattccttctcatgtccttcagaatggactctggtaaaaagaaattttgtaataggcattatatgggacaaatttgcaattattctttccaattgttttcactctgctcatgtcttcgtagtttttattttcatcaaagttacatgttcacattgtttaaagcaggggtcagcaaatcatggcccacaggccaaatccagcctgctgcctgttttcatagggcttgagagctaaaaatgtgtgtgtgattttgtttttgttttttttgttttgttttgtttttcattttacattgttaatttaaagggaaaagaatatttagtggcacgtaaaattataaaagaatatttagtggcatgtaaaattatatgagattcaaaatctaatgtttacaaataacatttttttttttttgagatggagtctcgctctgtcaccaggctggagtgcagtggcacaatcccagctcactgcaacctccaccccgccaggttcaagcaattcccctgcctcagccccctgagtagctgggattacaggcatgcaccaccacgcccagctaatttttgtattttttagtagagatgggatttcaccatgttagccaggctgtgatctcttgaccttgtgatctgcccgcctcggcctcccaaagagctgggattacagacgtgagccatcgcgtcccacctctacaaataacattttattggaagacagccatgctcatcggctgcttttgtgctataactgaatacatgtgacacactacatgacctgcaaagcctaaaatattttattatatagcccttccctgaaaagtttgctgatgtaactctattgtttaatgtgtcagttttgtaagaattactagaatgcgattgtttaatttgtcagtttcataagaattactagaattcttactagagttacccacttaccctgtcccctgattcaagggcaacaatttaattcaggttattcttttgatatttagctccatctatttttctgtgatttttttttcagatataggtatcatctattgattttcttgtatgaaaggtatgaatttagctatctttcactgtttctactccccatccatcctatattattacatcataattttagttaaattaatgttcaatgtttacaaaattatgaccacataaaggctattcacttttgaacaatatagtacactataattacttttccttccttgcacatttttattttctctggaattattaattctcttttctcccatgctttgttttccatactaccgattatattttacaaactctgccctaattttctacacattaaaatacagcagccattctatcaaattcattttcttggacacattttctcgagcttcctgacctgctgtaatttggattgactgctctctataccttgggcatagctgtcatcctgtggtctccattcaccatcatctcggtgactacttttcatctttcccttgtgtttcttggattccatgttgccttccttctcaggttattccctcttatctaaaaatgtctttggtctgtccttatctttaattaataatttggttgggtatagaattctagttggaaatcattttccttcaaatatgtgacaatcttacttcaatactttttagcttccaatgttcctgtcaagaagtccttttgttcctagtatatcttacagtattatgaaacaaatgtagaagtgtttctgtcactgtattggacacttaattggtccccttaatctaaaattcatgacattcacttcttggaaatcttaagttatttgattttccatcttctgttttttcttgttcttgatttcaaatgtttggctgtttgacctcctagactggtagtcttttctatccatcttttttttttttaattaaagattctacctttttttctttttctaatgatatttcatatgttgaccaggctggcctagaactcctgagctaatgccatcctgctgccttagccttctgagtagctgggattacaggtgtgtgccactggcaaaatcttttttccttgctttctgtgagatttctttaacttttcccccacagtccttttattagtctttcagttttccctgtcaaattttattctgtgtgctccattttatacggtatcttggttttgtttcatatattacctttccttatctctctgaggatattaataacagattaaaaaaattttttccttatacctgcaatgtttgtattctatcaaatagttttattccatttgttttgtctttggctttccttagatattcagtgatacttatctttcagctgatatttaagagtgggcactaagaagcggtttagaaaatttccctagtactcttactttttggtattttttctaagacagggtctcactctgtcaccctggctggagtgcagtggcttgattatggctcactgcagcctcaacctcctgggctcaagtgatcttcccacttcagcctcccgagtagccgggactacaggtatgtgccaccaagcccagctaattttttatagagaaagagtcttattatgtgtcctaagctggtctcaaactcctgagctcaagtgatcctcccgcctcagcctcccaaagtgctgggatttacaagcatgagtcaccgtgcccggccttgttttcagtatggtacttgagttttcaactgtgcttgcatccttctgttgagactctcttctttctttctattctcccctttccttgatttttctcttttagcaaatttccccaatttttagctcctggagaaacaatgcctctgtttttgcatcaagtaagagagaaacagaaggtggataactgttctggcctttcttttcctgccaaggacactaataaccagttcttcctgagggacacactcattgaaaggatattcctactcctttatattacttttttttttttttgaggcagggtcttattcctattacccaggctagagtgcagtggtgtgatcacagctcactgcagcctcaacttcccaggctcaggtgattttcccccacttcagttttcagagtagctgggactaccagtacatgctaccacgcctggctaatttttgtatttttagtagagatgaggttttgcgacattgcccaggctggtatattactttcaatgaggctaatgaattatttcccatttttttcttagcaagatcagttgcagtgccaacagaaatgtaaggtgagtcatatatgtaattttaaattttctagtagtcacattaagaaaataaaaaatgggcgaaacaatatttactcagttatataaaacatacaacaatatacacaaaatattagtatttcatcatgtaatcaatataaaaaagtattactgagatactttacacttctttttcatgctacattttcaaaatctggtgggtattttacacttacaacacatttcaatttggactagctacatgtcaagttctccatagccagctacgtatgcttaacgattattttattgaacagtgcagatctctagtgtgtcttagaaaaggatacttttaggctaggcgcagtggctcacatctgtaattccagcactttgggagggtgaggtgggaggatcacttgagctcaggagttggagaccaccctggagaacacagtgagacttagtctctactgaaaaaaaaaaaaaattagctgggcctggtggtgcaagcctgtagtcccagctactgtggaggctgaggtgggaggatctcttgagcctcgcagataaaggctccagtggggtatgattgcaccactgcactccagcctgggagacagagagagattctgtctcaaaagaaaagaaaagaaaagaaaagaaaagaaaagaaaagaaaaggatgctttaaaaatatggcaaaatgtaccctttattgactattgccttgttttaattttctctatttttctatttattttctcagtgtactttcccatttttctttctcttttccttctttgaaagtaattcttggccaggcatggtggttcatgcctataatctcagcacttagggaggctgaggcaggaggatcactttagcccaggagttcaaggctgtgatgaactatgaacacaccactgtactccagcctgggtgacagagtgagaccatgtctcttaaaaaaaaaaaaaagtaatcctcttatttccttttccattttggctaactttgctttgacttcatcttatttttattaatgagatgcaaagactataaacatgaccttgacccatccctttttgctcttaaacagagactcattccttttcttagctagaggagatatgaggcaaatgtgactaatcttcctttcgtgccaatggaaagtataaaagccaaaacaactttgccttcgtagccttcagatatgttcctatgatgacccctacttttttctctaagaaatggtaggcaaaccaggatatttcactttacagtacaggatacttttacaaagtattggggtcatctaaatcaggcaaggtagtaagtcaacctaataaggacccagctatttctatgacagggaagactttaaaaaggaggtatttatgaggtaaaagtattagaaagaagccaaagcttcctccaaaggaagtgtctccaaccctaatatcaactggttaaccccttagatggctttgtttagcagaaagtaaaaatcaggagtacgtgtgatacagtgatggtgcaggattgtttgttgcagacacaatctgagatccccagaagagcctgaagaaggagtaggagacaggcatctcttcctgtttctctagtatttattctacaatgttttttggatgattaaaaaaaaaaaactttgtaaaaagttaatcacagagactgttcaaaatctgtcacagtagaaaactgaaattgacctaaaaattcagtaaggattgttaagctaaatgctataggacctgaaatcctaatatgaaagttaaccatgtataagagaacaacgggatgttaggaaaactggtcattaaatttaaaaaaccacctcgtactatgcttttccaaggcaacaaaatagtactatgctctagagagatcacagaaagattgctatttaagaataagaggccgggagcggtggctcacgcctgtaatcccagcactttcggaggccgaggtgggcagatcacgaggtctagagatcgagaccatcctggccaatatggtgaaaccccgtctctattaaaaatacaaacattagatgggtgtggtggtgcatgcctgtagtcccagctactcgggaggctgaggcaggagaattgcttgaacctgggaggcggaggttgtagtgagccaagatcgtgccattgcacttcagccttgcaacagagcaagaatccgtctcaaaaaaaaaaaaaaaatacaattctacaattaaaatgttataatgatctaaatatacctaatatctcatctgtgcattaaaaaaatcaaatatcacatgctgcacttgcacagaactttgtaatttacaaaatacattcccataaattagggtatctgatccacataacaactgagtgaaaagggtaagggtaaacatctattcatacatcaagcacatgtgatgagctgacaacaataagacttagctccttattcttgaagaactcacagcccaagtaagaagggaaataattaacaaaacaacattgcagtatagtaaatgatgtacaaggttctaaggcagtactaaggactgagtgtctaaatcagctcggccagaggtaaggggtttttcttttacaaaagaaaaaactaaggctcaagaaaactaagtgtcttgaccaaggctttacaacaggtaattagcaaagtcagttttgaactcatgtttttgcctcttgattcagagctcttttcactacattagactcactgctctttgaagtgtgacagctgctttatactctatgagagactgcctctgttggtgaaaatttttcctttccctgtaccctctccaatgtttctggataatcagtgctgatttctcttccatttcccgatagtgtttctccacctgacctaaaaagatgatagacactattacaacatactcactgccatgctttcttaagttctggaatcaggacaatgataataataatcttgcattctttttatttttgtcaatattgttcactaattttcccaattctactattttaccatggttctaagattttagaaacaaagctttcccagattatgcagcttcttcacagaaagaactcatataatatttttgtggtagagtaataagaaaatggctgaaaatccaatacaaagaacactaaaaaaaaaaaaaaaaattcctaagtacatgattaagaagtcattcagtaccaccagagggaaagggcaaaatgtgtgtatgtgttctctactctacatgcttccaaatttctcttaagtcactcagtcagttatacagatgactttctttttgctttcttggagttgctcagcatacagcccagggttcacagtatatatgtgacagaataaggcagtagaattgttaataaaaaggggggcgtatttggggaagtataagaaactgatataatttaatgatcaactggatacggaggtaaaagagggaaaggactctaggatgtctcaaatgggaaactgagtaagttgttggtgccattacctgagatggggaataaaggaaaaggaaatctgaggggtaagataatgactttggtgtttgggatgcctgtggatatccaggtaaagctggatccaataggcagttggctacagaggtgtgttattcaatagagtagaaactatccacaagtggctacttgggttaaaataaagtaaaattaaaattcaggtccttcagtgcactagccatatttcaaatactcaatagccatctctagccactggctaccctactggatggtacagatatacaacctttcatttttgtaaaaatttatcttgggcaattttgctctaagagcttaggagagtaggtgaagatggagaccagatttgagactgctcagcactcagctgagagttgagctgcagttatggatggataccccaggaagagaaaaatgacaggaataaggtgaggatggaaccctagaaaacatctatatttaatggagatgaagtgaaataaagggctagtgaaggaccctggattgaataacaagaagacaggtaaaataatttgaagataatattgaaaccactaagacctctcagaccacatcttcttattaatttcagcttagtctgtcaaaggcggcaagaagatgtcacaacatttgtactaaggaatgagttaaactctgatggcagaatgtaataatattccaactccttgtttcagttcaagaagtatctttgtgtctctaacagctatctttatgcatacatttttatgtttcactaaattatctgaaggataagaaaaaaaactggtggggagattgttcatcgtcaactaataggtctgaattgaaaaaacagtaaccgtttttgaactcagaagatctaataaagtttatctgaaaaacagagaaaaaggacaaaagtccaaatttaaaaaaaaatcatcacgtagctagaaaagttggtttgttaaaagataacctaaatattcttatattgataaagttgatactgccactcacctggatgaactatttcgagcatactcagctgcaattctcgggaaagtctcatggctctctgtctttgaagttgcaattgtaatttgaggtcctcttcttccttctgcctatttatctccagcaacatctttgatcgtttggatctgtgatggaaacagtgtgttatacataattttcataaatcatatgaaaaaatgcataacctcactagtaatcaaataaatgtaaacagaaaaaattttaagataatttctagtgttaataaggtatgataaaatagcttgtcatctgctgctgttgtgcaatctttctgtagaaatatttgaatatatgcattaaaagtctggaaaaatatttgaaatatataaataaaaagccttaaaagtgatgaccaattaattctattacaaataattttcttaaggaaataatcagatatatatgtaaaaatttatgttcaaaaatgttctccacagtattacaacagtaacaagttgaaaacaaactttgtctcacaacagcgagttggataaacagatactggttcattcacctgatgggatgggattctatgaactatgaaaacataaaatgttcgaagaatatttagtgacatgagaatatactgatgatctaatgtcaggtaaaaggaaaatcaggatatagaagaatgacatcaaaattgtgtcaaaaaacttacatttacttacacaaaaaaaaaataaaaaacattaaaatttcaagtgatttttactgcatgatgtaattacagttgatctttattttcttcttatgcctatttctcaattattgacaactgaacattactttcataactggttatgaaaattttcatgtgaccacaaacattttatataattataatttctgtattatctgcttttattcaccaaaatttctccttagccattcccatctagtttttgttgcttccaatatcactatgtaaggagactacaagtgtcagtttacagtaaatatactcaaaatgctttcagacacccacagaaaaagaaaacgaggataagaagaaaggcagaataaactacttagtttaccgctatagacttaatttgacatgtgtctccctcaagaacattttctcttagatcttttttttaaactgtattcttagaattaaactgtaaacaaatgtggtaccttggctatagctttgtactcttaatagtcagacttcattatagtatagttaggattattatgatttttcaactgaattttcaactcaaaatagtttattttgattttgataaaattttgtgtgcctgtggttgtttctcataaattcttccatcaattacaacttaaattttctctagctttctacttagggcagagtagagaatttatttgttttgaaacttctttcttatccctattatcaagggtagagaagacctcaaaagtgtatgtgtgtcaaaagattccagagaagatctagggctagttgaatagttctaagtgtctcttgctctttgtgaaagctggaaatgaagtaggtaagggcctctcccttcccaaagaatagctgatagcaacttgcctgttctacagaactccatcacctcaaaacttctgggttatacagcatgcagataataatgttttatctcttacccattcatagagggtaaaagagagcaggccctaaacagagcctccttttaaactgatttttaaaaaactacctctgtggccgggcgcggtggttcacgcctgtaatcccagcactttgggaggccaaggtgggtggatcacctgaggtcaggagtttgagaccagcctggccaacatagcgaaaccccatttctactaaaaatacaaaaattagctgggtgtgatggtgtgcacttgtagtcccagctacttgggaggctgaggcaggagcttgaacctgggaggtggaggttgcagtgagccaagatcgtgccactgcactctagcctgagtgacagagtgagactccgcctcaaaacaacaacaacgacaaaaaactacctctgtttctaacttctaattggctatagattataatgtctaatactgcattatcaatattttaaataccattttacactattagtatgaaaaacatagtaatcattaaaattgcatctgctagaatatttaatctgtcagaaaactgggtttgggaaacaatttaggcatgtaggctatcaaatatggcaaaaatgaaaagactatggagcatgaaggtggaagtaaagtacaaaccagaaagacaggacaaaagtgagatttgggccgggcgcggtggctcacgcttgtaatcccagcactttgggaggccgaggcgggtggatcacgaggtcaggagatcgagaccatcctggctaacacggtgaaaccccgtctctactaaaaaataacaaaaaaattagccgggcgtgatggcgggcgcctgtagtcccagctactcgggaggctgaggcaggagaatggtgtgaacccgggaggcggagcttgcagtgagccgagattgcgccactgcactcccgcctgggccacagagcaagactccgtctcaaaaaaaaaaaaaaaaaaaaaagtgagatttggtgatttaaatagggactaaattgtaaacaggtgtgcttattggattcatatgttttactttcatatctgaaaacatttattaggaactgaagtgattttgaatgtaattcccccatttattattaaataacatcgagttattttgttcagagtttctctaatcactcaaaa

SEQ ID NO: 32 - DNA, 1275 bp, Homo sapiens
ccttgtcaatttaggattccctatagtaggtttgcatataattgggtgtatttaccagggaactctacattatttgccgtacattatttgaagactcacttcattgaatttcagatcctattttcagatttctcaattcatgaattccaaataagaagtatttgtcttttgacaaatgaatacaaagaagaagtatttgtcttttgtgtatgcattttcagttattggtgactgttttaaaatttctgtagttaccctacttcattgctaaaatgaggaggggtttttaataaagtttttgaaaagtctgaacaatcagaattatatgcttttttctttaggatactgggaaaaggttccatagaacctgatgatttttaatgtgtttggttcatttaaacattttctaaacaaaaatatttctaattatactggtttctagtcacattccgtgatcagcatgttgaagatctgtaagatacagaatatacttttatttcatgtggtttgttacgagttattgtgatatcctggagacatacttctgttttaaaacagaagtatttttagatggtaattccagggaaaatacaattcattgtgtttattcaattttcacccaactttattaggaattttatttcttaggaattctttattattttttcttagaaatttcttagaaattaaattccttagaaataaaatttcttagaaattttatttctaagaattcttaggaattcttaggagttcttttataccatatgagctataggtatcttcaaaagttttaaaaaattaaaaaaatcttttattttgttaagtatgtttggcatatatccataagctcattctggcttttctaaaatagttaagtggctagaataccacatctagtcatgtggaaatttgcttattttctgtaatatattgatcctgaaatcacagaactgcacgtttagattgtttgagttcatgtagtaaagataattttttaggacattgtctttaatatatattacgtaaatgaaacagttgccatttgttccaactgattggaccatttccaaggcagatttcctccctgctatgtccattattatgattttcagtctagaatttctttccagctcttggactttttccaagatagagacaacttctgagcatctctttggtagtctctactgaattttgaaggtgtcagtcaagaagagttggatgacaggaggacttgtagcattcaggcaggcccccttaaatataacttaa

SEQ ID NO: 33 - DNA, 35287 bp, Homo sapiens
atttccagtgacttctttttactagaaagaccaggaattagttattagcactgaggccaagtagctatctgcttcttttagacttctggtaaatagaatgatatccaatcacaggattagtcatattcttggtttttttctgagaacaggaagttggtagctcagctggactgatatgtgatttattctttcaacagccacggccagatccagtgaaaaacaagctctcatgtctgaactgaagataatgactcacctggggccacatttgaacattgtaaacttgctgggagcctgcaccaagtcaggtgggctcactgacctggagtgaggattttcactggacacatgtggttgtgaaaactgttcaatcaggcttaaatcctccactctccatccccacacatggcagggaatagaagtcccttgaatggagctgactggtcccttgaattgatggaagctcattggtttttgagcaaaatctgttgccagtccagtcatagccattcatggctctttattaaaaaaaaaaaaaaaaaaaaaaaaaaaaaacttttttggtatcttatttttttctgtgccatatggtctgcaggacaattcatggcttttctgttcttcattttcatacccatctcctaacggcttttgtccccataggccccatttacatcatcacagagtattgcttctatggagatttggtcaactatttgcataagaatagggatagcttcctgagccaccacccagagaagccaaagaaagagctggatatctttggattgaaccctgctgatgaaagcacacggaggtgggtgcaaagagagatgttgctgtctatcattatcttacaggcatcacaaatggaaagacccatgtcctgatagatatcatgtctgcagattcagtgcccaaggtagcaagacttagagtcaaaccaccctgtccagtctttccatggtcatgcagagagatgcatgatgtctaaaggtgttttggactggggtgtcacatgggaaggccttgctgataggtttgaatgagagtgagttagaatgactctgggagctcttctgctatttacatgtgatccacttagacctataaaatgcagctctggccagggatgcttgagttctggaaccttgcaagaactgtctgtggatctccaagctcgaggtccttgctgaacctggacctataaatgacgtcaatgatagtgatccctactgcagaaatctacaagtggctataaagaactctgtaggtaagaaattctgtaagatcagaaagtacaatgaattcacttcataataaattacttggtggacaccaaatgggtgctaaattgattgggtagaaggaattgtatgcccaagccacatggccacacggctcaagttccaaccaaggcttgtgagttgaaaaactgagaaagaataatgacagacttaacgtagtgaattcttcaaactttaagtgtaatggacttacaggtccatgggagcacagccccactgtcttagatgtggctcttcaggatgtgcgggctcctgctaaggatgtgcagggaactggctctgaaaacaagtgaacagtagtcatcatggcagctgacatttgtggagtcctttgtatgtgccaggtgccatgacaaatattccgctagtctttcccatctttgtcagtgggatccattctacgtcttctgaaaagtgcttccttgacccccagatcaagtcattttccttacaagctattgaaacctttcttccttcacaacacagctgagtttgagttgatctgtgtatttattttgttttttacatttctttttttccctatttaaaaaatttttttatttccataggtttttggggaacaagtggtatttggttacatgagtaaattcttcagtggtgatttgtgagattttggtgcacccatcactggagcagtatacactgaacccagtttgtagtcttttatccctcacctgcctctcaatttttccccgagtccccaagtccattgtgtcattcttatgcctttgcatcctcatagcttagctctcacttatgagtgagaacgtacgatgtttggtttccatttctgagttacttcacttagaataatagtctctaatcccatccaggttgctgcaaaagccattaattcattcctttttatagctgagttacatatatatatatatatatgcacacctacacatacatatgtatagatacactgcagtttctttatccactccttgattgatgggcatttggggttggttccacattttttcaatatgtgaattgtgctgctataaacatgtgtgtgcaagtatctttttagtatgacttcctttcctctggtagatacccagtagtggaattgctgtgatgcatgtatttgtgcgactatttgattaatgctcatttccttgactagatcacctcatgtgaaaggtatggattggttttgcttttacccagttagctcccatgcctacctcagtacctggcacataatcatcatctactgaaagtggaatgaccacttcagaagggcaccctgggtaagatttctctttctgtttttacagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggtaaaagtgtctatactcactctgggtgttgggactttccagtggtttaatatgatacttaaagtatttagagggaagtgtatagggatggtaagtgaacctggcagcccacgtggtctctaaatgcaggtctgcacaaccagttctgtgacatgtttccaggtttgtggcctgtaaattgaaaagaataaaagctgacaatgtaacaaattttttaaactttaaatttaatagttttaaagaattttcttggtgtgttcctgcagtaaacattttttaaaaaaaataattatttattctgatataatgaacttccttttttattgctgtctttttcttttttaatgaaaatatggtgattgattttttttaatgcccttacttggcagaattacaagttggctgtcttatgttggttcctcaccttgctttttttcccttaagttttagaagtctctgatgtctatgagttcagtaacccttgcttttacttttcctaacattcaatttgtgataggaactctagagtagataatttgcagttatattttctggaccagtgtttctgttgaatgtattttgaaggtgggtctatctgtttttcaagtacatgaatatgtggcagggttaaattgatttataaactccagggagtccagctgatgcccagaccagatggatcacttcacatctgctcagggtggttcctccagagccctgaactggtcacagacatgaagctggaagtctgacattggcttgtcctgtgagcttgcctttttgggtctgagccttcccattagtcaatgcaaaaaagtgttgagctgccctggacattgttttggaaattattgatgtgctctgaatgttttcaggttcttaagtgaaaggtacaatccatttaaaaaagaatgtgtttgttttgcaaagctcagtacacaatattttccatttctgcggttccaagttccattcacttctcattgccaaatgggtgaacttccaagcgcttttaaaagattagccagtgagagttatcggaaccagtacttcctctcccctcccatattgttaaaaatagtttacattgcttcccaggctgggctggtggagttggcacgagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgagaacttctggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaactactttttcatgtagcttgtatgtgtgctccatgtatttcatcatggaagattttagtgtgtgtttatgtgtatgtgtgttttaaaggtagctgagatgatttgctaattatggttgaaaaaaagaaatttaggaggtaaacaaaataattatgtgtaagattggtccttgtggctgtgtgtgtgttttgtgtgtgcgtgtatgtctctgtgtgttttaggctgttcttttattgctataaataaatacttgagactgggtaatttataagggaaagaggtttaattagttcatgattctgcaggctttacaggaatcaagatactggtagatctgctcagtttttggagaggcctcatgaagccatgaagtcatggcagaaggcaaagcagtgcaggcacatcacatggccagagcaagagcaagcgagagagagaaagagagaggtgccacacacttctaaacagtcagatcttacaagaagtcacttactattgcgaggacagcaccagaaggatggtgctaaattgttcgtaagaaatctgtccccatgatccattcatctgccaccagtccccacctccaatactggagattacaattcaacatgagatttgggtggggacacatattcaaactatatcatactgaccctggaccctcccaaatctcatgtccttctcacatttcaaaatacaatcatccctccacaatagtcccctcaagccttaactcattccagcatcaactcaaagtccaaagtcttatctgacacaaggcaggtcccttccacctatgagcctgtaaaataaagaacaagttatttactttcaagatacaatggggttataggcattgggtcaacattcccattcccaaagggagaaatcggccaaaagaaaggggctacaagccccacagaagttcagaacccagcagggctgaaaactccaaataaactccattgactccatatcccatgtccagagcacactgatgcaaggggtggagctcttgggagggatggaacaccctgtggctttgcagggtttagcccctgcagctgctctcaggggctgttgtcgagtgcctgtggtttttcctggtgcagagtgcaggctgttggtggatatattattcatggaggatggtggccctcccctcgtagcttcacgaggcagtgccccagtggagactctgtgtggggacttcaaccccacatttcccctctgcagtgccctagtagaggttctctgtgagggctccaatcctgcagcatgcttctgtctggacaccctggttttttaatatatcctccgaaatctaggcagaggctcccaagcctcaactcttaacactctgtgcacccacaggctaacaccacatggaagcggccaaggtttatggctgtcacaagctgaagcagcagcccaagctgcacctgaactcctttgagccacagctggagctggagtcatagggatgcagggagcagtgtctcgaggctgcacagggcagtggaccctggggctggcccatgagaccattcttccctcctaggcctctgggcctgtgatgggaggggctgccatgaaggtgtctgaaatgccttaaaggcctttttcccattgttttggcaatcagcctttgcctcctttttagttatgcaaatttctctagcaagtggttgcccagcagccctctttaattctctcccaaaaaagcttttactttctctgtcacatggccaagctacaaattttccaaccttttatgctctgcttcccttttactttttttttattttaaagagatggggtctcactatgttgtccaggctagtttgaactcttggactcaagcaatcctctcactcatcctcccaaagtgttgggattataggtgtgagccactgcgcccagcctctgcttctcttttaaatataagtttcaacttcaagtcatttctttgcttctgcatctgactgtaggctattggaagcagccaggccatatcgtgaacactttgctgcttagaaatttcttccaccagatatcctaggtcatcactctcaagttcaaacttccacatattcctagggcatggacataatgtggccaagttctttgctgaagcttaacaagggtgacctttactccagttcccaataagttcttcattttcatccgagaccttggcagcctggatttcattgtccatatcattatcagcattttggtcacaagcatttaaccagtctctaagaagttccaaactttccttcatcttcctgtcttcttctgagccctccaaactcttcttatctctgcctgttacccagttatctttacagcaattccccattccttgataccaattttctctattaggctgtttttgcattgctataaagaaatacctgagactgagtaatttataaagaaaagaggtttcattggcacatggattctgcaggctatacaggcatttgcttctggagaggcctcaggaagcttccaatcatggtggaaggtaaagggggagcaggcatatcacatggccagagcaggagcaagtgagagagagacagagagagagagagagagagagagagagagagaggtgccatacagttttaaacaggcagatcttgtaagaagtcactcacttttgcaaggatagcaccaaggggatggtgctaaaccatttgtgagaaattcacccccatgatccagtcacctcccaccaggccccacctccaatactggggattacacttcaacatgagatttgggtggggacacatatccaaactatatcattgcgtgtgtgtgtgtgtgtataatttttaaaccagatatatgtttctgcatatctctttcctttctttcattctttctatcttttttttttttttttttttttgagacagagtctcactctgtcacccaggctgcagtgcagtggtgtgatcttggctcactgcaactcattgcaacctcctcctccctgattcaagcaattcccctgcctcagcctcctgagtagctgggattacaggcacatgccaccatgcctggctaatttttttgtattattagtagagatagggttttaccatgttggccagactggtctcaaacttctgacctcaggcaatccacccacctcggcctcccaaagtgctgggattataggcataagccaccatgcctggcctatatatctattttctaagatagaatctttgcatagtgatattcatctgtgagatctaaacattctacaaaaaaattaagaaaatatttttggatgtgttctttgggcatgcctctgcaacctgatgatttcctgctgcctgccagcaccaatacatttaatttcttttctgcagactcagaagtcaaaaacctcctttcagatgataactcagaaggccttactttattggatttgttgagcttcacctatcaagttgcccgaggaatggagtttttggcttcaaaaaatgtaagttcaaggaacacagacctttttagacccagatttcagtgagtggagtgtggacggagatgctaggagatagatgttggaaaggccattaataacaggggcctcttacttacctgtctctctccttcatcccctacgcaggtcagggagtctgaaatcatcaggcatctactcttctctagagctttctctctgttgggagtgggtggagtgagaacctgggagaaggccagccctttatatccaggcagacagctccaagtgccaccatggatcagccagtcttgcaggggtgatgctattcagctacagatggcttgatcctgagtcatttcttccttttccatgcagtgtgtccaccgtgatctggctgctcgcaacgtcctcctggcacaaggaaaaattgtgaagatctgtgactttggcctggccagagacatcatgcatgattcgaactatgtgtcgaaaggcagtgtacgtcctcacttccctcactggtcaggctcatcctccttcactttaatctctaaagtcaggtgttgcttctagagattcggtgcctgttttttaaaacatcaatagatttcaaggggtcagtacactgccttggcagcagattgcccaggtttgagtgccagctccaccacttacttaatttggatttggggctagatacttgactgttctgcccctctgtctccctgattgtagtgggaggtgataatagtacctatttgctgagttgctatggggattaaatcaatgaattcatgtaaagtgcttaggacagtgcctggcatatagaaacagcactcaataatgttagctattttatttatttatttatttatttatttatttatttatttattttctttttttttgagacagagtctcactctgtcacccaggctggagtgcagtggcgcaatcttggctcactgcaaacttctgcctcccaggttgaagcaattctcctgccttagcctcccgagtaggtgggattacaggcatgcaccaccatgttcagctaatttttgtatttttagtagagacagggtttcaccatgttgcccagactggtctcgaactcctggcctcaagtgatctacctgcctcagcctcccaaagtgctgggatgacaggtgtgagccactgcatctggcaagtgttagctattaatatgtcaattgcgtgtatgcatggacaagcatgcattcccaaggatggtgtctttacattttaagcttttatcagattttcaaaagccatctgtgacccctaaaatagattggaaccatttgggtttatgtatcttggaggcacagtttccttaaagatactcattttgttgtctacttgaaccattcttcccatcccttccacttctcagcagatgacatagctccctgtggggatatatctgctccctgtaggtacaattccaaatcacctcactgcactggatgtgagacagcttatggcagctgctgcttccacctagagaaagacatgggcctgcatccatgctgtgtgtgattcatgtactcatgtggccgtgatagctgtaatcggctcatagatcattggatctgttcttagttttgttcccaggaatatctaaaaataggaaactggtccattcagggcttacaccttttgggtgaaaattcaggattaatgtttttggatattattcctttggaggacataaaaggcaatattgaccattcatcattcatctagtatttattgagcacctactatgtgccagggactgagagttcagtaatgaacaaaacacatgtaaaagacactcaaatgggacaagataattagcacaagttattaagagcccaaggggaacccttttctatttccactgctgtggatcatcagtgagtagacatgggtttaactgtctccctccttccttgcagacctttctgcccgtgaagtggatggctcctgagagcatctttgacaacctctacaccacactgagtgatgtctggtcttatggcattctgctctgggagatcttttcccttggtatgggcctgacattgctgcttatttgggctgttctgaaacaccactggaaggaaaatgtgttctttcaagccccaggatgtagacagtgttaagataacctggtgtgaggccagtatgctgcagccacctcaaaccacatgttgtgccttattgtgtctgagataggcccatgcaggtggagatgggggtttttgttgggggttgcgtcttactcctggcctctgcccctcctctcctttgggctatgccagagtgacttcctcccactggaagtggtcccaatgacattcgcatcccagctgctttttcattttgggctttgggtcacatgggttcacccatggagagtgggccctccctcacctggtggcgattgatgctcaggtgaaaaggggtacgtggcgggaagggcagggctctcattcctggttgtcattggccagtcttgacaacccaggtgctgaacaacccaggtgccctgggctatccggtgaggtccctaagagaaggatgagccataaccctgacatctggatggttcatctggggagatgagacttacacacttagggataaacagtgtgctgctgatttaaaattgtaatttgagtcttgagtaaagagaaaggagtcctggaatagtgtgggaaggcttcagagagggaacttaacttgacctggccttggctttgaaagtgtgaaatgtttcatgaatttatctgtgatcaggatgtaatagtaaagtgtgtcttcctgccccgtctcctttttcatcctagttctccctccatggatgatcacaatggatcatcccccagtggcttaatggagtcctgtactcccttaaaagcagagaggccacaactttgatttttgctttagctatttgaacatacctggtgaaaaagactctctgggttttaatgattcagaatttctccttgcttttctagttcattttgtctgtgttgatccagtagtcatacacattgaaaaacacttgaacgcttatttctaaagatgtagaatttttgtgatggtacttggacttgaccaacctggagtcctaattaaacttaaggtttgagctggtctctgaagtcaaggagatgatgacactgaattttcttgaaaaaaccagtgcttcaaggctataggatctgaaaggttttctaacagtgttctatcatgccaagtgtttcagcaatgcactgagcgtttgttagtcctggtgttttattgtttggcttttaggtggcaccccttaccccggcatgatggtggattctactttctacaataagatcaagagtgggtaccggatggccaagcctgaccacgctaccagtgaagtgtgagctccttccccatcccgggggcctgtgttcacagtctgtgggtctagggggagggaggggccctgagacttccccctgtgcccactcttgagttctgtccccacagctacgagatcatggtgaaatgctggaacagtgagccggagaagagaccctccttttaccacctgagtgagattgtggagaatctgctgcctggacaatataaaaaggtgtgtttggatctgtgggtggaaaggtctggataaagctggaagttataccagtgagctgtgctgttccgcagttctagaggagcattttcaaaagaggcaaaagactgtgtgatccagtggctgggcttcatggcggtgctccacgagaccctagtagcaatgatgaatgaaaaccctccccttcccgtggggctttcctttcatcttatatgtacagtacctgtaagcactattctccagatgtttgagtatcagaagttagtgtgcagttagaagactcagggcatccatggccattacatcactaatttgagtgcacttaaatccatgcgaaattggcttttaccagcggactggaaggaacaacctcagctgttatctgtggcaccagctggttttttgtggaatgggaagcattgttcaaaggaacaaatgtaatttcttggaaccaggcaggatatgtaaatgaatgaaacaactttctgctgaggtgttgagaggaaaactcagacataacctcagtttcttagattgagattagtccctgtgtagactttttatacttatcatttttcttccttcttctcaaggaggaatagtgttaggagattgtgtgccgaactggaagttaaatgcttctgtctgttaattatctcactgcccactacaactttcacaggtgaggcagtgaggaggcagaaggaaattaaccctcagttggtcaaagatgctctgactggtggaaatgtgttggtgggaagagattgaagttattgttgaaaatagggtcttttcacatccaatgttagacctctccaatgtttaaggatcatgaaggctttgggtattatccacccaatagaaggcctcactgcctctctatgggacccatccaagccctggaaaggcaacgtgatggggaccagaaggattctcagttgtagctactgacttggagaaggggctactggtatcttagcacctaatggcagaagctctttaccattggtggccccttcttcatgttctatgtctctggggatagttgacatgactctccttcaactaagtcccacatcttccaggtagtttggagatatgtacagttaaataatagtaagttctgagtgtctctattcatttttgaggtttggttgttaacacttgattaaatatgttcaatgaatgtttatagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacaggtagctgtgggggcagcctcggtgtctcacctttcccctcccctataggccctgaaggagaggacccattttcccgataatggtgcactcccggttggtaaatatgtactcagggacaagttgcagaatcctcaggaggtccacgtggttttgaaaatgcttcccagatgattctaatatgttccccctggggctgggagagggatgtgcatgttgtggggagagggacatgcttccctggtggagaatctttgagctaaattctcaggtaatttgatcaaattgatacagaactgtgattactgagatcatataagcctctcctgccattgtcttaaatagtcattgaactggggaaaaagtgaagagaggcgggactgggtcctttgacgctataccctacctgtgaattggaatcacctgcagagatttaaaaactgctgatctacaagcctcacccaaaacaacaaattagaatccctgggggtggtggccaactgctccctggctgatttgtttcttctttcttttaaattttgtattatggaagatttctaacgtgtgcacaattcacatagtatagtgagctgttcagtattcgtcacccagcttcaatgactatgccctctgccagcctggatgcacacatggccatgtctgtctctcctcagcctcctctggattgtttggaagcaaatcctagacaccttatcatttcacccataaatattccagtgtgtgtctcttaaagataagggctctattttaaagaagaacaacagttattaaaaataactacaatgccgttatctcacccaaaacagggacaataaatcgttaaggcatcaggcagccagttaaagttcaaattatctcacaaatattatcatactccattaaaaagtgggcagaggacataagcagacacttttcaaaagaagacatacctgcagccaacaagcatatgaaaaaatgctcaacatcactgatcactagagaaatgcaaatcagaaccgtgatgagataccatctcacaccagacagaatggttattattaaaaagtcaaaaaataacagatgctggtgaggttgtggagaaaaggggaagcgtatacactgcttgttgaagtgcaaattagttcagctattgtggaaagcagtgtggtgatttctcaaagaacttttaacagaattaccattggatccagcaatcccattactgggtatataaccaaaggaatataaatcattctaccataaagacatgcatacgtatgttcactgcagcactattcacgatagcaaagacatggaatcatcctaaatgcccattgacagtagactggataaagaacatctggcacatatacaccatggaatactatgtgttgataaaaaagaacaagatctgagataccatctcccaccagtcagaatggctattatttaaaagtcaaaaagcaacagattgtggcgaggttgtggagaaaaagaaacacttttacaatgttggttggagtgtaaattagttcaaccattgtggaagacagtgtggcgattccccaaagacctagaggcagaaatactgtttgacccatcaatcccattactgagtatatacccagagtgatgtaaatcattctattataaaggcacatgaatgtgtatgttcactgctgcactgttcacaatagcaaaatcatggaatcaacctaaatgcccatcaatgatagactggataaagaaaatgtgatacatatacaccatggaatacgatgcagccgtaaaaaggaatgagatcatgtcctttgcagggacatggatggagctggaagccgttaccgtcagcaaactaacacaggaacagaaaaccaaacaccacatgttctcacttataagtgggagctgaacgatgaggacacatggacacatggagggaaacaacacacactggagcctttcaggggttggggattgggtggaacatcaggaagaatagctaatggatactgggcataatacctgggtgatgggatgatctgtgcggcaaaccaccatgacgcatgtttacccatgtaacaaacctgcacatcctgcatatgtacccctgaacttaaaaagtggaaaatacaaaaatgaaattaaaaaaagaacaagatcatgtcctttgcagcaacgtggatggagccggaggtcactatccttagcaaactaatacgggaacagaagaccagataccgcatgttctcacttataagtgggagctaaaactacgagaacacatggacacaaagaggggaacaacagacaccagggcatagttgagggtgcagggtgggagaaggaagaggatcagaaaaaatacctatcggatactgtgcttattatttgggtgatgaaataatctgtacatcaaaccgccatgacatgtgatttatccatgtaacctgcacacgtgcccttgaacataaaataaaagttaaaaaaaaattatcatacacttgttttgttctgtctgagatccagataagagtcacacattgcacttggttgctatgtctctgtaagttcactatgtctctattttttgccctcttacatattatttgtgaagaaaccatagtgtttgcctgtggagttcccacaatcggcattttgctgattacatccttgaagtgtccttctcaggtgcttctgtcttctctatgtgttgtaaactggtagttagtctaggaacttaacctgactcaggttagatctttggcaaacatgcttcatagatggttctgtgtgcttctgtcaagaggtatgcactgtccagttgtctgccttttgtaacattatcagtcattgggtgatcattacctagaatttctttttttttttttttttttgagatggagtctcgctctgtcacccaggctggagtgcagtggtgtgatctcagcttactgtaacctccacctcctgagttcaagccattctcatacctccgcctcctgagtagctgggattacaggcacatgccaccatgcccagctaatttttgtatttttagtagaaatggggtttcagcatgttggccaggctggttttgaactcctgacctcaagtgatctgccggtctcggcctcccaagatgctgggattataggcatgaaccacctcacccggcctagattctttaactcagcaccaaggtggagctaatgcccaggcaggactgagaatcactggctgacgtggtcagatggaggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaatttaggtataatatgtagacagcccttgtttatttgtatggactgggtaattttgaaagtatggcttttctattttgttttagaatatgttatgtgatttgaagatgggacacagtggcccatcagtcttcggttttttattatgctttgctcaggccagtttttataacgtgtttatatctcttgagcatacggtgttcctccaagttttgggggtctgcgatggaacttcacgggggtcggggaaggctgggcagtgaatctagggctctctgtctcagatcctttctcaatttggttactttgtgtttgtgggctctgaataatatttgagttgtaagagggttctgcttttatataaagttagaaagtcacattggaataaataacatgagaaaggtgcccagaagttttctagggctacaacaggctgagctgcagaatttgacacgccaggaattgaactttctcagttgaagttcacgttcaagttaagtaacttgtgtggcatcacacagctagtaagtggggggaccattccagacctaaggctttctgactccagaactcccctttcagccacttctctagtacgtaaggagccgtcacctgggccctcaagttgggggttggtgggggggcatttgatgtcaagagagaggggaagagggcattccaggcaagtggcaggagatcctgagaacacagtttggatgctcaggaggcttccgggagagcacctgatgggcctggctgcagcttgcaccctgatgggcctgacttcaccccctgctctgccttcccaggcctttggatcaggcattgcttatgttctcttccactaggattgagtagggaaagtagaaattcttgcagcttgtcagtaactttgatgaaagacccagcagaaaagcaggaaagctgaagagtaaaaatgatgggtggaccttggttttccacgtggcctaccacagcatgtcaggcctgggggcagaatcttgccatactgtgcagcccaaatttgaatgccaaaggctttcgtttgtctctggggggccacagtctaggtctagttctgtgcaggagttgtaatatttgctcttctctccctcctccagctcgcagacctctgaagagagtgccattgagacgggttccagcagttccaccttcatcaagagagaggacgagaccattgaagacatcgacatgatggatgacatcggcatagactcttcagacctggtggaagacagcttcctgtaactggcggattcgaggggttccttccacttctggggccacctctggatcccgttcagaaaaccactttattgcaatgcagaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggcattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgtgtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagttatactaaggtttcagcatttttgtttttagtttaatcataagaattaaagcaatcctgttctatttactttcttagcaacatttgtaggactctatattaggccttttttttttttttcctgagacggagttttgctcttgtcatccaggctggagtgcagtggcgtgatctcagttcactgcaacttctgcctcccgagttcaagcaattctcctgcctcagcctcccaagtagctgggattataggcgcctgccaccatgcctggctaatttttgtatttttagtagagatgggggtttcatcatgttggccgggctggtctcgaactcctgaccttagatgatctgcctgcctcggcctcccaaagtgctgggattacaggtgtgaaccaccacgcctggcctttattaggcttttgatgaaccaatagaatatctaaggtttaagacattatatgagctagattgttccacgacacagtatttgacttaaagatgattggcacttggctcatctttggtctcatcatttttttgattgttcatctttatcctgtggtgttttcttcccctgcataaggaatacaggactgcagtaactctgtacaacattcaactgtcgtaaaagtgtaggaagtaaaatgttaaattatttttttcaccgtgtcttcttccctgtccctgtcctgtttccaagaggcagagctgcaccacttggtgtgtcttttaaacttccagttccctttgtatgcatctgtgtatatatattcccatacacacatctctacgtttgcttcatatctacctaaatgggttctcactttatgtaatcctttgtaatgttcttttttctttcctttttaaaactatttattaaagcagttttagatttgcagtaaaattgagtagaaggtacagagatttcccctgtgtgccctgcccccacaccaacatagcatctccatcactaacattctccacctttgctacagctgatgaacctacattgccaaatcattacccataacacagtccacagttctgttttttttttaatgctgttttagcgatctctgtgaaaagtatacagaggtattagctccattggatcccattatgtaaatgtaccataatttatgcaatcatggtcttgtaaaatggatttatagtttccagttctttgctattaaaatgatttcatgaacatttttgcaacatacatatttgcatacaaaaatgtgttttgtagaatggatttctacaaatgaaattgctaggccaaagggtgtgcagaaataaattgatgttgagctgaagtcttcagataggattgatacataagttcttgagcatctgcacgtgaatcactggctttgcacattacatgcagttttctagtctctgctccacattgcccaggaatcatggtcttcaaaataggattggaagaaatacaatgtggtaagtgtgagagaatgtgggttttgtgttctgaagcatactgaagcaagtgactttaggaatttaaaaaaatggtacaactcaccttattttgagctcacggataatgaaaattgattatgttgttaataatcagaatatagcaccctattccaatataactccttatccaaattcaagtagcctgcagctggaagcatacttctttggagttaaacctccaaggagggattcagaagatcatggcatatgagaggcaagactagattgcagctcaggacagagcagcatgcagcagcttgcattgtgaattttagctccagatcctgagaggacccacagaccctctgatggaagtggacttctcctgcaggaccggggagacaccccaaatattgtgagttgccccaaatgcggaagtggtacagggagaccctcctctaccgaatgcgcagtcccactggagcagctgaagttttgcttgcgggagaagtttctgactttacctcaagctgagtcaagttagagagctgagcaaaatacaggggtggaggaagcagcagaaaggccctgggagctcgctgagtccccaagcagcccattcctgcctggcaccacagggatccatagggagggtggccagaggagcagggggtaaaactccacagggagaaggaaatctctagctgaactttgtaacaatttgaaaggggcaagaagcttcctggccggaactcgggggagggtgcaaatcgggcgtacagacttcacaggcagaggaagaactaaagcccttttctctcccagctgggaggaggatagccttgggcaagttttcaagcccatcttgccctctgcctggaaacagactcagggctgttgaggtgggcagggtgggagtgagacaagcccttcggtttgtgggggagctgggtgaggcttgtgactgccggctttcccctacttgcctgacaacctgcatgactcagcggagacagccataatcctcctaggtgcacaactccagtgacctgggaatctcactcccatttccccccagcagcctcagcaagacttgcccaaggagagtctgagctcagacatgcctagcctcacccgcacctgatggtcctttcctatccacgctggtagcataagacaaaggacataatcttgggaattctagggctccgccctccactggttcctctccacactactatagctgatgcttcctgggaagtaccaccttctggcaggaggccaaccagcacaaagataaagcattaaaccaccaagactaaggaccctcatggagtccattgcactgtccaccacctccaccagaacaagcactggtatacatggctgagagacccatagatggttcacgtcacaggactctgtgcagacaacccccagtaccagcccagagctgggtagactaattgggtggctagacccagaagagagaaaacaaccactgcagtttagctcataggaagccacatccataggaaaagggggagagtactacatcaaaggaacacccagtgggacaaaagaatctgaacaacagccttcagccctataccttccctctgacagagcctacccaaatgagaagaaaccagaaaaccaaccctggtaataggacaaaacaaggctcttcaacacctcccaaaatcacactagttcaccagcaatggatccaaaccaagaagaaatcctgatttacttgaaaaagaattcaagaagttagttattaagcttatcagggagggaccagaagaaggtgaagctcaatgcaaggaaatctaaaaaatgatataagaagtgaagagagaaatactcatggaaatagatagcttaaggaaaaaacaataaaaaattcaggaaactttggacacacttttagaaatgtgaaatgctctggaaagtctcagcaatagaattgaacaagtagaagaaagaactttagagctcaaagacaaggtcctcagattaacccaatccaacaaagacaaagaaagaagaataagatgcagccataaaaaaggatgagttcatgtcctttgcagagacatggatgaagctggaaaccatcattctaagcaaactattacaaggacagaaaaccaaacaccacatgttctcactcataggtgggagctgaacaacaagaacacatgaacacaggcgggggggaacatcacacatcagagcctgtcagggggtggggggccgggggagagatagcattaggagaaacacctaatgtaaatgacgagttgatgggtgcagcaaaccaacatggcacatgtatacctatgtaacaaacccgcacattgtgcacatgtaccccagaacttaaagcataataataaaaaaaagaaaaaagaataatatgaacaaagcctccaagaaatctggaattgtgttaaacaaccaaatataagaataattgttgttcctgaggaagaagacaattctaaaagcttagaaaacatacttgggggaataatggaggaaaacatccctggccttgtgagatactagacagccatatacaagaagcataaagaacacctgggaaattcactgcaaaaagatcttcacctaggcacattgtcatcagattatccaaagttaagaccaaggaaagaatcttaatagctgtgagacagaagcacaaaggaaaacctatcagattaatggcagatttctcagcagaaaccctacaagctagaagggattggggcactatcttcagcctcctcaaacaaaacattttatcggccaagaattttgtatccagcaaaactaagcatcatatatgaaggaaagatacagttgttttcagacaaataaatgctgagcgaattcaccattatcaaactaccactataagaactgctaaaaggaaccctaaattttgaaacaaatcctggaaacacattgaaacagaacgtctttaaagaataaatcacatagggcctgtaaaacaaaaatacaatttaaaaagcaaaaacaacaaacaaaaaaccaaaccacagaggcaacaaagagcatgatggaagcaacagtacatcacatttcaatactaacattgaatgtaaatggcctaaatgctctacttaaaagatacagaaccacagagtgggtaagaattcaccaactaactatctactgccttcaagagactcacctaacacataaggacttacacagaattaaagtaaaagaatggaaaggggcattttgtgcaaatggacaccaaaatcgagcaggggtaactattcttatatcagaaaaaaacaaacaaacactttaaagcaacagcagttaaaagagacaaagagggacattatataatggtaaaaggccttgtccaacaggaaaatatcacaatcttaaacatatatgcacctaacactggagatcacaaacttataaaacaattactaatagtcctaagaaatgagatagacagcaacgcaataatagtgggggacttcaatactccactgacagcactagacaggtcatcaagacggaaagtcaacaaagaagcaatggatttaaactatactttggaacaaatggacctaacagatatatacaaaacatttcatccaacaacctcagaatacacattttattcaacagcatatggaactttctccaagatagaccatatgataggccataaaataagcctcaataaatttaagaaaattgaaattatatcaagtactctctcagaccacagtgaaataaaactggaaatcaactctaaaaggaatcttcaaaaccattcaaatacatggaaattaaataacctgctcctgaacgagcattgggtcaaaaacaaaatcaagatggaagtttaaaaattctttgaactgaatgccaataacgacacaaccaatcaaaacctctgggatacaacaaaggcagtgctaagagtaaagttcatagccataaatgcctacatcaaaaagcttgaaaaagcacagacaacctaaagtcacatctcaaggaactagagaaacaagaacaaacaaaacctaaacccagtacaagaagaaaataaccaagagcagaactaaataaaattataaccaaaaaaaagataaatgaaacaaaaagctgatcctttgagaacataaataaaatagaccattagcaagattaaccaagaaaagaagagagaaaatccaaataacctcactaaaaaacaaaacaggagatattacaactgacaccactgaaatacaaaagatcatttaaggctactatgaacacctttatgtacataaactagaaaacctagaagagatggataaattcctggaaaaatacaatcctcgtggcctaaatcaggaagaattagatatgctgaacagaccaataacaagtagtgagattgaaatagtaattaagaaattataaaccaaaaaaagtccaggaccagatggattcacagcagaattctaccagacattcaaagaagatttggtatcaatccttttgacactattccacaagatagagaagaaggaaccctccttaattcattttatgacgccaacatcaccctaataccaaaaccagggaggacacaaccaaaacaacaacaacaaaaacaaacaaacaaacaaacagaaaaaacactacagaccgatatccttgatgaacatagatgctaaaatccttaacaaaatactagctaactgaatccaataacataaaaaagataatccaccatgattaagtgggtttcataccagggatgcagggatggtttaacatatgcaagtcaataaatgtgatacaccacataaacagaattaaaaacaaaaatcacatgaccctctcaatagatgcagaaaaagcatttgacaagatccagtattgctttatgattaaaactctcagcaaaattggcatacaagggacataccttaatgtaataaaagccacctatgacaaacccatatccaacataatactgaatgaggaaaagttgaaagcattccttctgagtactggaaaaagacaaggatgcccactctcaccacttcttttcaacatagtactagaagtcctatccagagcaataagacaagagaaaaaaataaagggcatccaaacaagtaaagaggaagtcaaactgtcaccgtttgctgatgatatgatcatttaccttgaaaaccctaagtaaggactcctccaaaaagctcctagaactgataaaagaattcagcaaagtttctggatacaagattaatgtacacaaatcagtagctcttctatacaccaacagcgaccaagtggagaatcacatcaagaactcaatcccttttataatagctgaaaaaaaaatacttaggaatatacctaacaaaggagtcaaaaaacttctacaaggaaaactacaaaacactgctgaaagaaatcatagatgacacaaacaaatagaaacacatcctatgcccatggatgggcagaatcaatattgtgaaaatgaccataccaccaaaagcaacctacaaattcaatgcaacccccatcagaataccaccatcattcttcacagaattagaaaaaacaattctaaaattcatgtggaatcaaaaaagagcctgcatagccaaagcaagactaaacaaaaaacaaatctggaggcatcacactacctgatttcaaactaccctgtaaggccgtagtcaccaaaacagcatggtactgttataaaaataggcacatagaccaatggaacagaatacagaacccagaaataaacccaaaaacttaaagccaactgatctttgacaaagtaaacaaaaatataaagtggggaaaggacacccttttcaataaatggtgctgggataattggctagccacatgtagaagaataaaactggatcctcatctctcaccttatacaaaaatcaactcaagacggattaaggacttaaacctaagacctgaaactataaaaattctagaagataacactggaaaatccctcctagatattggcttaggcaaggaattcatgaccaagaacccaaaagcaaatgcaataaaaacaaagataaatagctgggacctaattaaactaaagagcttttgcacagcaaaaggaatagtcagcagagtaaacagacaacccacagactgggagaaaatcttcacaatctatacatctgacaaaggactaatatccagaatctacaaccaactcaaacaaatcagtaagtaaaaaacaaataatcccatcaaaaagtgggctaagggcatgaagagacaattctcaaaagaagatacacaaatggccaataaacatgtgaaaaaatgctcaacatcactaacgatcagggaaatgcaaatcaaaaccacaatgcgataccagcttactcctgcaagaatggccataatgaaaaaatcagaaaatagtagatgttggtgtgaatgccatgaacagggaacacttcaacactgctggcaggaatgtaaactatgacagccaccatggaaaacagtgtggagactcttttttttttttttttttttttttttttttttttttttttgagacagagtctcactctgtcacccaggctggagtatactggtgcaatcatggctcactgcaacctctgcctcctgggttcaagtgattttcctgcctcagcctcctgagtagctgggatcataggcacctgccaccactcccgagtaatttttgtatttttagtagagacgagtttcatcatgttgaccaggctggtctcgaactttctgacttcaggtgatccacccacctcgggctcccaaagtgctgtcattacaggtgtgatccactgtgcccagctgagattccttaaagaactaaaagtagaaccaccatctgatcctgcaatatcactactgggtatctactcaggggaaaagaagtaattattcgaaaaagatacttgcatacacatgtttatagcagcaaaattcacaattggaaaattgtggaaccaacccaaatgcccatcaatcaacgagtggaaaaagaaactgatatatatatatacatatgcatatatgagatatatatgtatgatggaatactacacagccatgaaaaggaatgaattagcagcatttgcagtgacctggatgagactggagactattattctaagtgacgtaactcaagaatgggaaaccaaacatcgtgtgttctcactgatctgtgggagctaagctatgaggacgcaaaggcataagaatgatacaatggactacgggacttgggaggaggcatgggagggggcgagggataaaagattacaagtatggtgcagtgtatacttcttgggaagtgggtgaaccaaaatctcacaaatcactactaaagaacctaatcatgtagccaataccaccagtacttcaaaacttatggaaaaataaaataaaaacctccaaggaactagctgtaggtgggatattggctgtatctcagttccagctccaggaagaagacagatcattgggaacaagaaccctgctgattaaacaatagctgcctaatacggcagcaacacagggtactccaaacttgcttggataattttgtccttttaaaatgtacaattctacttcttaatacaatgcagacaactccatctactttatctagtcataataaaatgaaaatgacttttactcttcgaatacttaaaacttgttcaaagattctttcacatttacttcttttgattcttacaaaagaagggaagacattttatagatgaggaaaccaagatagcacaagacaaatgacttttaaaaaattgtgtaactgaatactgacagcactaggattagaaactgcaaaaatactaatgccagtgtcatttatactacaacaaaccatgggaaaaggaagaggtacagaaaaatatctgcgctcagaagtaggttgcttgcttcttgagatatttcaaaagacaagtgatgagctagtcagcctgtggaactattctacacgtttgtaatcagaacaatttcttttcagggtataatacaccagttctaataatgggtattatgattttaatagctatgtgcttcacaaaatgcagttcaggaaaatggctaagaatatctgaatccatcataaactaggcaattttccctgggataacagtgatagaaatgtttcattatctctcgttctaaatacatgtaaggattaaatccaactacattgttatagcaaaattaatatactgtgtttataacagacacaatttttcaccccctcccattaagatatatgtgaaaatacatatgtggctttaattagcagattataacattctgttccacgcagttagatacatagcacctgtgtcttaaagaataatgaatatattctccaaaatctattcatctatgggtaatgtttccatcactcacactttcgtttacatataaagtgatggagacatcaaggacacatggtctcacatggcagagggagcatatttgctccctgtttctggtttataggctaattggaattttaaaaagatttgccacattatgctggcagatggtattttgctttatcattattcatgggtattaatgacttccctctggagcatgtgtatcctgtctattttgaatttcattacatttcatgctgactgctctgaacagaatcggatccagtattttctgtgtggtgtttgaggtgcagattgtgtggctggtcaaagttttagacttgattaagaattaagtaactctttgaaataaagaaaacctttttggtctctttcctgagtattccatcagacttctcattttgttcagcttgctatcccacagggttgcatataatatcaggtgtatatgaaggcaattccagagtagattcgtctttcattaccctgagattattagacatcctttctttctttctagaaagactacgacttggtttcctaaaaggagaaaatgcatgagaacacgctgtaataatccagtcacagaaagtcactttttattaattccttcaacaaatatttattagagaacagcctcctctttgtttagctgatctctgaaatgcgtaaatgagacagctggtacagttgatttcaaccagctaattacctgagggaaacactacatcatagagaagaaaactgtggtaggtggaggccacagtccttccttagagtgaaaaagtagaaagccgatggagtaggataaagaataaagcttactggagccttctgataaaactgaagcattcctgcaaccagagaacacaaagtatggttgcagaatttgagaacagggaactaagtaaggccggggtaaccatacctggtagctttacttctgcagtccctgtctttgctttaattccagatactttcatggccaccttcacatccatcctccctaactattcttcaatgttattgagctcggcactgctttaggtcctgaggtttggtaattaatacaacagacaagattcctctctatcatggaagaaagagagagtccctctctggagcagagggcagatttgcttgaagtaggtcctgaggtttggaaattaataacaacagacaagagtcctctctctatcatggaagaaagagagtctctctctagagcagagggcagatttgcttgatgtgcaatataataaagatgatgtctccttctgggacaaacgtttgtcaggtttgcttgcagctcattataaaagattggggtttcctaaatgttgtagtttttagtgcacttatatatacattgttaacttatttataagttatatatttcatgtttttagctgatcctattgtaaatggtatttttaaaatttctatttctatccagtttatggaaattcaattgaccttatcttctgcaaccttgtatattccttagaattttagatgtagacaatgttaactgcaagtaaagacaattttgcttcttccttcccaatgtggatgtattttatttcttctgcttactgtattgcactggctatgaactccagtacaaagtggaatggaaatggcaaaagccacatccttgcttgattcctgatattaagggggaaagtattcagtctttcaccattcaatatgatgttagctatagacttttcatggacattgttcatcagtttaaacacgtttctttctgttcctagtttggtgagaggtttttatctggaatggatgttgggatctgtggaaagtgttttctgcatctcttaagattatcacataattttcattttttcatttcttaatacaatcagcctttgaatctgcaggtttcacatctctggattcaacaaactgtgggtgaaaaatatttttaaaaaacaaataaaaaataatacagcaatacaaataatacaaataaaacaatctagtataacaattatttgcatggcatttacattgtattaggtagtataaataatgtagagatttttaaagtatacaggaggatgtgcataggttttatacaacgccacatcattttacataagggacttgaacatcctcagattttgatatctgcagaggggtcctggatccaatcctttacagatactgagggatgactatatggtaaattacactgactggtttccaaatgctaaagcaattttgcattctccagttcacaccatcttagttatgatataatacgtttatatattgctagattcaacttactaatgttttgttaaggagttttaactctatgcttatgactgatattgacctgtagttttctattcttgtcatgtttttgccttcatttggtaacagagtaataatggcatcacagaatgtgttgggaagtttcctccttttctattttctggaacagtttgtgtagaattgatatttcttccttaaatgtttgatataatttaccattggatccacctggacctggtaattttttgttgaaagtttataaattactagtccaatttcgttaatagacataaggctattcaggataattaattgattaattaattactttttagtgatgagctctccctctctcatccaggctggagtgcagtggcacaatcatagctctgcagcctccacctcctgggttcaagcaatcctcctgcctcagcctctcctcagtagctgggactacaggcatgtgccaccatggtcagctaatttttaattttttggagagacagggtctcgctatgttgccagggctggtctcaaactcctggcctcaagcagttcccccaacttggcctcccaaagtgctgggattacaggcatgagccatcatgtccagccaggatatttacttattcatgagtaagatgggatagtttgtgtttttcaaggaatttgttgatttcatatgttattgaatttattagcatgaagttgttgatgacattattttattactcattactattgtaggatctgcagtgtcccttcattcattcatgatactgacaatttgtgtggtctctctttttcttttgatgattttgcctagaggcttattaattttagcgataatttcaatgaatcagcttttggtttcattgtttatctattccctattatttgtcccattttatatcattggtttctactcattattacctctttccttctgcctacttaggcttaatttgttatttttcccttactttcctatggtagaagcttatataatttatttgaaatcatgatttttctgttttgttttttttttgagacagtctcactctgtcacccaggttggagggcagtgaacgatcttggctcactgcaacctccagtcaagttcaagcggttatcctgcctcagcctgtcaagtagctgggattacagatgtgtgctaccatttctggctaaattttgtatttttagtagagacagggtttcaccatgttagccaggctgttctcaaactcttgacttcatgtgatccgcccgcctcagcccctcaaagtgctgggattagaggtgtgagccaccgcacctggccaattctttctaatacaaggatttaatgctatgtttccgtctaagcattattttagttgccttctacaaattttgattaaatgcagtatggtagataattcaaagcattatcagactacaaaggaaagagcttttagtcaggctaggagaagttgaagagaagcatttgagttgagttttgaaggatatttttttctagtcagagaagaaggtaagagtattctaagccaaaagaacaataagccataattcattaattgatatttctcttataagatgggttcatgaatatttaataactataatctacagatagaacatctctttgaaaggcagggatggagccagtcattcccataaaccaaaagtgatgatggagctgcaaggttgtttggctcttgaagtcatcctcttgagctgatctcattttaaatgagaatggtattggtccaatatagagttaaaacaaaaattctcacatgtgaaattcttggatattgatcagaataaaaacaaaatgaggttcaaatggaagcaatagggtagtggtctggttataactctcaggtataggtacaaagtcatttagatacatatatttatcagagagatattaccttggacactccagctttctatttatttctacagccataagatccttattgtatcatttcttaccctctgctgcagatgctgtatatatgactgagtagattggctcactgaacatcttttctaaacattgccattattacttttttctaatgcaagtgttggaaatcaatgtactcaaattcccttgcagatggaattttattctggccagtaagatgtaggtgcaatttcttgggaggacttccttagtgcactgaaaaagtaaaagcttgaggaaaaggttctgtctttctcattttgctcttcccatttctttctgcctggaacttagaattactgcctggagttgcagcaatcatcttttgaccatgaagttaaaaattacacactgaaagtggcagtccaggagacagaagacaggcttttaaatgacattcttgcataggtgcattagccctgacctatctacctctagattcttttttgcatgagaaaaatacatctttaggcgactattttcagttatccattctttgtaacaaataacatttgta

SEQ ID NO: 34 - DNA, 52428 bp, Homo sapiens
caccttttctcagacttaaaagcaaccaaatagaactttttattcacagacttccaaacaaaatgagaattaagcaattaaatattaaatacagtgggttaaataattaaatattaaacacagttcttagaggttattttatctaatgtttcatataaatatatacactagtccccaaataattcaattctacaaagattagaaatataatataacctagtcattatttttctgatatattcgtgttggaattatttatagtagttcactgactccaaaagaatataattttcttcctaaaattatctatgtaatatattttttcttaacattcataaaggtcaatttatttctaaagtaattttactatataaaagttctcaaaagggtttccataaatataatcaacaactttcataaccatcatgaattattgttccattttactactgcaataataaataatacatttatacttcaaattaataattattttattagtaaatattagttattttagtaaatattagtacattattttattagtaaaaattagtaaattggtccagtgcagtggctcatgcctgtaatccgagcactttgggaggctgaggtgggtcaatcacctgaggtcaagagtttgagaccagcctgaccaacatggtgaaaccccgtctgtattaaaaatataaaaattggctgggcctggtggcagacgcctgtaatccaagctacttgggaggctgaggcaggagaatcgcttaaacccaggaggcagaggttgcagtgggccaagatggtgccattgcactccagcctgggtgacagaagctccatctcaaaaaaaaaaaaattagtaaatttttattttactaaataagatacttattagtattagtaaaataataactttaattttactaataggtttccaccccattacctatattttaaagtgggtaatgagacattaacaataaatctgaagtgcatattcttgctccttttttgtatcactgttatttgcttagatatgatgacagtatatgtgatcacatttatctgatcacattcatcacacgcctgttggagatgacagaaatattgcagcaggcatttggctatttggactttcaaagaataaaaccaaagatgaacccaaatattagattttgaccaaatgccaaggtctataaccaaactttgaaacattcttaaattaggtctatccttggcaattgtctcccagatcaccataagagttgggcagtactgctccaacacaaaattaacaaaaaatcacttggataagtagcactccttgactcaatgctaagggcttgaaaatatgacttgattgacttgaacaatgtgtgcctatctatatgtgttccctgaggccaatgtatgttacttgaatgctgtatttatcttagtttgcttgctatgtactgtttttcttttacagtcattttaatttttttaggtgttaaagtgaactataaagttgtagagttagctttattaatgtaccttctataatgagaaatcgaagctttattttttaacccaagcaacagtaatatattgtttatttttaatatattgtttatatttctctgctgacagaaaaaataattcttaattctgaagcactatttttaaaagctttcactatcagttctcacggaaccattacttggacaatttttgaaattactaacagttattttttaaacccagctctaagtgattactctgtctcttgctttttggcgtatatagaccaaggaatattttttcttttttaaaggcagcattcaccctgatcgttgacctggattgttttaaatgctaggttggcacggctcagtaagtattgtagtatctttggcagtcattaagccatagacccaacaacctgttttcagaagcctcactagagagtgaatggaaaaacctcatgctattgtatgtggctttaggcacatccattttaaacccggcatttgtgctccatatcttgccctttgacctatttggattcatgtgggaatgtgacctctgcttgaataggatgatgacattttcaaagaagctgtaagtatctttaatgaatatttagtcccaagatcaaaatagttgtaaatatcctctagcctgagtttaaatctcaggtttatgtttatgtggtcgaggcagggtatttgtctctaattgtacatagaactttcaattttgatgcattgcttagcttagttgctgtaataaattccaaggacttagatgtctttaattcacttgccagtaagaaatgcaattgctgtctttcaggtctttgcctaccctagcatattcataaagcacatccattgagaagacacagaaataataagacaatgggaaaattttccagaagttaatgaaaaaagattacataaactgacaactggaaggcaacatttaacactgtactagaaaaacattcattgtcaccagaatctgttctagaactgactccctcatatcctgcaaaaacaaacaaaaaaagctaatattctaggtattgcttttagctttcagtgtataataattaattcaatgtcaatatctaaatgtttaagtattttacttagctatatttagaaaactcataaattttttccccaacaaaaaccaaacaaaccacattagctagtttattgtattttccctttggcttattttttctttaacttaataattatttattttctgagaatttttagaatagattgaataatttaaattttttgcttttttcctggttccaatttattgatataaaaccattttttgttcatagtattattgattttttaaatatctttctgtactaacagaattttagaaatatctacacttccatttttagacaaaaagaatcaatttggagaaatattgataactaagtaaaaccacaaagatccaaaaaacaaatattattttaaaaacctgtagttttgaaacaaagtattgttgattattttttaagaattatcattatacatttaagaaaacacttggtggacaactttttcctcaaaaagcagttttgacacaaggatacttatattttcaaaaacaaaatgatatacaattaagaaattaaattttttttagaaatatatatttctggaacatatttatatatttatatttgcactttcaatgtattttgtttaaataagttgatttctttatttctctctctttctttctttctttctttttctctttctttcatttccaccagaaatcttaccaaaaatcagattctggtacgattgtgatcaagtagtataataaagctaatcgtggcttgcagaaatcgaaactctgcacctggacccattagtgctaccttccaactaaatgagccaacacaatcagcccagctaacatgtaaatttggaaatactgtgggaaaattgtgttcctgaggcaaactggtgtagtgcaaaggccacagtctctggggtcaattacaagcataattgtgtagatttctgcctccctcaaattctaagtgtttaaccaggataatttattcttatatttaaaatagacatttaaagtaaacatgacaggcaggccgggtggctctcacctataatgccagcactttggaaggcgaaagcgggcagattgcttgaggtcaggagtttgagaccagcctggccaacatggtgaaaccccatctctactaaaaatacaaaaataaaaataaaaaaataagttgggcatggcggtgcatgcctgtagtcccagctactcaggggactgaagcatgagaattgcttgaaagaggctgcagtgagctgagatcacgccactgcactgcagcctgggcaacagagtgagactctgtatcaaaaaaaaccaaattaattaaaaaaataaagatgacaattcagaatttgaaaaaacacatcatatatcaaaaacctagaacaaaatagtatgtagtagattgtttacaaaaattagttcccatgctgttacatgtctaaaaactggcaaagggtggctacagcgttaatatgagtcattaattaaagtttgtagcactatatgataccaataatgacaacaataacattacctctactaggaagacactaagagaaggaggaaaaagggaaagaagaagaagaaaaaaaaacaagtagaaatagccgggttaactgttagtcactttcaaaaaataattttggatttttctaaatggttttcatctaatactttgccttctgtattactggtacacaattagatcaatatggaattttggggttgtattattcttctcgggctgccataacaaaatatcatagatgagtggcttaaatatgacattaattttctcatagttatgaggactgggagtccaagatcaaggtgcctgcagggatgctttctggtgaggattttctccttggctcataagcagtcaccttctctctgtgtcttcacaggacctttcctttgtgcacatgaagagagagaacgctggtgtctcctctacttataaggacgtcagtcctattgcatgccacccttatgacctcatttaaccttaattacctccttcaagaccatatctccaaatgcattaacattgggggttatgaatatgaactttaggggcacacaattcagtttataacagggatagacagcagaaaggggggtcataggtgacaatttagttactgcaaaattaaggaaactagttagacatgaatatagtttctctaatgcacaattatttaccaacctcctgttctcacaaaggactattatttaaaggcttgtcacatattgttttgtttcattgtatcatttgcaaataataggccctttaaattttcatttttaatttaacttgagaaaattaattaacttaagagaaattagaatgtcagtaaggaatttctcattggcttcccatagctgacaccaacatttgcaaaatgacctttttctcccgcattttaaaatgataatttccattggtgtttattacctttatctccaaaagctgtggtgctattacacactgccagtcaaaagctctcattgccgtatggaaaatgtttgattttaatgaaaaacctggataatcgttattggatgacttagcttgactagtgacagtagcagcttcatatcacttgagatagtgtttttctggaccaactttgattttaagttgtctgtgagggctctttaacctgggtggcaaatattgtgcatgaatcataggtgtgcagctcagcccccatggactccactgctatactctatgctgttgactgctaagtctcagtttctactacttgggagattttcttccttggaagagaaaattgagtcttgactgttctacacccattttctatcccctcatgcatttaataaaatttgtatccagcgtttgatgaagatgtagttattatagtagttcaattatttctcctcctacatattagtgtttactgcatattttactcaactttaacagcaaactgaactttatcaccatcttaattagcccgaaattatgaaatgattttcttcttcaaatattgatttgtgtctgtaatgtagactgagtgatcagaatgatcaatgttcaactcaagcagctgatatttttaatattctgttttcccatagaattattacacacaaccctgatgattatgagctgagggaaaaggtttttaaaatttttttaaattaatccattattgtgatgccttaaattaaattattttgaaaataaaattaagttttgccttattagaaactgagatttaaaacatttatgttaaaagcaatattgagtctttgagattctctaatctgaaatttatttgattaattgctaatcagttttagatggatctaaaactctgcagctgattatgtctggagattgtaatgaggaattgtaatatggttgcctagaaactgtattattgacaaactgaaatattaaggtctccataattttaagattcagtgaacaatgaaagtgcctgtgggggctgcagaccccaggaagataattatcagggggttgaatctgagactgtcagccaaactcagatccaattgagatataataaacctgtcttgtaaatatttactgacatgatttttataggaaagttaccattatattctaaagctttaatacactaacatataaattaaacttttatttgggatatgccattttcgtctaacttagctgttttctttatgttagtattgaaatcaattcatagcctcagccatgcagcctgatgcttccttcttgttactgagccctatactgacaaatataccaagcaactaacagccccaccattctcctaggaggaacaagtcattaatgatggtggcagtaaagattctatgtcctgctaccttattttgttagaagctaaagtatttcttcttatgttgcaataatataaaagactatttggtgcctttaatttattacatttcaatacaaaatttttctactaaaaaaaatactttaaaaaaaagttggagaaagctaatgagcttcaagtcctggagttctcagtcactgataaagataataccattattgaattgaaacagctgtgtgatttagatcaggggtcagcttttagctcttcactcagctctcatatgagggtgaaaagaagagaatggaattaggcgtgatgtgagttcccaccaacacaaattttgcttgattctgtccttttaacgacaattgaaccagtagatggcactatgtatttcagtgaaaacagtagactttcagtgccatagaaataagcaattaattgctgaatgtgaaaatgagtgaaatgcttcacatctgattgtgagtttcccccagttgatttgtattcaaataccttaaaggaacatacagtcaacacagatttccttatttaagaatgaagaagcatacttgcttctgggactttgtgtatgtttttaaaataatgatgtacagaaagacaatacatttaaaaatgttaatttgagtgttctgttcttagcattgcaaatctaaagtacatgtatatacatgtatttgtgtacaatatagttttaaatataattaagtcacttttatataaatagaaaattgttttccaaatgcatcagccaagacaaccatttttggaaacaagacaaagatctttgcagaccagaaatggaactgaaacagtgctaaatgagacagaacattcagcttgccaggatgtggggccagaagtgagcctttgccaccaaaaaatgttgatcctatgggatgatggaaactaaatccatctccggtgggataggggacagagccctcttcactgtttaacaccaaagtctttcatttagggggaagaaaactctggaaaggtccctgctgcactggctggaggaggaggaagtaggcggaagcttctcagttaccacctgagtgaaactgcctactagttcaatgactagtctgagatattgttaacatcagtcactgaggcacgggaactcaaaatcaccagttctgcactggttcctaggcagaagtaactgtaaaacttctgctggagactggagggatgaaattgaaatggaaacttccagtcaatattagcctgcaaaccaatattcctgaccatatgaggaaaatttaagaaagacagctaacactaaacaattaataaaacattctattttagctttaaaagagaggaacagaattcaaaattttaataattattttccggatttgattaagtatataagtcttaattttggcaattcattttgagggctaagaaggaaaaataaaaataagtctaccagacacatcctactgaaacttcagaatatcaaaaataaagaaaaaaaaaagacacccttaaatctatcagaggagaaagatttccacaaaacaaccgtaattaaactaacggtagtcttctcaggtataaccaagtgtgcccccaaacaatgataatttacctttaaagtgctgagggatgccagttgtccacccaggattctattacactgtatagagtatgcataattatgctgtaaataagtaattatattttaagcaggagggaaaggaaaatatattttcagatacacggaaactaaaagagtttactaaccatgcttttccagaaagaatgaccaaaagatgtattatagcaagaagatgaaacctagagaaaaataataggaagcatgaaaaaatagtgaatataaaaactggtaaaatatgttggcaaatttaattaactactgatgacaaaataaaagatttagagctacaaaaggtgaaactgaaatacatgtcaataaaaacagattcgtttgggcagaatggggattggggtggtaaagccaagatccttgcctgctctgggaggaagataggtgtaaggaatatgtattacaaagtatatatccatttaaggagtgaagaataaagagggaaagtagagaaacttttgaaatgcataggaagaaaagttgaaaaatgaatggaaagaacccactcagaacagtgactgcctctaaggacggagggaaaatcacaacgcagggagtgagagggaggcttcaagttatgtctttaacttttacacattaaaagacaaaatgatacaaattcaatatgccagaatgttaatatttgtttgttgaatgtgggtagaagttatataggcgttctttatcctatttgccatacttttcaggttgactgaagcattgcgaaatgtaaaataaatgccaaggggggaaaaaaaggaaaaaaatcatctcaatgtaaattaatctattcttccactttcttaggccctgctgctgaagtttgagatataaaatatgtacctagagctaatataatggagatccctgaaaaagttttcctaaaaaaataaaaattaaaaaaaacacacacacaatgaaataaaaatgagaggtaaaatctgctcaattccttgtgtatattgtcagtttgttttacctttgaaatccttagttccatgttcattttacacttgtttcaactgattccagctaattaagcagattatcttggggactgtgctacacacacaagtttatctgcctgtgtaagtgcaacttgaggacctttctgcagtgctaaatttgccttaggaaaaaatactggaagaattgtaattctgtatttgtgtgtatgtgtttctataaaccacaaaatctaatcggactatttgtggcatttgcaaaaacacctacgtcagcagtattactagtgaagacaagttagccttctctcaaatttaaggcttacatgatacacatgactagtttagaacatagcaaatttaaacctgggcacactaaaagacattaggggtgactcttaggtaacagattttatcccagtaccatacaccctctagttccgatatgaatgagatttttagaatttcagcttgagtaaaaccaatcaataattctgccatggagggaaaaactaccttgtttattttcagaggcagccacaaattatgcttggaccctagacaaagtgaaaaaataacataaaagcttctaatgccaatatggtttgaaaggccttatgggaaaaaattaactaggataaataaataaattttaaaaaatcagtggcctgactcaaaatgacagattgagcaatgcacattcattcacttttctgccagccaattctactgatgtaacagaaagaaaatataattatagggaataaacctgaaaaacaaggatgtttttcaacgctaggctagaaattgtgaaaaattctagaagctagaaagtagacaggatcaaatggtaaaaaaacaaaacaaaacaaaacaaaaaaaacaaggacagagaaagctacagccagaatgtacgcagtgacaaggtattggatgggaaagggcagcttatttcccagagaaattccatgttcagaataaacaaaaacataaagcaggaaggacgtctagaacaacaaccaggattattcagcaaaggctgctatcaacacagtcctccaatttaaagggtttacattgtgttaaataggatttataaaataggagttataattagacatgtcctagataacttttagaaacctaatgtgttagtttcctagaactatcataacaaattaccatgaactgagcagcttgagataacaaatttattctctaacagttcagaaggaaagaagtctgaaatcaaggtgctgattcactactgctgctccctcggaaagctttagggtaggatccttctttgccctttccttctggtggttaaccagaaattcttggcattccttgacctgcagacacatcactccaatctctgcctctgtcataacatgacattttccctgtgtgtgcctatattcaaaattcccttttcttaggattccagtcattggattaggttctgccctaattcagtatgaccttctcttaatatgattatatctgcaaaaactttttttttttccacagagggtcacatttgcaggtgctagagattaggacttgagcctattttaggagaaaagttcaactcctaacacctaagaataaaaaagctccaaaatctttcagaatgaccatcactaccaacaaaaatataggttacctgtaaagaaacaaaaattaaatttgcaatagccttctcatcaacaacacagcataggagaataaaatggagtcaggtcttcaaagtattgacaagatatagctttaagctaaaatactataccaaaaacaaaaacaaaaattattactcaagttgaggacaaaatgcatacttttttttttggtatgtatatcatctaaaagttagcccgttggacaaattgccatttctttgtggacccaatcgccatttcccatcttttttccccatattgcccatgtataattccagccaatgataagtggaattttgccataaggattatgggaaagtttctgatctactgatacatatgctactcttctttttctcatttttccaactagaaagcttgcctaagatctataatggtatctcttctgcaactatcaggagaagaaaattgtagacatagtggcctgatatgtagccctgaaccaagtatagcagccatctacatctagtcttctagttacaagaaccaaatacattcctatatctaatttactgctataagggtatcttagttgtaggtaaagatgtccctaattaatacattaccattagatcctttttgaaattactattttagaatttactccccaaaaggaaaagagaatctaagagaaggataaaatggaaggcaaaaaatagtgatgagcaagaaatcagtaaatgtatagttaacattatgcaagtgttgattgaattatgaacaaattagtaacaattttgaattcaaatccaagacactttcaaatatgtgaggtggcaatttgggagagtagcaaagtacaaatggcataaggcttttgttgtatttggaggattaatattaattgttgttatgtagaataaaatacaagtttaattttttattaaaaattaatatgatcactaaaagaataagaaatggatttaagttctaaaacaatagagagaaaagcacaataagtaaaaaattattccaacgaaggtagaaaaagtagaacaggaaaacaaaatcatgctgaattaaaaaatataaaagtgcagaaaaaatttgaaacattatcacttcccataataaatgtttggcaagttactcaattttttgaagaagggttaatcacacttggtagtgtatgaaatacacagctgcaagctatttgcaggagcataataatatgactttattacaaatgtagcattttttggtggttacttgagaatattgtgctacagtccttgagttttagaggagtggtcaggatgagtctgaagggggacttactgaagggccaagaattggggggtccctggagtggaggcaggggacaggatcaaagggctgccgggaaatgttggtgagttttcatggtttccctctccttggtatgttgggcagatcagatagaccaagtcagctggaatctcatttaatttatgtagaaatcctacaggcaagggaaaagatttctgcctttagtcatcctggggtcttcctttaataatgaattttcttggagattagatttgaaatattaataagctcattctgcttgaggatcttaaagaagctttttagttattctaccccctattgtataatgtgattttcttagcctttttctactttcaggacaagagccagacacaatcgtgcgacgggaaaagtttgtttttgggtgtcctttccaaattcatgtgacttactttctcacacctactccaccaaatgcctggaatatgcatgctgcctcagtccaatgtacatagcctcctgtcatcatggttgttgtcccttgtccattccctagctaatcacttcagggaataatctttgcaggtgttggaggatgctaaaagtcaatgtaccatgcctagcagagctgttacattttagctaaagatacctgaagactgagaaaccttctaatgtataaatgaacctttgaaagtagaatttcaggtacctgggctggctatggcagaaatttttaagcttgaaaaaaattttgtgtgtgtgatttttttgttgttgtttatttgtttaatctacagaacagagagaactgggccagcattgctttacaggccatatggtaaccaatactattttgatctgcattacagagttttgaaaagatgtatttcctcaggatattctcctaatcctagtacaaaacagtgctgtaaagctgcacacttcatctgtgcataaggcttaccccagctactggcatcagatatacaatgcaaacaatgccaacaaatggattttaccattctctacctttaggtcaagagaagccatatattcctccattatagttttcaggagagacacaagaatacaattcaacagactgtacagttttccttcgttatgttggaatagttttccttcattttgagaggaagtccagaaaggtgatggctgtgataactcacctggtgaattaaaatagccacctgtttcaaaaaataaaaagcaatctcagaggatcagaaagaaatataacaattatagccaagattgatatttatagtaattacattcttatttgaataatccctttttgtcattcttcaaagcacagtacattctatttttttcatgacacatttctatccaactgcctcctttaaacatgcccaaactagcttctgatgacttcaccattgctaacaatttaaagataattccctgtttgacatgatttttaccaaaacagtaattcctgaacaatgaatggtatctagtttaatatcaatcattaattgttgaaaaaatttcttccaacaaaatttaagccaaaccaactagttagtgatcttctatcatgcattcacattgggataacaaaatataaaatgaaagaaaccagtagttcctgcatgtctactatggttctaatatttaaacataaacaacctcacttgaagtcagagaagccagcttcccaaagttacatagatatataactttgaagtattagattcacggtttgacttcaaatctgggcaatttgaagacagaaaaaaaaccagcaaagcatgctgcctccagctgtagaaagatctgtcaaagtgtaaaacgctaggggtaagactaaagagcaaagagaatgcctcaacaatccaaactatttcagacgatggacagaagaaagaaaatattccaattgtcaataattctgtgacaggaactgtagtggatcttgcccttctggaagtggggagcagaggcagggacttcctatggatccagatcctgagggcccaaagtatgaagtctgtagctggaagaatagattcagtgttgggacaagaggtgctcttgacattgaagataagccaggagtgagaaatactgtcaccaagtctctgggatgccccttgccagcactaccccatgatggcaatgccaaacttaagattgtatctcctctccagcatcacaagtaatcagtaagattggttctttggacataggaagagtagcaacctcttgctggagtagtaggagaggcctgtgtctgagcacagcatgtgaatggtatagatcatctagccatgccatatgcatggagaaaatagatatctatgtagaagtaaagaactaaaaatgctgtacttgtgaaatgccctaacacaggaggctcaggccttgggtggcatggagtgactatagcttaacataactctgggaaagaaaggcatcttctccctttcccgaaaggctgaggagctactattagaccagcagttctggtttatgattcagtcacctcagctgattggtccaccgcccttgtcccacagctatactgcacagcctttagaataaaacagaaacaagcaagggatctccccccaggcaaaaggctgctcagatgatctgcttttccgtttcaggaaagatactaatgaggacaaataccttggattaagaaagtgctagaatcctgttatttatcagggaatgtgggcatgtagaaaaggtgactcagagccacttagttttatatattaaaaatgacagtttgtaccccaagcttgtaagtggaacaaattagttatagtaggtaccttccttcctatagtatctgtctctccatttcttattcaaatattataggcaaaccaatctagaacagaagcttgtgaatatttctgaccttgaaccccaaataagaaatatatcttaattgtgaagcagaacacacatacgtacgttttaaatggaaacaagatcttctgaaaacaatactttccttgatcacctgcaaggcactctgatattttctctcctattttattttcttttaagtattggttaagtatgttgctacctgcagtttgaaaatcactggcttagattagttcattaaaaagaaactaaaactatctgtgtgtgctttgaatgggtttcatgaaaccatcttattttcaaagtgctcataagcatctttacactagattcttctagaatttgtttggaacaatattaatttcacttgaaattaatattttcctccgttacacatctaatttttagtccatctctaccttcctacatgttttatattcatatactcaaattgcactaactctacttctatgataatatctgtcttctttaatgccccactttatcaaggcattttatttgtgcatctaaacttcattttatccaaagaagttaattgttcagctacaattttttaaacgagatttttctgttctttctagcatgaagtcattactgattttttttcaaaaataaaatgtggggctgggcgcagtggctcacgcctgtaatcccagcactttgggaggctgaggcgggtggatcatgaggtcaggagatcgagaccatcctggctaacacggtgaaatcctgtctctactaaaaatactaaaaattagcttggcgtggtggtgggtgcctgtagtcccagctacacgggagactgaggcaggagaatggtatgaacctgggaggcagagcttgcagtgagctgagattgcaccactgcactccagcctgggcaacacagagagactccatctcaaaaaaaaaaaaaaaaaaaaaaaaaaaaaaaatatatatatatatatatatatatatatatatatatgcatgtgtgtgtttatacatatgtgtgtatatatgtgttgtatatatatgtgtgtgtatatatatataatttcaatttgtcaatagtatattttggatatttttgcaagttactctattttcttttctacaaaaatctgtcaacatattgctcgggcttctctcagtagccatttgagaatcttcactgaaattttcctacttaaagttttagatatttcacaaaacctaaataataaacattacagcttatgaagatattgatcatttaagctcttatatcagacaaatgtttttcttcctctgaattgtcattcatataattatttggtaattgctaactatacgtaaatgttatttatttttgtcatttaacattgtatacactgatggtgctaatttccccccaaaaaagttttaaatttcctgagaagaggaaatagtataataccattcagttcagggtgaacttttaggaattaaaaaaaaaattgatgtataatttacatacaataaatgcatttcctaagtgttctattttgacaattgtggatacaacctaaataaagaaatagaacatttcaattaagatgtttcaatttcaaccttgaaccacagaaagttccttccattgagcccctttccagttactctcctttccaaagccactcactttctgatttctgcattgagaactgtgaagggtctgtgatctcacccttcttgaaagataataagttatcctgctgcagtttaacagattctggcagaacacatgagttgtgataataatgaaacagccttggattctaagcaaatgaagcactaaaaatgattagagctattaaagccaacctcataagaggtagtgagcaaataataggagtgttcaaagaaacaccatggattagtttgatgtttagccaaacgacttctaagattctaagtttcatcattggcttctaatcttattttgaactaaattgatttaaaaggcaagagtccaatttagcatacaacaaaattagaaagacatatgtgaaataatatggttttatgagtaacattttcccaatttacacatataatagcagtctagaagtgcctgaggttgacagcacatgatgagtcctaactgaggtgattgtcatctcaaaaggagtcgatggaattcatggctcaggtaattcatttgggttaatctacaactgtgcttagaagaaaggcatctgacaatgtatcacatatatatcaaaacatcacatgatatttcataaatatatacaattattatttgtcaattaaaaataaataagtaaatagacatctgtctcttttttcctatgagcttcctaatttcatttattttatttttactgacacataacagatgtacatattgttggagtatgtgtgataattgatacattcatatgatgtgtaacaatcaagttaaggtaatgggatatccatcactttaaatatttatcttttctttctgctgggaacattccagttattctcttctagctatacttaaatgtacaatagattaatttatagtcatcctactaatctatcaaacactaggtcttatttcttctacttggaagtatatttgtaggcattaatcaaccatcccacccccagtcccacctttcctggcctctggtacaggccagaggcctctattctttatctttatgaaatccccttttttaactcctgcatatgagtgagaacatgggatatttgtctttctgtgcttggcttatttcacttaacataatgacttttatccaatccatgttgctgtaaattacaggatttcattcttttttctttgctgaataatattccattgtgtatatataccactttttaaaattcattcatcctttgatgggcactttggttcagtctgtattttgactattgtgaatagtactgaaataaacatgaaagttcagatatctcttctatatattgatttatttcttttggatatatatccagtagtgaaattgctggatcatatgatagttctagtgatagctttctgaggaatcaccatactgttttccatagtgactgtactaatttacattcccatcaacagtgtaggagagttcccctttctccatatccccaccagtatctgttattccctgtctctgtaataaatgccatgttaattagggtgagcgaaatctcattgtggctttgatttgcatttctttcatgattagtaatgctgaacatcttttcatatacttgttggccattcgtatgtcatcttttgagaaatgtccattcagatcttttgcccatttttaaattgttctttttactgttcagttgtttgatccccttatatgttctggttttaatcccttgtcagatggatagtttgcaaatattttctctcattctatgggttgtttcttcactttgttgattgtttcctttgctgtacagaaactttttagcttgatacaatcccatttgtctatttttgcctttgttgcctgtgcttttgagggcttacacaccaaatttttgcccatatcaatgtccctgagtacttccccaatgttttcttctagcagtgtcatattatctcttacacagaactctttgattcattttgatttgatttttgtatatggtgagagatagggggtctaggtttttgttgttgttgttgttttgagatggagtcttgctctgtcacccaggctggagtgcagtggcatgatctcggctcactgcaacctccacctcccaggtttaagcaattcttcttccttagcctcctgagtaggtgggactacaggtgtgtgccaccatgcctggctaatttttgtatttttagtagaaatgaggtttcaccatattggccaggctggtctcaaactcctgacctcatgatccacccacctcggcctcccaaagtgctagcattataggcatgagccaccatgcctggccagcagactagttttattcttttgcatactcttatccagtctccctccctctctccctccttctctctctctctctgacttctcctctcctctcctttcctttcctttctttcctttccttcctttccttccctccttctttttagagtcttactctgtcacccaggctggagtacagtggcgcaatcttggctcaccgcaacctctgcctcccaaaaaccaaacgatttcatgcctcactcagcctcctgagtagctgaggctacaggtgtgtgctaccacacttggctaatttttgtacttttagtagagacagagtttcatcatgtaaactcccaacctcaggtgatcctcccatcttggccttccaaagtgctgggattacaggcatgagccactgcactcaactgattatccagtttttccagcaccatttatagaagagactatcctttctccattgcatatttttgacacctttgtcaaatatgtttcttgtaaatgttggatttgtatctgggttctttattctgttccattagctttttcattttttcaaggtgtctatttcttgacacttggctttgcaatattttttcttcaaatttcaaagtattttgtttcaaacatgttttttaaatattaaaggggatgtacagaaggataagttgcaaagtcaagaacaagtgtgttcctgaaaatttagcctggctttgaatttaaaaagggtttaaaacaaagtgaatgaactagcttctgagtttatgttggtttattcaacattgaacacaattttaaaagtcaagacaagtgaagatcaagattctgtgttttcttgttaagcttaaggcattttgagaggggtgtatgttgatcagcataattgctattaagaactgagagaacttatagaaaacttataatggccacagggaaattcaagatggccaaataagaacaggaacagtctgcagctcccagcgagatcgatgcagaaggtgggtgatttctgcatttccaactgaggtacccagttcatctcattgggactggttggacagtggctgcagcccatggagggcaaacctaagtagggtggggcatcacctcacctgggaagctcaaggggttagggaattttgtccccaacccaagggaagctgtgagggtcagagcctgaagaactccagcacagatacagtgcttgtcccacagttttcataacccaccaaccaggagattccctctggtgactaccccaccagggccctgggtttcaagcacaaaactgggtggccaattgggcagacaccgaactagagctaggtgcaggatcttttctttccataacccagtggtgcctggaatgccagtgagacagaaccgttcactcccctggaaaggggggctgaagccagggagccaagtggtctgactcggtgggtcccacccccacagagcccaggaaactaagatccactggcttgaaattctcactgccagcacagcagcaatctgagatccacctgggacggtggagcttggtgtgagggaggggtgtctgccattgctgaggcttgagtagacagttttacagcaagggtaacaaagctgctaggaagttcgaactgggtggagcccactgcagctcagcaaggctgctgtggcccaactgccagattgctcccctctggacaaggcatctctgtaaaaaaggcagcagccccagtcaggggcttatagcagacttaaacgtccctacctgatagctctgaagagagcagcagacctcccagcacagtgtttgggctctgctaagggtcagtctgcctcctcaagtgggtccctgatccccatgtataccaattgggagacacctcccagttggggtgacagtcacctcatacaaggagagctctggctggcatctggcaggtgactgctgggttgaagcttccagaggaaagaacaggcagcaatctttgctgctctgcagcttccactagtgatacccaggcaaacagggtagggagtggacctccagcaaactccagcaggctggcagaaaaggggcctgactgttacaaggaaaagaaacaaaaagaaaggattagcatgtccactcaaagaccccatctgaaggtcaccaacatcaaagaccaaaggtagattaatccacaaagatggggaaaaagcagcacaaaaaggctgaaaattccaaaaaccagaatgcctcttctccaaaggatcaaaactccttgccagcaaaggaacaaaactggatggagaatgagtttgacaaattgacagaagtaggcttcagaaggtgggtaataacaaacaactccgagctaaaggagtatgttctaacccaatgcaaggaagctaagaaccttgaaaaaagttagttgaattgctaactagaataatcaatgtagagaagaatgtaaatgacctgatggagctgaaaaacacagcatgagaactttgtgaagaatacacaagtatcaatagccgaatcaatcaagcagcagaaaggatatcagtgactgaagatcaacataatgaaataaagagagaagataagattagagaaaaaagaataaaaaggaataaacaaatcctccaagaaatatgggactatgcttccaaccaagttggaaaacactcttcaggatattatccaggagaacttccccaacctagcaagacaggccaacatccaaatccaggaaatacagagaacaccacaaagatactcctcgagaagaacaaccccaagacacataattgtcagattcaccaaggttgaaatgaaggaaaaaatgttaagggcagccagagagaaaggtcgggttacccacaaagggaagcccatcagactaacagcagatttctctgcagaaaccctacaagccagaagagagtgggggccaatattcaacattcttaaagaaaataattttcaacccagaatttcctatccagccaaactaagcttcataagtgaaggagaaataaaatcctttacagacaagcaaatactgagggattttgtcaccaccagacctgccttacaagagctcctgaaagaagcagtaaacatggaaacgaacaaccagtaccagccactgcaaaaaataccaaattgtaaagaccatcaatgctgtgaagaaactgcatcaattaacgggcaaaataaccagctaacatcataatgacaggatcaaattcacacataacaatattaaccttaagttgaatgggctaaatgccccaattaaaagacacagactggcaaattggataaagagtcaagacccatcaatgtgctgtattcaggagacccatctcacatgcaaagacacacataggctcacaataaagggatagaggaatatttaccaatcaaatggaaagcaaaaaaaaaaaaaaaaaaaaaaaaagcaggagtcgcaatcctaatcctaatatctgacaaaatagactttaaaccaacaaagatcaaaagagacaaagaaggacattacataatggtaaagggaacaatgcagcaagaagagctaactatcctaaatacatatgcacccaatacaggagcaccaagattcataaagcaagttcttagagacctacaaagagacttagagtcccacacaataatagtgggagactttaacaccccactgtcaatattagacagatcaatgaaaattaacaaggatattcaggacttgaactcagctctggatcaagcagatctaacagacatctgcagaactctccacctgaaatcaacaaaatatacattcttctcagcacctcatagcacttattctaaaattgaccacataattggaagtaaaacactctttagcaaatgcaaaagaacagaaatcataacagtctctcaggccacagtgcaatcaaattagaactcaggattaagaaacccattcaaaaccacacaaatacatggaaactgaacagtctgctcctgaatgactactgggtaaataacaaaatgaaggcagaaataaagatgttctttaaaaccaatgagaatgaagacacaatgtaccagaatttctgggacacatttaaaacagtgtttagagggaaatttataacattaatgcccacaaaagagagcaggaaagatctaaaattgacaccctaacatgaaaattaaaagaactagagaagcaacagcaaagaaattcaaaagctagcagaagacatgaaataactaagatcagagcagaactgaaggagatacagacatgaaaaaccgttcaaaaaaagatcaatgaatccaggaactgtttttttttttttttttgaaaacaaaaaacaaaaaaaaaaccaacaaaatagataacccgctagccagactaataaagaagaaaagagagaagaatcaaatagacgcaataaaaaatgacataggggatatcaccactgatcccacagaaatacaaactaccatcagagaatactataaacacctctatgcaaataaactagaaaatctagaagaaatggataaattcctggacacatacaccctcccaagtctaagccaagaagaagttgaatccccgaatagaccaacaacaagttctgaaattgaggcggtaattaatagcctaccaaccaaaaaaagtccaggaccagatggattcacagccaaatttgaggtattgctcttcacacttgggggcattagctgcgggggtctgcctgcagaccctgacccaaacgatggatgaataaaatgtaccctgacacacagatattttgttttgccagttcagctgagtgtccaactgcctgcacatcaagagaggtttgtcactgtggccggccctgagcagttcgcattccaggcatttatttggtatacaattaacaacagaagctttgagtaaacacacttgcggataactaacatggttaagagagtagttctaggaatgattaaagctcaggtaccggggtctaaagtaactaccatgagggggcaatttgcctcttagacctctcccccaccgagagagccatctggctcaaaggttagttaatggaggtagggtaaacacacttaactggagaagcctctattgtccctaatatttacgctatgacctaatgctctaaggtaagaacaggctgcctttgccctgttcagttattacaagctatgtaacctttcggccttccaaaagatttgtgactattccctataactttccctaatatttccctttaatatttctgccaccatcctgagtgaatcccaacacgaattctaccagaggtacaaagaggagctggtactatttcttctgaaactattccaaacaatagaaaaaaagggactcctccctaactcattttatgaggacagcatcatcctgataccaaaacctggtagagacacaacaaaaaaagaaaatttcaggccaacatccctgatgaacatcgatgtgaaagtcctcaataaaatcctggcaaactgaatccagcagcacatcaaaaagcatatccagcatgatcaagttggcttcatccctgcgatgtaaggctggttcaacatatgcaaatcaataaatgtaatccatcatacaaacagaaccaatgacaaaaaccacatggttatctcaatagatgcagaaaaggcctttgacaaaattcaacagggcttcatgctaaaaactttcaataaactaggtatcaatggaacatatctcaaaatagagctatttatgacaaacccacagccaatatcatactgaatgggcaaaagctagaagcattctctttgaaaactggcacaagacagggatgccctctctcaccactcctattcaacatagtactggaagttctggccagggcaatcaggcaagagaaagcaataagtggtattcagaaaggaagagagaaagtcaaattgtctctgtttgcagatgacatgattgtatatttagaaaaccccatcatctcagcccaaaacctccttaagctgataagcaacttcagcaaagtctcaggttataaaatcaatgtgcaaaaatcacaagcattcctacacaccaataacagacaaacagccaaatcatgagtgaactcccattcacaattgctactaaaagaataaaatacctaggagtccaacttacaagggatgtgaaggacctcttcaaggagaactacatatcactgctgaatgaaataaaagaagacacaaataaatggaagaacattccatgctcatgggtaggaagaatcaatgtggtgaaaatggccatactgcccaaagtaatttatagattcaatgctatccccatcaagctaccactgactttcttcacagaattggaaaaatactattttaaacttcatatggaaccaaaaaggagtctgcatagccaagacaatcctgggcaagaagaacaaagctggagtcatcatgctacctgacttcaaactatactacaaggctacagtaacccaaacagcatggtactggtggcaggacagatatatagaccaatggaacagaacggagacctcagaaataacaccacacagctacaaccatctgatctttgacaaacctgacacgcacaagcaatggggaaaagattccctatttagtaaatagtgttgggaaaactggctagccatatgcagaaaactgaaactggaccccttccttacaccttttacaaaaatcaccttaagatggatcaaagacttaaacgtaagacctaggaccataaaaaccctagaagaaaacctgggcaatactatacaggacataagcatgagcaaacacttcatgtctaaaacaccaaaagcaatagcaacaaaagccaaaattgacaaatgtgatctaattaaactaaagagcttctgcacagcaaaagaagctatcatcagagtgaacagacaacctaaagaatgggagaaaatatttgcaatctatccgtctgacaaagggctaatatccagaatctacaaacaacttaaataaatgtacaagaaaaaaacaaaccaccatcaaaaaatgggcaaacgatatgaacagacacttctcaaaagaaggcatttatgcagccaacagacatatgaaaaaatgctcattatcactggtcattagagaaatgcaaatcaaaaccacaatgagataccatctcacaccagttagaatggcaatcactaaaaagttacgaaacaacagatgctggagaggttgtggacaaatagtaatgtttttacactattggtgggagtgtaaattagttcaaccattatggaagacagtgtggcaattcctcaaggatctagaactggaaataccatttgacccagcaatcccattactggggatatacccaaagcattataaatcattctatgataaagacacatgcacacgtatgtttattgtggcactattcacaatagcaaagacttggaatcaacccaaatgtccaccaatgatagactggattaagaaaatgtggcacatgtacaccatggaatactatgcagccataaaaaaggatgagttcatgtcctttacagggacaaggatgaagctggaaaccatcattctcagcaaactatcacaagatcagaaaaccaaacactgcatgttctcactcataagtgggagttgaacaatgagaacacatgaactcagggaggggaacatcacacactggggcctgttggggggtggggggctaggggagggataacattaggagaaatacctaatgtaggtgacgggttgatgggtgcagcaaaccaccagggcatgtgtatacctatgtaataaaactgcacattctccacatgtaaccaagaacttaaagtgtgtgtgtgtgtgtgtatgtgtgtgtgtttatatatatatacacacacacatatacatatatatatatataacttataaggaatttttacactaaaaaaagaaaatgctgggtaagaatagggtatgtggacagactaagaaacaatcaaaagatgagtgggctgggtttgtggtggccaggtttgtggagctgattaagacattgctttaaaatgatatttttttaatataaattactgtctatatgaatataatcccttccaattcccccaacttttgtaattttattacagaagtgattttaagttttaattcaatttctgtcagtttggtattttttgatcacagactacagggtactcaaatttgggaggaggaggttatgcaagtatattcatatttatttatttattcacttattcattttatcttcctgcagtttagcgatcaattttgctattttatggtacaaaatggctttctgccgcgttggtaaagaaagccaattgtctttgaagctagtagtggtcagatgacaaatccctgatcaatgatgcttaagtggaagtcagcggatggtgctctctcctggagattttttaaaggatctgatttatctggtttgtttaaatggaatcataatcagagaaataatttcaccatgagaaattaattaaagaaggccagaggacagcatttaaagtgaaaatctaaaggacataattggaaagaaaaaaaaaacagtttgggggaaaatgtcaagtgatggatttgtgagcatttactaaggcagggggcaagccattatactaaagaaagtacatggcaactgaaaatgatctttccacatacaaattctttcagatgaaaatttttattgtttttcaaatcttatttttaaatttttgtctcctttatctctcagtatatgagtgatttgttgaaaatctccctctgtgacgctgtgactgtggaactatccatttcctcttgtaatctggctattacttgttttacatatttttatagattcaacattatagtatttacttgatgatttattttattggtataaagtgttcttttccttcttaatatatttcatctgaaatttcattcttttctgatattaatattggtgtaccagcttttttcttattaatgttcacatgctttctcctttttctttttattttcagcatttctgtgttattgcatttggtgtttctcttataaaggatataactggatttcgtttaggtaatctgagattcctggcattggaaaagtgggtttaactcattctgattcttgatgatttttcagatgtgttgacttttttcagcattttagtttatgttttctgtgccatgcctttgtgtctggaattggttccttccagtgggttcttggtcttgctgacttcaagaatgaagccgcagaccctcgtggtgagtgttacagttctcaaagatggtgtgtccggagtttgttccttcagatgttcacgtgtccagagtttcttccttctggtgggttaatagtctcgctggcttcaggagtgaagctgcagaccttcgcagtgagtgttacagctcataaaggtggcgcttctggagttgttcgttccttccggtgggttcgtggtctctctggcttcaggagtgaagctgcagacctttgcagtgttacatctcttaaaggtggcacgtccagagttgtacattcctcccgtccagagttgttttgttcctccttcctcgttcctcccagtgggtttgtggtctcgctggcttcaggagtgaagctgcagacctttgcagtgagtgttacagctcttaaaggtggcacagacccaaagagtgagcagcagcaagatttattgcaaagagcaaaagaacaaaacttcgaaaaagtggaaggggacctgagtgggttgctcaggtggcctgcttttattcccttatttggccccaatcacatcctgctgattggtctattttacagagagctgattggtccattttacagagtgctgattggtccgtttttacacagagcactgattggtgcatttacaaagctttagctagacacagaacgctgatcggtgcatttgcaatcctttagctagacagaaaagttctccaagtcccctacccaattagctagacacagagcgctgattggtgtatttacaaacctttagctagcacagaccactgattggtgcatttacaatcctttagctagacagaaaagttctccaagtcccctacctgattagctagacacagagcactgattggtatgtttacaaacttttagctagacacagagcactgattggtgcatttacaatcctttagctagacagaaaagttctccaagccccctaccggattagctagacacagagcactgattggcactgactggtgtgtctacaaacctttagctagacacagagaactgattggtgtatttacaatcctttagctagacagaaaagttctccaagtccccacccaacccagaagcccagctggcttcacctctcactttttctgtccctttttcccttaccctatattctattgatccaatgaagtcatttctattcccctcttttttctttataagtttagaagtaatgtacttaattctattctttcagggttaactcaacattttttcacttatatatcatatttatattttctaatattacctagaaccagttagtctgtattctttcaaagcagagagatgttacattctggactaaatcatgctcctatcttccatgatcacatgtggaatatttgttacaaattgttttaagcacacaatacagcttttctaatagtcaatgcttatttaaatttgtgaacatgttttgctgcttattttgaataatttttttctcaatatttactcttatttgagatctttttttttttcctgaagtacattctatagttatttttcagttagtacatgtgatcaaaaactcagtatctgaaatacttatattttacactcactctcgaatgatggtttattagggtgcagaactctatactgacaatcatttcccttctaaagtttgaaaatataacttctaggacattgtgttactagtgagaacactcatagagatgttatctatttgtgatagatgcaagaggcagataagggagggttcccagagaatctctgacctgccccacaagtgtttacattagatgcttctgtgcaaatgagggaacctgcccagggctttgcctgggcatgcccacagcagaccgggggcccacctgcgtaccgggagagtggggtggagccaccgggaattcacgcctgatgcccggggaggagtctggcctcttcagctcctgtgtggtggcctgatattcagtctgtgagctgggagcctgttggcaggtccctctttttattttcgctgagagctttcttttactaaatgccaccatccttacctttcaaggtgtctgcgtgcctaatttttcctggttgttagacaagaacccggattttagttgaactctggagcaaaaatcctgcatcatttgtaggtaatgtttgttttctttggttgcttttatgaccttctctttattcctagtatttgggcatttcacaaaaacatttataaatctgaattaaaaaacaaactgaccttgccaaggaccctactgatcccttttcatataattctatctgctaggtcttgtgctgccttctaagttagttcatcagttctatacttcagtatttaattctatattcagccatgttatcaaatgtttatttcaacctttgagtttctcatttgtaatagtattttttcatttttatgtttttaaaagagttcttttcatattttactatttttgtttagtaactttcagtacttgttgcgtagattttatttcatctttatgtttttgagatgtttgcataacacatttaaagacaattacatattgttgtatgatttccatttccttggtcaagaattctcccatttgttgcatctctgaagagtttcccaaggtgggttaatcttgaatatggtaaacttgctgccctcagttttttagttttaatactttatcagttgtttcttgttctttttttttctgggcatattattacctcatttgaaaataatgacaattttggcctttctcttcgagattttgtaactcattttcttttcttttcacatagaatttgataaggcctccagtactttgtgatatagtagttgtggggatggtccttcttgtcttactgctgatctcaagtttatgtttgtagcaaatttttgctacatgaccattacaagtttaagaggttaccaagagtttttattacaaataccttaaatcttagcaaagactataaaaactgagataaacatgtttttcttctaaatagtaatcatttagacaaatcacaaatgtgatatcagattagtgcatcctacactgtatggaaactataaattcatgattttcaaaaattgtaggtaaatatttatttttcaaaataatttatccatcttgctttaccaaaaaaggcaaggtcttgtttttctttccctatacagtagtaatggctctttggtgtaaaaactttataggacctaaagtaaaaaagaagataaaaaccagtttgtctttcaaagtcttaaaatatttcattaacctcgtagtgcctgatctctgtcaccaagcaaatagtctgaactattatttccaagctcaattcaaacaggtaaagttttactacaattatatctggccatcactacagtgttttctccaatcacttccaaagcctaccccttttctttatcatacttccacctacattgcataatacagagcttagctagtgaggtacaagtgataaggattatctccccagagtctccgggccttggtaattcctagaccacagcaccatgcattaggttatagtcacaggcctctatatagtcttccacatatcccattacattttaaatcctatgcataccctttatatcctgcacttatctgtcaaaattctaaggtataagattttttttttacttatccctgctgtttaattttgaagaaagaaaaatataaaagaaaattttttaaaaagaggccttcatggatatcaaagaatgccaacaataatgctgaagaaagaagttattctacagcaatgagacacaaagaaaagaattttgtaaacattagcatcttggttactggagaactataacttttatgtagtcgtgcttggaaaacactaaaagggaaatcgagtctgtttgacaatattctgtcttcactgttgatcacttcataatgtgttggaatataaagttctatacagttaatatgaagctctctttagcatttaaaacatgatttgcattttcatgaggcattttggctaattttattgatttccttatatttcatagtccttagccttatgagaatcttatgtttctgtgtgttttctatcatgtagcacaatttctgacacacaaaacatacaataaacttgtgttaatttttctatcaaagtcagaatttattcataaggaatctgaagtaaggtgtactaagcttgtttatgggttaagtgatatagccaaattcaaaactttactttttatgtcagtctagaaatatctcagattaaaacatatcacttcttagttccaattagataagggaaatcttttataataatgccaggattgctataatctgataggagacaacaatttcattttgctacaggaaaatttggaggacaaaaaaaaaaaaagaaaacataagatagaggagagaaaatagtcagatgaagaagcaaaaaacacaaacaaggcatttagatttgttaggaaggaattcaagtcagtcagtaaagtgataacttttgaattatctgagaaaaatatactcagaacaaaatcaggcacactaaaggtatccataatccacattatttactaggctaaaggtaagtacaaacaaatctacatggactaattgtatcacagaacaaaaagggtagcaaaatccagtaattccaatggagtaataaagttgcagacaaaggaaaattaacgtgtgcattgcttgagatatgactaaaatgtcattaaaataaattctaagttatgaatattcatttgaaaagttacaaagtacacactgatttatatttcagaagcaaggatatatgtttctatataatttagtcctaaatatagttcatttcctatgctaatgcttttttccttcttcttaccttcttaggtcaacaacaagaggccaggacctcccaagaaaagctttactaatgtaatagctttggccaagtccacccaatatattttcctctctgcaaagagaaacaagctattgtctcatcttaggtttcatcttcttccatgccactgttattcatgttcaaatcctggctgtccttcagggtccaattcaaatgattatcgccattttctattaatgtcatttcttcctattttctaccttttgttagctatgttaaagtgtttctttaccaacatcccccatatattgtgtaacacagtgtctatggcttactcatttttgaatccttatcatgacctgacataatgaagattcttagtacatagtgatacatgtaaatatgagttaattagtacatgatagacttgatttccagaatgattttgtatagttgaattgtgtagtaaggggacacatgtgaaatgaagactttagtcagtatcaagaagatattttgggtgacttcacatatctgccaatgataaatctagaaacaataggtgcttgggtaggtgatttccttttgccttctttatcattgttttcccagtatttcttacattcatctaatttcattagatgcccatatactttatactggctcttcctgtgaggttcgaactggtccagtccatttgttttcagaattgattcatctggagagtcatctcctatcctcccaaacaatgatataccagtctgaggactgtgtagaagggacttctctttctactcagtatgaccaaaataattcaattctagttgtggtgtgtgatttatgaatattttgtcctttagtttgtgtgagccaattttgtgccataagaattttagcctccttttccacaaaagagtgatttaatcaaacaaaagttgacaatcaatgtagtacatttgtgtgacagtgattaaacatggtgtttttctcttaggtgtctgagtagatttggaaatgcccattcagccctcagagctcctctgctttaagggtgatggacttcctgtaccactacgtagtgcatgagtgccagccactggtatctagaactgtgattagtgaggaaacactaggaggaacaaacaacccaactctttttatctaatctgttgactccaaagggaccttctgcttattccagttaaaactcaagctgcaattcaaaatgaaatcagtatcttttttctctacttttcagcaaagcaagatgctaccttataattaccacgtaacaatcaatcgcaaacatagtggcttaaagcagctcctcttttagcctacatatctgcaaactggcagtctggactgagctcagctggatgttttttctgagctgatcatgtatgtagggtctgctgctggctggtttagactgatggtggatgagaaaccacatgaagaagagaggcatgatggtggcagagttctgaaagagtcacacagaagggcgttgagttcgtggcttgaaaatagcatcctgtcacttctaccacattctatttaccaggccagcccagataaagatgtgaagaaacagactccatctcttgatgggagaagttgaaaatcaatggaaaatggcatggataaggaaaggagtgatgattgtggccatatttgtaatggccatatttgatacccttttcagttttcctagccacacttctcattggccaggaaaattaaatgcatgtcaacactgaagaaaacagatcttggttaaaagcaatgatgtagctaatatcccgttcaggtaaaagattacttatatagtgtgagacaggcatgaggcagagaagtgcttacaggttggtttctgctttgttagcagatttacttttagatcatatactactttgtttttactgttttattgagaaaaaataacaaatatttccaaaattttgcagcatgcaactcagtgcttcagttggcattcaatcaaaatttccttgaaataaaaaaagacaagagagagacttggaattatgactcttctactagattagctccttcatgtcaaaatctgtcaagtttatgatttattcagatagcacttgtttttggtgtaataactaaactgttgctttagagtctactacattctcctctattatttggcatttttctctttattattttgttcaagtaggatattgtgctgagttgaaccatgaaatgaattgtattgagcaacatcaacaacataaatattctggggtgtcatctgcattttcatatctggctgctcaaattctttttacagctatagctttgataataatgtaatagcataatgtttttcattagatatcaaatcatagaagacaacaaagatgtgttaagttagcatagtttaatataaggaaacaacagcatcagtaaaagcattgagcactaaatatctcttccatttcagttcttttacaggaagcttttgttacgtgttgtcagcacattgctgtgatgctcaagtatagctctttaatgtgaaaacctggtatttgggcatggcttgaagcaggtgagagagtaacccatgcagatattagaggaaaggaacaagagtagctggaaagatccagagttaggaagcttcctggtgccctccaggagtggcaagctggtcactgtggcatgagaaaattgagttagggaaaaagaagcagattaggtcaaagaggtgaaatgggagggaggtcatgtagatgttgtaggctactgtgatgagtttgacttttactctggaagacaggaagacaaccataaaatttgggccattagagtgaaataatttgtctttattttaaaaggatcactttgcctcctctgttggaatagaatgtgtatgtactggagagtggtggtggatagacagctataatggaagctgggagacaaattagaaagcaactgttttctcccaaattcattccctgcccttcctctaattacatctatatcttagaggtctaatccttaaaaaatatatttcccagattcccttgctaattggtttcaaactaaatttagtcaaaaagaagcattgtcatgaagttcagggcaccaagaagggacaagctggggcattgctctctctctctgattgctttgggttgtgcctgtggcaactgccacatgtgccccatggccagtccctgctgggcaggctactgtgattgccatttgtattgggtgatctcagcttttggtttcccatgataccatctctaggggtagcagctggctataataactaatgtctggattatcctaactcttctgtttgttctttcaggtatttaacaatgttgtgactaattggcttccattatttccctagagtaggttctgttattaccctggaatatgtttgtaatagagtgggctattacaatcatctaggataaagataatcgtggcttggaataaggtggtagcaatggaagtgatgagaagtcattagatgcagaatatattttatagatggaatgtgataaaataaaaaataaactggactctggtttccagcatatagttccaaaagactgaaattgaaatttgtggagtaatagggtatcttttgtatgctaatgagaagagtggcggttgggggcccctagaaagcttcagcatgagggctagtcaccagaaaaactatgacatgattagagggctagaactttcagcctcactccttgacctctgaggagagaagacaggctagagattgagttcaatcaccaatggccaatgatttaatcaatatcatgcctacataacgcagtctccatagaaacccctaaaccgtggatttcagagagcttctgggttggccaacatatcaacagaggagctgtgaggtgggcaagcctgaagagggcttggaaggtcctgtatctgcccccttttctttgctttatgcttctcttccatgggctgttcctaagttgtatcttttatatagtcaaaaagagttttgatataggttgtatgagtgttataagataaataaaagtcaaaaatgactctagtgtttttcctgagaaattgaaaatggcataattattattaactaagatgaaaataatgtaaataaagcaagtctatgctgggagagattaggggttcagttttgtacatgctgtgtttaagatgcccattaactacctaattggaacgtttaaatgatcagttgtgtatatatgcatctggagtcagaagtccaaactagagatataaatttaggaatcaacagcttttattgttgtctattcaaagttatgagcctagatgagatcattccagaaagtgaacatatataaaagagagattaccaaaagtgaatgaggactccatttactataccttcaattatttaaaatcttataaattggtgctgtccaatagaacttcctgcagagacagaaatgttctatatttgtactatctgaaatagtagctgtattagttttctatttctaccacaacaaattgtctcaactatagtggcttaaacaacagtaatttattatcttgtagttctgtagatcagaaatgcaccatggtgtcactgggctaaaaccaaggtgccagcatggttgcattcctttttggaggctctggtggagaatctgtttctttgactgatctaacttctagagcccatttgcattccgtggcttgtggctccctacctgcatcttcaaagctagcaaggcatgttgagttctcacagctcattaccctgatcttttcttctgtcttcctcctccactttaagtatccttgtgattagattggaacccttgtggataatccaggataatcttcccatctcaaggcccttaaccttaatcacatgtataaagtcccttttgtcatgtaaagtaacatatccataggttccaggattagaatgcatacatttttgggaggccattactttgcctaccagcatgaccactatcaccatatggtgattggacatttgaaacatggctagtggaattgagaaacaacattattttattttaactaatttaaatggaaatggaaatgcatatagataatggctaccttattggacagcacacatctagaagaataggagagtaaatagactagggacatgtggtatgatcacagaccaacattaagagcctatgtatgatttgtagttatgaattttaagtaagactttagcatagttgtatttctacagccatgttaactactgatggcactctatattaatcccttctcacactgctataaggacatacttgagactgggtaatttattttaaaaaagaggtttaatggactcagtttcatatggctggggagacctcacaatcatggtgtaaggcgaagaaggagtaaaggcacatcttacatggcagcaggcaagagagcatgtgagggggaatggccttttataaaactatcagatctcatgagaactcactcactatgacaagaacaccatggaggtaaccaccttcatgattcaattacctcccaccaggtccctcctatgacatgtggggatcatgaaaactacaatccacgatgagatttgggtggggacacagccaaaccatatcacacccataaaattgccttgaagatacattatcaaaaaacgataattataaaccaagggagataaaggttttgaatttaagaaacagtgatgagcaaagagaccagaaaaatttctcttaactctaaataattattgaggctaccactccaaaaattaatataattttttttttagatgaagtctcacactgtcacctgggctggagtgcagtggcgcaatctcggctcactgcaacctctgcctcctgggttcaagcaattctcctgcctcagcctcccaagtagctgggattacaggcacccgccactacacccagctaatttgttgtatttttagtagagatggggtttcactatgttggccaggctggtctcaactcctgatctcaggtgatcccccccacctcagcctcccaaagtgctaggattacaggtgtgagccactgcgcccagcccaaaatatcttaagtagatggggttgtgccatattggccagtctggtcttgaactcctgaccttgtgatccacctgcctcggcctcccaaagtgctgggattacaggcatgagccactgtgcctggccatataatttttaaaagaagattcattaaacaaaggatccacaatataataaaaaattccaaactatcaaaagccaaatgattaattcttgacacttaggaaataaatggattgattattttgttccgaatttcagaacaaccaataaaataagagaaataagatacagaatttgcaaatcattagaaagaagtaacaaagttataaacagggaagtatttttaaatgacacttgaaaacccaaacaaaagaagacataacacacgatggcagcaaaaagtttaaacatattatgattacaattatgattagataagttcccctgtcaaagacaaagaacagtaattagttgtttataagaactacacttaaatcaaatgacacacaaaggtaaaaattgaacaaggcaatgagaagcaaaacaatacccagaaatagatttcagcagaagtgggagtcattctttccagtataggtttgaattcacaatacctgcagggcctaaaaaagctcaaattaaaatttaatgtaaagtggtctccaattagtagtttcccaagatgccttgcagaagaggcaatacaaattcattctttttttcttttcgccacaaggtgggtgtcattgtgactggctgctacctccccatgagtcttctaaaataaaacctgcaaattcacatcttccccatgcttccagagaatgcatattcttcctttgaaaaaagaaaaccaggtatggttgcatgtgcttgtagttctagctactcaggagtactcaggaggctgaggtaggaggatcacttaagcctaggagttcaagtccaagtctaaccaagacatatggagacactctttctggggaggggagggaaaaagagggcaacacctagggaaacagatttaggtagagagggacaatagaattctcaatttataacaaggaaaaaaatgactaccagacatttgtaagacgtcaatagcacaaaagagaaacacaaccagatcataattttttggtcaaaggtctataaaacgctggctaattctgaggatatggtgcaaaaaaatatgattttgttaaccacaacaaaaagaaaggtaagaaatgctaggagaaagctaaaagctccatactaaaataatggtcctaatattaagcaaagtaaaatgtggtatgattttgagtggtcagcagagtgtaagaataatctatttgcacttgatactttcagctgtcacagaggtcatagaattgggcttattgagaaggaaaggtaaatgctagtacactacttggctcagaagtgaacaaaattgcagtttgctcaaacaactccataggaaaaagtctaataatctgatgtaaaaatgggcagaagatttgaatagatatttctcaaaagaagacatacgaatggcaaacagacatatgaaaatgtactcaaaatcattgatcatcagagaaatgtaaatcaaaactgcaatgagatatcatccgactccagttaaaatggcttttatccaaaagtcaggcaataaaaaatgctggtaaggatgtagagaaaagggaacccttgtacactgttagtgggaatgtaaattaatacaatcactatggagaacagtttggaggatcctcaaaaaactaaaaatagagctaccatatgattcagcaatctcactgctaggtatatacccaaaagtatattgaagagacatctgcactcccatgtttgttgcagcactgttcataatagccaagatttggaagccacctaagtgtccatcaacagatgaatggagaaactgtggtacatatacacaacggagtgctattcagccataaaaaagaatgatactctgtcatctgcaacaacatgaatggaactggagatcattatgttgttaaataagccagacacagaaagacaaacatcacatattttcacttattttggggatataaaagtcaaaacaaactcatggagatagagaacagatagacggttaccagaggctaggaggaggagtggtggggggcagttagtgatggttaattggtacaaaaaaatggttagaaataataaataagacctagtattagataggacaacaggaggactatagtcaaaaataatttatttgtacatttcaaagtaactaaaagagtgtaattgtattatttgtagcacataggataaatgcttgaggtgacggataccccatttaccctgatgtgattattacacatcgtatgcctgtaccaaaagatctcatgtacctcataaatacatacacctactatatacccacacaaattaaaaattaaaaaaatttaaagaaattacagtttgttggttttgaatatttgaccaaattttttactaagcacagatagattgaatataattttattgtccttttgacattatgataatgaaggtatctacacagaagtctgagatgagaaaaaaatgatataatatccacctactacatagtgggtagtttatatactaaagttattgttatgagaaagaatggcttaggaatattatttaaaattaattaaggggtgttaaaaataaaataccaagtgtaaaaatgacaaaggcaagaagaaacagtatataatgtgagtaaatcttaatctttccaagagaggagacagtacataatgtctaaaattgttaaaccatgaaatagaaatatagttattttattcataattaaggagataactactatagcacgaaatcgtgccaaaaatggttgcctctgggaaatgtgattatagatattataatattttggactgtaaaaatctgcttttaagactgaggaaatacaaataggacaatatttatttgaaatttgtatcctcagggagtgtaaagaaattaatgtatccacaaaataataatagctgctatttgaaaacatagttttcttgaaagttaaaatagtaatagtcttctaaaaattttgttagttttggttttctctttaatctgagttatgtagaaaagtgcttatttcaaattaggtaggcttgttttattcctttttctgtcttttttctatcaactagtgttttattgtgttcagaaaatgccatgcattaaaagactacttttgagaatttctagagattttctttgttactaaagagatttttgtaattgttacatgggattttaaaaagaatgtaaattatcctttttgtcaagtataatgatttctgaaacctagctgtgtcagaatactgtataatactgtaatagtatgttgtttttggctatgtgtacttatttcttagagtggtatgttaaagcctcgaccttgtgactttgtttatttctctctctacatctaaacatttccaagacatgttatttgcaataccaagaccataactattatgtatttaatcaaaataaaatatttcggctctctataattcaccttgaactttattttgttaaatataaatgttgttgattatacaacatttcattatcaatccctagacacatttctaatccactataattgttttaaaataaaaggagaagggaaggttgtagtaaaaccctccccaaactcctcctccataaaagcaatgaagatactggcaaaaaaaaaaaagtcaaaatcaactttttcagaactctggaaactaactgaagcttttcaacaatctgaggaacttttattttagaaaaataattggatcttggtaacaatgagctttgtggtgcttgaacttactttatgcccattcaaattcatgatatcctttaagaccaatagatttacactcgcagtaactgagaaacaacagcctagcagtcactggatgggaagaagggtttagaaatcacccaaatccacatgcgaaatgaccatttgacctgtgtggaagctacctgaaaaacttcattctcaaggtttattattattttatttagttagttatttagagaaagagtctcactctgtcacccaggctggagtgcagtgacatgatcatgactcactgcagccttgacctcctaatttcaaatgatcctcccacctcagcctcccaagtagctaggactacatgtgcttgaccaacacctagttaattttttgtttttttagagacaggagtcttgctattttgcccaggcatgtctcaatttcctagcctcaagtgttcctcccacctcagcctctcaaagtgctagaattataggtgtggcaggtttatctttatttgataaaggcctgacttagagctttctctgtgagaatagccaaattcccaggtgtgtgtctaaagcaactattggtaattgtttaacaagacagcttccttaagcagagatcccatttagggctaataagtggctaagaaacttaaaaggaaaaactggggaatgaaaggactttagaggatatttaaaagctccacacattcctgggaatctagaaggccacatgcatgtgcaggacgctgaacatgtacagaaaacactggagaaggtcttaattgctcacctatggctgacctttagttgctgtaaaatcaaaagtaaaggttaaggcagaactgtaaattatctgaagtgttgaagatgttcctgaacataaacacagagtcggtcagcaaaggctgtgaaacttattggtctaaggtatgtaaggagatccctgtccaatcgctagctgatgactaaattaaagaatacagacttgacagaattagtccaggaaatcacaaataaataaaagaaaaataaacaaagagaggcacaacaaatagcaacagtagcaagtcctggaagccttattatcatctgatttccagagttgccacaatatgtttattttaaatgcttcacttttcaataaaaaatcttgagatacccaaataaatgagatagatgtatgccctttatatatggtgttggggggcagaggtggaggaataaatagtcaatagaaactatccctgagaaaggctactggactattaagaccttgtacttactagtcaaagattttaaatcagatattataaatatctttgagaactaaaggaaaccatgtttaaaaaattaaataaaaatatgagactatctcaaatagaaaatatcaataaaatggtagaaataattttaaagtaaagtagaaataatgcacttaaaaattaaatgatataaaaattttactagaaggactcaaaaacggatttgaaatgggagaagatggaatcaatggagctaaagatagatcaattgagattatcaattctaaggaacacaaagaaatatgaatgaaaaaagttgagcagagcctcagggatatgtgggacatcatcaagcacaccaacataggcataataaagtcccagaaggattggagtgaaagaaagaggcagaaagaatatctgaagaaatcgtagtataaattgtttcctatttgataaaaaacactaatttgcacatgcatggagattaaggaactcaaaatagaatcaactaaaagggatccacacctagacaaatcatagtaaaattgtcaatagccaaggacaaagagagaattttgagaacaactcatcacctataagtgatcaataaaataactttctatctgaaaccatggtggccagaaatggaataacattttcaaagtgttgtaataaaatcattgccaataaagaattatatacccaaataaattttcctgtgaaaataaagagaaaattaattcccagacaaaaattctgaaaaattaatccctagcagacctgccctaaaagaattactaaatggggctttctaggctgaaatgagagataccaaagagcaacttgaattcacataagacacaagaattactgttaaaattaactacataaataaatataaaacattataaatatatttttattagtaactcttctgtctgatttaaaaggcaactgcgaaaagcaataattataaaaaagtgttgatgggcttataatgaatataccaataatttaaactgattttacatttaaaaattattaatgaatttatttatggattaaatgttaatgcagaaattagatttcctcatctttacatgggatatttatagaaagagacatatatatcacaattaataataaactatcaaatgtttcccattaatattaaataacacaagaattgtgactaccatattactgttatcattcagtatttttctggattttctagtgcattcagtcagaccagtaaaagaaaaataaagagagatataattattacataggaagccacaaagctgcaattattttcaaacaatgatttaaaaatacatgtttattagaaaataattttaatgaaaaccccccaaaagttagtgctaatagcttaggtaggtgaattgacaagacattatctaaatatacaaaacccaatagttttcatgtacacaagtcattaccaaccaggtaatactgaaaaacaaatatgtaactcacaatagtaccaagtgcataaaatatctatgaataaataggagcccagaatgaaatatttgcatcctatatagtagattaagtattaataaacatccagtagaaatcagcatatcaggaaaatattacttgtaagtcaataagataaaagacacaatacagtagcaaaaaagcagaaatatgcaggcaaaatttcttaggttaaataattgatactgaacaataaaccactttaaaagttataaaagattatcaagcttgtaaataaaccagatcccattccgggtatagttatgcagttcaatatggtaaacactagtcacatgtggctttttaaatctaaattaaataaaattaaaaatttaatgtcttaattgtaccacccaaatttcaagtgctcagtagtcatatatagctagtggctactatattagacatcatagatacagaatatttacatcaatgcagacaattctactgagcagaactggtctacgaggtttaaattagttatgtgggaaatgggccctggttcactattggtgggagcgtaaatgtgtccagcttttatagagagaaatgtggcaatatatgaaaaagttaaaaatggattaagaacattatttcttagtgagctatcatcatttttgtacatatgtacagaaagataataaaaggacactcataacattattttatcatgcacagcaaataattggaaatattctaaataacattgacaaatatagttagctaatttacataacctattaagtgaaaaagcaagtaacaaaacaatataaatagtatattatgtgtgtatgtatgtgtgtgcatttgtgatatggtgagactttgtgtccccacccaaatctcaccttgaattataatccccataattatcataatccccacatggcaaggtggaggtaattgaatcatgggggcagtttcccccatgttgttctcatgatagtgggtgagttctcatgaggtctgatggttttataaggggctcttcctcctttgctctgcacttcttcttccttctaccttgtgaggaaggtccttgctttctcttcacctttccccatgattgtaagtttcctgaggcctcccagccatgctgaactgtgagtcaattaaacctctttcctttatatattaccccatcttgggcagttctttatagcaatacaaaaatggactaatgcaatttgtaaaatctgtgtgtattttttgtaactggaagaaataggctttcaaggatgctcgataaacttttacaataatattatataatagttaaccttagagagagttgaaatttaaaagatactatcatgttttgctcttctgcagtgttagagttttattcttttcataattaaaaaaaaagtttaaagaaaccgtagtagtagaagcagcgccctaagtatttttcccaccattttagagatttcatccatttcagagaaacagttaacattgtcacaaacactaagaaaattattagtgtcatacacccactttcctcaaataatggctgcaattcagatatggaattctgaataataaaaaattatacatacttaagaaagaaacataaaaaatacttttctattttctaatgtattactaagttcagtgaattcaaatagaatccaaactgtggcttgattgtatctatactgaaacaacatcaatttttcatctttaactgtgtgtgtgctattaactttaagcctgattcatctcttgagggctgaggtgacatactcatgtagagctatcctagaatacagccaagagcatggaaaacaaatctaattgtttttgtaaaagtgagaaatatacatatattattttagctggaactttcagtcaactggtagaaaaattcaaatttcattctaatatcagaacttacagttaaagcactaaaacatatttatcagattctcctttagtatacacagatgatttcttgtgggtatgaacattttatatcctatatgtccctatcactttgcatgtcaattttaataactttaacatgtttttgataaaagtcacacctaacatttatgaataatttaattttactatataaataaccatttctatattttctcatttaaatttcattagtacactttctgggaaaatgctgtctttgtgctgttaatatcattatgctgattaagaaatacattggacaaaacagtaaagtagtaagatgtatttctaagatgtcttctcttaaacctttttaatatttctctccctattttatctactgtcttcctcccaccataactgaagcgttctgtgttgtttcccactgcagtggcctatgaagaccagttctttctcatcatggcttaatgtttccttctacagaatttagttatcccatctcttatcatctcagaatgttggtttcagctagttttctgtttggaggcaatataaaatagtggtaacaaaaagctttcttttgaagtgtttacatccaaatgtacttatgcaaccaataggaataaaaacataatggcaaagttacagaaaaaaaagccaatcaaagaggtagagcattttgagatggggatgtctggggtcctttaagacattacccaaaagcctcgttagccctgtataatgtttcatactggatattccaattagtatgtctgcaatgtgttttatttataaatgttgaatttttcccattatgtttcaaaaaagatgtgatggatatattattagctacaacattattcttttctatagacagtaagacctgattcatacaacctctcaaaggcatttctgtcaaagagcagcaagagaaaactgacagcagaaatcctaaattctagttccttattcaagcttgttcccaatttctttttcttttcttttcttcttcttgttttttttttttttttttttttttttttttttttttggacaaagtctcgctcttgttctcaggctggagtgcaatggcatgatcttggctcaccgcaacctctgcctcccgggttcaagagtttctcctgcctcagcatcccaagtagctgggattacaggtgcctgccaccgtgcctagctaatttttgtatttttagtagagacggggtttcaccatgttggccaggctggtctcgaactcccaacctcaggtgatccgcccaccttggcctcccaaagtgctgggattacaggcatgagccaccatgcccagccacccaatatcaaggttatttatcaacagatactttcttaaattattacatgaaaggattttgtgaaaatctatattagtataaagaactacaaatattgcccagaaaaaaatagtcatctttgtaaaaggctgtagatacaaaatgcaagcaactccggagctaaaagagaaaaggctacttagatgccaagggtctctcctcaaaaatatatttaaatttgtgttataaaagcaacatgtaactgggacatcatatgtttttttgcagctctgctggtgactatgtgttgcctaaatcacctaatatctttgggcttccttacatcatttgtgaagtgatggagcttgaataatagaatttctaaagattctctcagctgaaccattgtttgagtggagattcctctccctctcagtctagatttaaaaaaattaaactgtttgagctaattgtagattcacacacagttgtacaaagtaagacagagagatcccatgtaccagctacccagtttcctctagtggtaacacgtatatagtgcacaagtatagtataatattacaaccagaatactagcattgattcagttaagataaaaaacagctcactatttaatttcttagtattattcaggaaaaggtagtataatttttgacagcttactgtatggagtgttttacatgctttatgtcatttagttctaattatacaccactttaaagacaaggctcagctaaaagcagaagaatcaggttcaagttctgcttgacttcacagcacttattcttactatttagcatgctgcccctgaaacagatctcaaagatctttatcattgcttcacatagcattacattgtgccacatatatcactagaaatatatgtacattatatgcctttgttttcctcaggaaaactttgtttacaatcttttacagaggcacaggcctgggaagatttaaaacatatccaggtctaggtcaccccgcccctcggtcatttggccaggattaaatttgcagcatctatcttccaggctcccttctttcttttctgccttttacacgatagcctcattttctgaataataaatgatggcagaacacagcacagaaagaagagacactttgaaaggagtcatttatatgttccaagggaggaaaagtaattttacaatcaaatctgctcagatgagttccttatttctataaaataaacaaaatcacacttacttttctatgaagacataaatgcaaaattgaaaaccatgctgattagacagtcttctaccatcccctaccaatctagtagagtgcaaataccaaagtctttctgagcctgtagggactcttaaaccactgtaacttgagtcccttagaagtaacactggagtaacaattaatttacacaataaatatgtattgagggcctaccaaatgtcaaagttaaaaaactgagtacatatggggaaccagaaagatacagctcttccgtgatatatatagaatataaatatatatttatttcataatgaataattttatacaaatataaattattatacaaattagatttgtataattatataattatataagtagacatatatttacatgttatatacattatggaggggattcatgaggcattataataacatataaaagggcaacttaatagaatatgagagttcagagaaaatttctttgagaatgaacatcaaacttggaaactgaagaatgggaataacttctgcatttggacagaagcctgtggcctggggactggtatcttttgtgtggctaagtgcttgctcattcacttacttggaaattattcctggctgtgcactgtgtccttctctggggctgtcagctggaacatgtacacatggcatggcctctccatgtggcctgggcttcctcacaacatggtggctgggtgtcaaagatgaggagagagagagaatgtgagccaggtggaagcagtatcacctattatgctgcagtgccctagactagaaagccacttggcatcactcatatttcatttttttttaatgtagtcacaaaggctagcccaattttatggggaggagaaatagactttacaccttaatgaggagtggtaatactgtgaaagagcattaaaacagcaaagattgtatttttagaaattttggggaaatgtaatctacctcaaataactatcatagttcaaacctataaaacagagtacagtttagctgccaccttttagccaagtgaggaaaagctgcaagtccattttgtagagccacaaatgcaaaacctaaattttaattctagattttatgctcaataaaaatgcaattttctcacatatatattttatatattcatttccacttgttcaactatgtgtcaaatatcaactatatttcaatttcaatctctcagaattaagtgaataaaaggcagatttataaatagattttatcaagcattaactgttttccactttctgccactttgaccaaaaaatcatttgctttctaaatgaatttactccattcactttaaccaatgcccccttccttttcttttggttatctctgtctgccactttacttattactgtctgagaaaacataatattatgactgcaacaaatgtattcaactgtcctaatggaaagaatcccaagggaagatggataggaataagcaaagtgaaaagagaaacaccaatgtggctagtggttgcgtgcagggcctctgatttcaaccacctgagtttgaaatcaagctccaaaatttgccatttgtgagactcgagttacttaacctttttttaactttggtttcctttctgtgacaaaaacggttattataacagagccaagcaaattgagttatttaagtataaaactaaataaagcttataaaccatgcccggtgttaggcacatttaagccctcgggaaaagttagctattgtagcaaaattatttatattaataggaaagaatggtacctagtttacctatccaatgaaggtaagcacatagggaaatggatatgggattattatcatatgatgtttcctcagacattcagcctttcagtacagtaggcttcagatagccctgggataataaattagtatcatcagggatacagcatgaaggccagtgacattggcctctcctgtgtacctagacctctcatagtttctccccacaaatctgattgggttagcttcattatcatctacagtggtctctgca

SEQ ID NO: 35 - DNA, 7396 bp, Homo sapiens
aaggcttacatgatacacatgactagtttagaacatagcaaatttaaacctgggcacactaaaagacattaggggtgactcttaggtaacagattttatcccagtaccatacaccctctagttccgatatgaatgagatttttagaatttcagcttgagtaaaaccaatcaataattctgccatggagggaaaaactaccttgtttattttcagaggcagccacaaattatgcttggaccctagacaaagtgaaaaaataacataaaagcttctaatgccaatatggtttgaaaggccttatgggaaaaaattaactaggataaataaataaattttaaaaaatcagtggcctgactcaaaatgacagattgagcaatgcacattcattcacttttctgccagccaattctactgatgtaacagaaagaaaatataattatagggaataaacctgaaaaacaaggatgtttttcaacgctaggctagaaattgtgaaaaattctagaagctagaaagtagacaggatcaaatggtaaaaaaacaaaacaaaacaaaacaaaaaaaacaaggacagagaaagctacagccagaatgtacgcagtgacaaggtattggatgggaaagggcagcttatttcccagagaaattccatgttcagaataaacaaaaacataaagcaggaaggacgtctagaacaacaaccaggattattcagcaaaggctgctatcaacacagtcctccaatttaaagggtttacattgtgttaaataggatttataaaataggagttataattagacatgtcctagataacttttagaaacctaatgtgttagtttcctagaactatcataacaaattaccatgaactgagcagcttgagataacaaatttattctctaacagttcagaaggaaagaagtctgaaatcaaggtgctgattcactactgctgctccctcggaaagctttagggtaggatccttctttgccctttccttctggtggttaaccagaaattcttggcattccttgacctgcagacacatcactccaatctctgcctctgtcataacatgacattttccctgtgtgtgcctatattcaaaattcccttttcttaggattccagtcattggattaggttctgccctaattcagtatgaccttctcttaatatgattatatctgcaaaaactttttttttttccacagagggtcacatttgcaggtgctagagattaggacttgagcctattttaggagaaaagttcaactcctaacacctaagaataaaaaagctccaaaatctttcagaatgaccatcactaccaacaaaaatataggttacctgtaaagaaacaaaaattaaatttgcaatagccttctcatcaacaacacagcataggagaataaaatggagtcaggtcttcaaagtattgacaagatatagctttaagctaaaatactataccaaaaacaaaaacaaaaattattactcaagttgaggacaaaatgcatacttttttttttggtatgtatatcatctaaaagttagcccgttggacaaattgccatttctttgtggacccaatcgccatttcccatcttttttccccatattgcccatgtataattccagccaatgataagtggaattttgccataaggattatgggaaagtttctgatctactgatacatatgctactcttctttttctcatttttccaactagaaagcttgcctaagatctataatggtatctcttctgcaactatcaggagaagaaaattgtagacatagtggcctgatatgtagccctgaaccaagtatagcagccatctacatctagtcttctagttacaagaaccaaatacattcctatatctaatttactgctataagggtatcttagttgtaggtaaagatgtccctaattaatacattaccattagatcctttttgaaattactattttagaatttactccccaaaaggaaaagagaatctaagagaaggataaaatggaaggcaaaaaatagtgatgagcaagaaatcagtaaatgtatagttaacattatgcaagtgttgattgaattatgaacaaattagtaacaattttgaattcaaatccaagacactttcaaatatgtgaggtggcaatttgggagagtagcaaagtacaaatggcataaggcttttgttgtatttggaggattaatattaattgttgttatgtagaataaaatacaagtttaattttttattaaaaattaatatgatcactaaaagaataagaaatggatttaagttctaaaacaatagagagaaaagcacaataagtaaaaaattattccaacgaaggtagaaaaagtagaacaggaaaacaaaatcatgctgaattaaaaaatataaaagtgcagaaaaaatttgaaacattatcacttcccataataaatgtttggcaagttactcaattttttgaagaagggttaatcacacttggtagtgtatgaaatacacagctgcaagctatttgcaggagcataataatatgactttattacaaatgtagcattttttggtggttacttgagaatattgtgctacagtccttgagttttagaggagtggtcaggatgagtctgaagggggacttactgaagggccaagaattggggggtccctggagtggaggcaggggacaggatcaaagggctgccgggaaatgttggtgagttttcatggtttccctctccttggtatgttgggcagatcagatagaccaagtcagctggaatctcatttaatttatgtagaaatcctacaggcaagggaaaagatttctgcctttagtcatcctggggtcttcctttaataatgaattttcttggagattagatttgaaatattaataagctcattctgcttgaggatcttaaagaagctttttagttattctaccccctattgtataatgtgattttcttagcctttttctactttcaggacaagagccagacacaatcgtgcgacgggaaaagtttgtttttgggtgtcctttccaaattcatgtgacttactttctcacacctactccaccaaatgcctggaatatgcatgctgcctcagtccaatgtacatagcctcctgtcatcatggttgttgtcccttgtccattccctagctaatcacttcagggaataatctttgcaggtgttggaggatgctaaaagtcaatgtaccatgcctagcagagctgttacattttagctaaagatacctgaagactgagaaaccttctaatgtataaatgaacctttgaaagtagaatttcaggtacctgggctggctatggcagaaatttttaagcttgaaaaaaattttgtgtgtgtgatttttttgttgttgtttatttgtttaatctacagaacagagagaactgggccagcattgctttacaggccatatggtaaccaatactattttgatctgcattacagagttttgaaaagatgtatttcctcaggatattctcctaatcctagtacaaaacagtgctgtaaagctgcacacttcatctgtgcataaggcttaccccagctactggcatcagatatacaatgcaaacaatgccaacaaatggattttaccattctctacctttaggtcaagagaagccatatattcctccattatagttttcaggagagacacaagaatacaattcaacagactgtacagttttccttcgttatgttggaatagttttccttcattttgagaggaagtccagaaaggtgatggctgtgataactcacctggtgaattaaaatagccacctgtttcaaaaaataaaaagcaatctcagaggatcagaaagaaatataacaattatagccaagattgatatttatagtaattacattcttatttgaataatccctttttgtcattcttcaaagcacagtacattctatttttttcatgacacatttctatccaactgcctcctttaaacatgcccaaactagcttctgatgacttcaccattgctaacaatttaaagataattccctgtttgacatgatttttaccaaaacagtaattcctgaacaatgaatggtatctagtttaatatcaatcattaattgttgaaaaaatttcttccaacaaaatttaagccaaaccaactagttagtgatcttctatcatgcattcacattgggataacaaaatataaaatgaaagaaaccagtagttcctgcatgtctactatggttctaatatttaaacataaacaacctcacttgaagtcagagaagccagcttcccaaagttacatagatatataactttgaagtattagattcacggtttgacttcaaatctgggcaatttgaagacagaaaaaaaaccagcaaagcatgctgcctccagctgtagaaagatctgtcaaagtgtaaaacgctaggggtaagactaaagagcaaagagaatgcctcaacaatccaaactatttcagacgatggacagaagaaagaaaatattccaattgtcaataattctgtgacaggaactgtagtggatcttgcccttctggaagtggggagcagaggcagggacttcctatggatccagatcctgagggcccaaagtatgaagtctgtagctggaagaatagattcagtgttgggacaagaggtgctcttgacattgaagataagccaggagtgagaaatactgtcaccaagtctctgggatgccccttgccagcactaccccatgatggcaatgccaaacttaagattgtatctcctctccagcatcacaagtaatcagtaagattggttctttggacataggaagagtagcaacctcttgctggagtagtaggagaggcctgtgtctgagcacagcatgtgaatggtatagatcatctagccatgccatatgcatggagaaaatagatatctatgtagaagtaaagaactaaaaatgctgtacttgtgaaatgccctaacacaggaggctcaggccttgggtggcatggagtgactatagcttaacataactctgggaaagaaaggcatcttctccctttcccgaaaggctgaggagctactattagaccagcagttctggtttatgattcagtcacctcagctgattggtccaccgcccttgtcccacagctatactgcacagcctttagaataaaacagaaacaagcaagggatctccccccaggcaaaaggctgctcagatgatctgcttttccgtttcaggaaagatactaatgaggacaaataccttggattaagaaagtgctagaatcctgttatttatcagggaatgtgggcatgtagaaaaggtgactcagagccacttagttttatatattaaaaatgacagtttgtaccccaagcttgtaagtggaacaaattagttatagtaggtaccttccttcctatagtatctgtctctccatttcttattcaaatattataggcaaaccaatctagaacagaagcttgtgaatatttctgaccttgaaccccaaataagaaatatatcttaattgtgaagcagaacacacatacgtacgttttaaatggaaacaagatcttctgaaaacaatactttccttgatcacctgcaaggcactctgatattttctctcctattttattttcttttaagtattggttaagtatgttgctacctgcagtttgaaaatcactggcttagattagttcattaaaaagaaactaaaactatctgtgtgtgctttgaatgggtttcatgaaaccatcttattttcaaagtgctcataagcatctttacactagattcttctagaatttgtttggaacaatattaatttcacttgaaattaatattttcctccgttacacatctaatttttagtccatctctaccttcctacatgttttatattcatatactcaaattgcactaactctacttctatgataatatctgtcttctttaatgccccactttatcaaggcattttatttgtgcatctaaacttcattttatccaaagaagttaattgttcagctacaattttttaaacgagatttttctgttctttctagcatgaagtcattactgattttttttcaaaaataaaatgtggggctgggcgcagtggctcacgcctgtaatcccagcactttgggaggctgaggcgggtggatcatgaggtcaggagatcgagaccatcctggctaacacggtgaaatcctgtctctactaaaaatactaaaaattagcttggcgtggtggtgggtgcctgtagtcccagctacacgggagactgaggcaggagaatggtatgaacctgggaggcagagcttgcagtgagctgagattgcaccactgcactccagcctgggcaacacagagagactccatctcaaaaaaaaaaaaaaaaaaaaaaaaaaaaaaaatatatatatatatatatatatatatatatatatatgcatgtgtgtgtttatacatatgtgtgtatatatgtgttgtatatatatgtgtgtgtatatatatataatttcaatttgtcaatagtatattttggatatttttgcaagttactctattttcttttctacaaaaatctgtcaacatattgctcgggcttctctcagtagccatttgagaatcttcactgaaattttcctacttaaagttttagatatttcacaaaacctaaataataaacattacagcttatgaagatattgatcatttaagctcttatatcagacaaatgtttttcttcctctgaattgtcattcatataattatttggtaattgctaactatacgtaaatgttatttatttttgtcatttaacattgtatacactgatggtgctaatttccccccaaaaaagttttaaatttcctgagaagaggaaatagtataataccattcagttcagggtgaacttttaggaattaaaaaaaaaattgatgtataatttacatacaataaatgcatttcctaagtgttctattttgacaattgtggatacaacctaaataaagaaatagaacatttcaattaagatgtttcaatttcaaccttgaaccacagaaagttccttccattgagcccctttccagttactctcctttccaaagccactcactttctgatttctgcattgagaactgtgaagggtctgtgatctcacccttcttgaaagataataagttatcctgctgcagtttaacagattctggcagaacacatgagttgtgataataatgaaacagccttggattctaagcaaatgaagcactaaaaatgattagagctattaaagccaacctcataagaggtagtgagcaaataa

SEQ ID NO: 36 - DNA, 819507 bp, Homo sapiens
tatttggttcatttcctcatactctttctgctacaacactacgtaagacctctgctaagaagactggatgaggtggtgcatgagtcacatgcctcaccaaaaagtaaaacaaaatatctgaagttaaaaaattatactgatctagaaacatactcctgcattattgtagatataaatcaagttatgcacagaattcaaaacttttgagtttgatctttctttaaataagtctccttagcttactattctgccctccattttgttggggtttaatgtttggtgaactgattatgtttatttagttagatatattagaagagtgaaaagagcattcctcagctaatgtctggttcttctgcttaacaatactatgaacttgtcatgctcaacttatacaaatacaaaactagtatagtataaaatttggtgttattgatgtcaagatttcatattagataatgaaataggcagggattgtataatatgtatagcttattaaataagtacatgttattagattttaactgccttacattatcttctttgatgtctaaaactgcatgttgatattcaaagtaatgtaaacttattttttctgtaaactgcccataaaaggcttgtgcttctggtacccttgaggtccaccagtagccaccccatgtcatcatagtgaaaatatgaatgagattaaaagctctgaatggaaacaaaatagtattttacatactttcttactcaagtgagttgggttaaacaaataacaatggaagaatattatttttctcatttttacatggaacatttatcaagagttagggctataaaacacacctcagcaaatagaaaataatgagaatcatacaaggtaaaatttcagatcacaatgaactaaactagaaaccaacaatagaaagacagatagaaaatccctatatatttatcacactgaaaaaccatatgggacaaggaaaaagtctcagataatattaaaaaaatgaaagaaaattaaaatatgacaccaaatttgtatgaggcagaaaatgaagttcttagagaggaatttatactacatagtattagataaatatattagaatagaagaaagattgaaaaatcagtattctaagcttccatcttagcaaaatagactaaagaaagcaatttaagctcaaagcacaacgactaagaataccataaaaattatgatagaaatcaataaaaatgaaaacaggaaacaatgaaatgcaactgtagctcttggaaaatatattttttaagattctctaggaagactgaccaagaaaaaagaacgtaaacattatcaacatcaaaaatgaaagaggggtcatcactattgatcctggggaccctaaaagagaatgattcaagcaaactacagagaactcagtgtccataaatttaatttagatgcagtggagcaattcctggaaagtacaaactaataaaattcacataatgagaactatctaacctaaataactttatatccacaaggaaattggatcaatttgctgagaccagctcggtcagggaaaccctaacccagtggagctagaagaattaaagacacacacacagaaatatagaggtgtgatgtgggaaatcagaggtctcacagccttcagagctgagagccccaaacagagatttacccacatatttattaacagcaaacctgtcattagcattgtttctatagatattaaattaactaaaagtatctcttatgggaaacgaagagatgggctgaattaaaggaatacgttgggctagttaactgcagcagggacacacccttaagacacagatcgctcatgctattgtttgtggcttaagaatgcctttaggcggtttccaccctgggcgggccaggtgttccttgtcctcattcccataaacccacacacttccagcttgggcattagggccattatgaacatgttacagtgctgcagagatttcgtttatggccaattttggggccagtttatggccagattttggggggcttgctcccaacatcaattattctatgatcttgcaaaaaataaatcaccaggcccaaaagttgtcaccagtaaattctaccaaatatttaaggaataaatgatatcaattctccaccatcttttccagaaaatggaagcagaaggagcactttcaaatccattctatgaagtgagaatcagcctcatacaaaaatcagaaagcacattacatgaataaaaatgcatagaataatatatctcataaagatagagacaaaatcatgaccaaaatattagcaaatccaatccaatacattttcacattttgatgcaataaaagttattttaggcatgcaaggctggttcaacatttaaaattaaaatcaatcaaaacaattcaccacattgacagactagagaagaaaaaacataggatcacagacttggcatagaaaaacatacatttgacaatatccaacactcattcatgattaaagaaaaacttttagaaaagctgtaatgaaggataactttctcaatatgattaagaacatctgaaaaaaaaactgttcaattagcatcatacttaatggtgataggtggatgctttctcccaaaatcaagattaggggaaagatgttgctatggtttgaatatgtgtcaccttcaaaactccttgaaatttaatacccaatatggcagtactgagaggtgaagactttatgagttgactggctcatgagggctctgcctttatgaactgatttatccattcatggattaattggttgatgtataaatgatttataatcggagagaactggtagctttataaacagagaaagaagaacttggtcttccacatgagcatgttcagctccctcaccatgtgataccctgcaccacctcagggctttccagatctttatttcaattaccattctccaattacagaatccaagcctccttgaagaaatgaataattttagactgataggaactattcaagatgagccaggagcatattgtggtaacaggaaataagaaaaaatttacccacaataatgaggacaaagggacagaggggctaattggaagagatcccaatagccaaagatgaaacaatctgagcaacagaattaataaagtagtactggattataacccaaattataaaataaatatatccaagtgtccatactgatacaaaaaggattgtataaatcaataaataatgaaagagaataggtaaatttcctgttcaggatgatttcaaattatttatgtcatacgtggcctttaaggaagtggaacaatactccccgctccttacttgtgggctgtgcatggtgactaccttccaaagagtacagtatggaatgggagggaaagaaaaattaactttacaatggagatgtctgacaaaccctaactcaagttagatgattaaggtcaacatcaacagcaataagatatattcatagcatgcactctcaatatgatgtgatgagaatggtactttaagtctcgtttttcttcccaaaacaattactccgatctaatcttgagaaaagcatcagacaaatcccaattgagggacgttctacaagataccttaaccagtgctccttaaaactgtcaaattaatcaagaagaaggaaattccaagaaactttaatgattaaaagtagccaaagaagacattactactgaatgtcaggtggtattatgtatcagattctgaacagaaaaaggacattgggtaaagactggaaaaatctcaatgaaaaatgcactttattaagtactttaacagttggttcattagttttgaccaacataccatagcaatgaaagatgtttacattggaattatctgtatgatctttgcaataattatgtaaatataaagcccctgtaataaaaaggaagtaaaagtttaaccgtaaaaagggaaccatatatctacatcaatatcttcatctctcgctctctgtctctataactatttttaatttaaaaattattttgaatcatctggggatttttttcaacatactggtgattggatttcaactccactcaattatatgagaaaatatagtgtaggtttttggcattggcatcaaatttttttaaagctttccaggagatagtaatgtgtactcagtattatgaacaattgaattagatgaactgaatgattactcctaaagaaatagaaaacctgagtattttaataaccacaaaatacagggaatcaaacacaagtggctttatttgtgaagcctaacaaatattcaaataacaggtaatgcctagattgtttaaacttctctaaaacagcgaatactttttgaaaaagttttattattctttctaagaagtgagcataacctgatatccaaagtcatctaggggatcacaaaaatgactccaataacaacaacattatagaccaatctcactcatggacagagatgacacactatgttaaagaaatattacatcaagaaaaaatagtttttatctcagaaatgatcttatggtttaacacaaggatattcagtgatgtgattcactgtactaatagtttaacccacataagtccagggaggaacatattccagtctttgtataaaaccttagtcatattaccaaattaactgtaaggtatttaaaacctcctctgaattcacaaaacatatgtcgacttcacaaatcccatctttgtgcataataacacttcaaaaaattctttttaaatgtttcttctacatattcatcaaatctccagaaactgactcaaagacttttcctcctacaaatttatccccaaacctggcctatacatatacagttcactacttaacacaggtttgagctaggcaagcccatttataggtggattttcttctgcctctgccacccaagatagtaaaagtaaccccttctcttccttctcctcttcatcctactcaacataaaaatgatgaggatgaagaccttgatgatgatccatttattatgatgatctatttattatgatgaatagtaaatatattttctcttccttattaatttttaaatattttatattctttagctaacttaattgtaagaatacagtatctaatatatacagcatacaaaatatgttttaatcaactatttgtattattgttaaggcttccagccaacagtaggctactattgtcaagattctgcagagtcaaaaattatatgcagatttttgacagagcaggggttggtacccctaatctccacattgttcaagatcaactgtatactttcatttcttatcccatctaacttcaatactctctttctttttccccttcattcaaacattaattctctgcactttctaaagcaggccctgttagattcatagcttttcctaatctgcttttttcttagaataacccatacaaaaggctaaggggccaatgagacaacacagaatcattttaacaagaaagaatagtggaagaaatggaaagcttcaaaatggaacttcaaaattttccttaattggtgagcaggaagttaaagaagttaattaatttgagttaatatgtttcactcagccataatagattaatgggttataacctcatggttattttgataaagttaaaaaaattcacttaccaaaattcaaatatttcctaataaatatatcttagctgtaaatgaggaacatttcttaaagtcagcatattattaaggaatcatttcaaaagttagcagaaaggatgaaatccttcattaattattttggaaaaattgtctctttggggtaaaaaagggggataatatagaatatttcatattatactcacaaatatactttggttgggttaatactaaaaaatgtatttagaatatgtataataataaaatataataaattataataacagagtagtcatgataaaatgtagtaaaactaaataaaatagataaaaatgtgaaaagcaattccagtcaggtgcggtggctcattccagaaattccagaaatttgggaagtcaagggaggaggattgtttgagcccaggagttagagaccagcctgggcaaatggtgacatcccgtctctacaaaaaattaaaaaataggaaagcagggcatggggacacatgcctgtggtcccagctactagggaggctgaggtgggagaatcacttgagcctgcagagcaaggttgcagtgagccataatcatgccagtgcacttcagcctaggtgacagagagataccctgtcatttaaaaaaaaaaaaaaaaaagaaagaaaagcatttccattatttcccagtgtgtaaaacccgcttacagaacataaaatctttaatgccctaagaaaaaataggcagatttaaatcaacaataatgaggatcaaaataatgacagatattgtaaatgcaattaagaaacaagcaacaaattaggagaaaatagttgcatcatataaaatatatatctggaacattcctataaattagatttacgaaggcaaacaacagagtagaaaaatgtgcaaagaataggaacaaaaaaataaatccaagcaattagtaactctaagaagaaatttctcagcctcccagaaataacaaaaatgcaaacagaaatacaaataattagggtatgtccttttgtttattaacaagataatatggtttggctctatgtccccccaacaaatttcatctcaaattgtaatcaccatgtgttaagggcggtgggacgtggatcatggtaatgggtgcccccatgttgttctcatggtggtgagggagttctcaggagttctgatggtttaagtttcccctgtgctttctctctcctgctgcctgtgaagaagttgcttgtctctccttcaccttctgctgtgattgtaagtttcctgaggccttcccagctatgtggaactgtgagataattaagtctctattctttataaattacacggtctcaggtatttacagtagtgtgaaaatggactaatacacaagacaaaactaaaactgaattggcaaagcaaacaggcagccttatcaaagaagcaatttggtgttatttgcctaagtctaaaaataagatcaaatagtctttgacccagtaaatcaatttctaggcattttttgtacatgtgtagaaacatatatatatattttatatatataattttaataaaaattggagataaatatggtttggctgtgtccccattcaaatctcaacttgaattgtacctcccagaattcccacatttatgggagggacccagggggaggtaattgaatcatgggggctggtctttcccatgctattcttatgatagggaataagtctcacaagatctgatgggttcatcaggggtttctgcttttgctttttcctcattatctcttgctgccatcatgtaagaagtaccttttgccttctgccatgattctgaggcctccccagccatatagaactctaagtccaattaaacctctttttttcccagtttcaggtatgtctttatcatcagtgtgaaaatgaactaatatagaaacaatacaaatttctgtaaatttttagcaaggtaaattgccatctaactacaggctacattttgcagccttccttaggcctgaaggtgatcctataccaattctgggcaatcatatgtgaatagcaatgatttttgcaatttctgggcagtaggaatatcaaacagaagctgttagtttttcatttcttctattatttctgccccattatatgggccgtatcaaaacatggtggagaggaatcagctcctcttgtggagatgacaaaaacgaaacaaaacatgttagtggatggatggaatctaggtcaccaaattatactttccatttgacttaagcccctattatttggttccagataaagaggttgaaataatatctcaaccaatgtagtagtaaatgcacacacattgagcctgtgactctgaaatatgaaaacactgttatagacacttttatcagaattcacatacaggtttacattcaaaaccaaaaaactgacatgctgacatctccaaaattcttaaagatacaaatctcaagcagtttagatttcatcttagttgcatcttttttactaacctccaaagtaagagccatctgtcagcttcatttctttactggattttgtaatgacaccagcaacaccgtgttgaatgaaatacatttttttacccacggctccttctcgtatgatataatctccaggttgaaacacctcaaatctcaacttgctcagcatggcagtcacaaaattaggatccgcattagcaaataaaggcattgtagccaccagtttccgacagttgaagttgactatctcctaaagatgtcaagagtaaacaaatattaagagagatattaatcatatctggaagaaaaacatgctgaaatttaaaatatatacagcataacattgtaatttaaatttagatacaaaaattcataaattctagtaatgcgcatcatattacagtcaggattatgttttatttttatgttgaaatttttgtattcccagcacctagtgtagtataggaatgtattaaatattcgataaatgttaattcaatatatgaaagtctcaacttttttaacttcccatttctttactactgtgtatatgaaactaaaacttctaaaatgtgaatacattctattcttccttttatcttttatttacgaagaaagaaagccatatcacttcctattagctatgccattcctgcttctgtgctcctttttgtctgggcccagctaccagacaaaaacattttgatgttttttttttttgttagtgtcattcacattagagtgaggacaatggatagtacagaaaaaggttacacaaaggaaactctaatctaaaagtataaattcatcaggtgcagtggctcatggctgtaattccagcactttgggaggccaaggcgggtggatcacgaggtcaggagttcaagaccagcctggtcaagatagtgaaaccctgtctctactaaaaatacaaaaattagctgggtgtgctggtgggtgcctgtaatcccagctactcgggaggctgaggcagagaattgcttgaacccaggaggcggagattgcagtgagccaagatcataccactgcactccatcttggacaacacagtgagactctgtctcaaaaagattaaaaaaataaaattataaattcaactggtgtctgggctagaatcagaaatcattctttctaaagactcctgggattcccctgcaagtgatgggctagagagaggacatatttgccttttcctgacttgtttgttttattccaggatcaggccaattctcaaataggagatctgtatgtttgatttcattctgtggattctgatcaaggttagacatatttttatccctctggatgaaaatagaaatatggaaccaaacatttttaatcatgcaaatcacttatgtgacacagaagagacagtggaaatttacatttttgccacaaagccaattctcagaaatttccttaccaattagttaccccaaaaaaggttgggactgcatttgtgattttgtgtaagagtcacagaaattggtcatgtctgctaagaggtgaaaagaaggcagaaggaatcataggtattaacagagtctgagaactctatcttctgccttggggaaatgtgctataccgacccatcaattccaagactgagaaagaaggtttctatgatcttacttcataaaataacctaatgccatccaggatagataaagaattccaggtgataacagaaggcacaacattttgaatctatcttggaagagaaggtgtttcatcctgaacaatattttatgagtttagcaaagcacaacaatgtctgtaatagtggagcttcatggaagatgagaaaatatttacaaataagcaacaataatcagaaagtgaacctagcagcaaagacaagagaaagatattacatgtggtacttggtgcatcattattcaaatcaaaatacacacttgagtccacgattggctgtatctagggaaatttgtgataattttagctgatgcatggagtgtgggtctataacaatgttcagcaagtagtaagtactgaatcaatatgcatgcatataaaggaagccattcgaaggaagaaatgaaggaggggaggaaggaaagaaagaagggaggaagggagggagcaggtgggaaggaaagaaggaagggataaaagaagaaacagaagaagggagggaggaagaaaggaaggaaggaaggaaggagggaaagaaggaatgaaggaagcaaggaaagaaggaaaggagggagggaggaaggaaggaagggaaggagggagggaggaaggaaggaaggaaggtggagtctcagttgtaaaaaagtactcataaagactaattttctcgttgggagatggttacttaaaactcttagctttctcaagcaaatggcttgagagacaagtcttctgtattaaaaaatttgtttttactatttcaaatatttctatacaaaaacaacaggaagataaaaggtgacgtggagttaaaagaagacagagttatgtcatgaaaatagctagatgagttgattgagagttaattatttcacatgtaaaatgacagaataatactgtgtaggaaattgaaaataagtcagattgtagagaaaataagagttttcatataaaaataatagagaatcccttcatctttgtaccttgatttgaactatgcaaatgtttcacttcatggatctctcattttttattttagaaaatagttggaattatatttgataagcaattaacctgatctttagtcatatgaataacttgttaatgatacattgcatatccaggtgtttctgttagaactccctttattataacactactggaataatttcatattattgtttgaagaaatctattaatgttttcttccttcatgcaacttttacttcccaggagtattacctgattaaaactgtaaattctaacagatatgatagaaaaaatggtaatgagacagaatcttcttggattctaaaaacctttcattctcccatgaaaactgcttgttctgaggatgtctagtatagtagaaacaatcatgtaagtatagaatgaagcaaaactttaaaaaaatatttttaatcaatcacctttccttagggcacattgaggcaaataaaacacactgttactatctctaatgtcaattcaaattacttatggcacttgttataattagctctttttatcaaaatatcaggattgagttaggagtattatctatgtgcattaaattgaggaaaggttgcttgctaaggaaggcaaacacatggtcctgaccttagtaataagttgctccagattattaagtttatgttggcactttaaaaaatgcaattatttctttcctggaacattttgtagtacaagaaagtatgtacatggtaaaaacaaatgaaaaaacaaacagaaagaccaatccccaaaatgaaacagaacaagaaccccacagtaatgaaggtatttcaaagggacacaggggccaactgaaagagttaccaacggtcaaacaaagctggaaaaacttgagtaacaacaataaaaagtattggattaaacccaaagtataaaataaataaccaagatcacatacaaatctaaatgattggttaaactactaaaaagtgagggataatacataagctttctgtttaaattccaaataatttcaaataattcatataagcactcctgcctcaaaaagttggagaataattaccaaacccttaaggatgggctgagcattgagcatggggacttccttcaaagaatacaataaggaaaagaggggaaaagtagtaactttccaatagagaaacatgaaaaactccacctcaagtcaggcaatcaatgttaacatcaacagtgctaaatcatgttggtagcatgtactcttggtttgatgtaatcagaagagcattttacttttgtggcattcctacaccaaacccataatcccattttaatcatgacaaaaccatcagcaaacccaaattcaggaaagttctgcaaaatatttggccagttctaaagatgatcaaggtaatcaaaaacaaggaaatttggaagaaactgtcccagacaaggggagactaaggagacatgacaagtgaccataatgtggtatcctggatgggatcctaggatagaaaaagaactttaaagaaaactaagggaatctgagtaatgttcggacttaataataatgtatcaatattgagtcataactgtagttattacaaatgtagcatactaatgtaaggtattaaaaacgggggaaattggatgtgatgtacatgggaattctccatactatttctgaaacttttttgctgatatagtttggatgcttggcacttcatgtctcatgctggaatttgacccaatgttggaggtggtgcatgggaggaggtgtttcagtcatgggggagaagaacccacatgaatgatttggtgctgtccttgagttaatgagtgagttctcactctattagttttcatgagatctgattgctaaaaggtgtctggcacctactttctctctcatgtcctctctcatcatgtgacatgcaggctccccttccccttccaccatgattgaatatttcctgaggtcctcactagaaacagatgctggtgccatgcatcttgtacaggctgctgaatcgtgagacaaataaatttctttataaataactcagtctcaggtattcctttatagcaatgaaaaatgaattaagaaatctgcaaatataaaattattctgaaaaagcttattaaagatgtaattactgctcttcatagttaagaaaataaatatgattttgtcatagcatgtaaagcatattttctttaagttaactcttttaaaagttacttttaaaaagatctcctagtaaatgcttgaaaacaattatatcatagtacagtctggggttaagcagcaggcctggaatgtgtctgtttatattgttgtggagttaataactgtggtctgtcataagaagacaaattgtatatatatcatgcattttcaatttcagatatatgtttctatcaagtttttatttacaaataaaaatctataattatttctgtattctgttccattgttctatgagtctgttcttgtaccagtaccatgctgttttggttactgtagccctgcagtagagtttgaagttgtgtagcatgatgcctccagctttgttcttttttcttaggattgtcttggctatttgggctagtttttggttccatatgaattttaaaacagttttttctagttctgtgaagaatgtcagcggtagtttaatgggaatagcattgaatctataaattgctttgggcagtatggccattttaacaatattgattcttcttatccatgagtatggaatgtttttccatttgtttgtatcatctctgatttctttgagtagtggtttgtactatccttttagagatccttcacttttcttgtcagctgtattcctagttatttgattccttttgtggcaattgtgaatggaatgtcttctgagatttatccctcagcttgactgttgttggtgtacaggaatgctgacacaatttttgtacattgattttgtatcctgagactttactgaagttgcttatcagctgaggaagctttaggctgtcataatggggttttctagacatgggatcctgtcattcgcaaacagggatagcttgacttcctcttttcttatttggatgccctttatttacttctctttcctaattgctatggccagaacttccaatactatgttgaataagagtggtgagagaagataccctagtctggtgctggttttaaaagggaatacttcagcttttgcctattcagtatgatgttagccgtgggtttgtcatatatggctcttattattttgaggtatgttccttcaatacctaatttattaacagttttgaacatgaagtgatgttgaattttatcaaaagcctttcctgcatctattgagataatcatgaggttttgtctttagttctgtttatgtgatgaatcacatttattgatttgtgtatgttgaaccgaccttacatccaggggatgaagcctacttgagttttggtggataagctttttgatgtgctgctggattctgtttgccagcattttgttgaggatatttgcatcaatgttcatcaaggatattgggctgaagttttctttttttgttgtttctttgccaggtttggtatcaggatgatgcttccctcatagaataagttagggaggactccctccttttcgactttttggaaaattttcagtaggaatgctactggctcttctttgtatatctggtagaattcagctgtgaatccatctggtcttgggctttttttggttggtaggctatttattactgcctcaagactaaatgtaaaacctaaaactataaaaaccctggaagataaccaataccattcaggacataaacacgagcaaagattttataatgaagaccccaaaagcaactgcaacaaatcagaaattgacaaacgggaactaattaaactaaagagcttctacacaccaaaataaactatcaacagagtaaacagacaacctgtggaatggcagaaaattttgtaaactgtgtatctgacaaatgcctaatatccagcatctatagtaacttaaacaaatttacaaaaaaaaatacaaacaaccccattaaaaagtgggcaaaggacatgaacagacacttctcaaaagaagacatacatgtggccaacaagcatatgataaagagatcaacatcactgatcattaaagacatgtaaatcaaaaccacaatgatataccatctcacatcagtcacaatggttattattaaaaagtcaaaaaataacagatgctggtgatgttgtggataaaaaggaacgtttatacacccttgatgggagcataaattagttcagacattgtggaagacagtgtagtgattccttaaagacctagagacagaaataccattcaacccagcaatcccattaccaggtataaacccaaaggaatataaattgttctattataaagacatgcatgcatatgttcattgcagcacaattcaaaagagtaaagacatggaatcaacccaaatgctcatcaatgaatgactggataaagaacatgtggtaaatatatagcatggaatactatgcagccataaaaaagaatgagatcatgtcttttgcagggacatggatggaactggaggctatcatccctagcaaattaattcaggaatagaaaaccaaaagcctcatgttctcacttacaagtggttgctaactgatgagaacacatggacatacagagaggaacaacacatactggggcctatcggagggtggaaggagggatagaaccaagaaaagtagctaatggatactaggtttaatgcctgagtgatgaaataatctgtacaacaaacccccattatctccatgttcatctatttaacaaacgtgcacatcctgcacatgcacccttgaacttaaaatgaaagttaaaaaatctataattatttcaaagttagaaatatatattcatttattaaacacaccaaaagtgagggagaaacaaaaatgttgttccaaagaaattctctctccaaggaatattattacataatttatatagcatcaatatggtttttattttaaaagatctcaagttgcccactagcaaaagggtggatttcaaatgttactatttaaaatacactggttcaatttcttcttacttttgcaatcagcttatattagaaaatttgtttaaacatcttagaagggaattgataatttttgctaatattttattttgttaaaataagtcataagaaatatttggcataaacacccatgcagaaatgacataatttttaagttaaatgatattaagttctctggagtggacttgttgctttagtgttgataattatggcataagtgttatgatccatggaggatatgttgcccataaaaggaacagttcgatataaaagtgttgactgaagaaatgccaagaatgtgatttcagtaatattctttgcataaggtttctcattgaaaatgcatgagacctgcagctttatttattcctctgaggaaaacttcagacagagcagtaattgcagaggaagagtacactggtcgccttggaacctggagggaattttcaccctcaaagttcatcaacagctttctcaaatttctagctgtgggctaaacactgggaagccaagtaaataagctcagatgctatgggaaatgctgcaaactatttcctcaaatatttcaagtaagaaaaaatctttgttgtcaagaagagtccacgttggaacccaaggtgtacatatatttgtattcattaagaaggtgtcttaaaagatgacatgagatagaaatgtttatgtcagatgtttctgggatccacctttcaaccaaatggaatggttgtttcagtcttctaaaacattcaagcacacacttgggtgaagatttttcttatgcaatgccctcttgaggatgcttctcatttggcaaacggtaaccctgctaaagggtagtgctaagattttaaattgaattttatatattatatacaagaatgaaacagcataatacaagaatgaaacagcaataaagaatcttgttatttgttctttggttgacacgatgtctatttattttagatataaaagtatttgctgggggcggttccaagatggccaaagaggaacggctccagtctacagctcccagtgtgagcgacgcagaagacggatgatttctgcatttccaactgaggtaccgggttcatctcactagcacttgtcagacagtgggtgcaggacagtgggtgcagcccactgagcatgaactgaagcagggcgaggcatagcctcacccggcaagtgcaaggagtcagggaattccctttcctagccaagggaagctgtgacagacagcacctggaaaatcgggtcactcccaccctaatactgcacttttccaatggtcttagcaaacggcacaccaggagattatatcccgcacctggctcagggggtcccacgcccacagagccttgctcattgctagcacagcagtctgagatagaatcgcaaggtggcagtgaggctgggggaggggcgcccaccattgctgaggcttgagtaggtaaacaaagcagcctggaggctcgacctgcatggagcccctcgcagctcaaggaggcctgcctgcctctgtagactccacctctgggggcagggcatagctgaacaaaaggcagcagaaacctctgcagacttaaatgtccctgtctgacagctttgaagacagtagtggttctcccagcatggagtttgagatctgagaacagacagactgcctcctcaagtgggtccttgacccccaagtagcccaattgggaggcaccccccagtaggggcagactgacacctcacacggcagagtacccctctgagatgaagcttccagaggaatgatcaggcagcaacatttgctgttcaccaatattcgatgttctgcagccttcattgctgatacccaggcaaacagggtctggagtgaacctccagcaaactccaacagacatgcagctgagggtcctgactgttagaaggaaaactaacaaacagaaaggacattcacaccaaaaccccatctgtacgtcaccatcatcaaagaccaaaggtagataaaaccacaaaggtggggaaaaaaacagagcagaaaagctaaaaattctaaaaatcagagcacctctcctcctccaaaggaatgcagctcctcgccagcaccagaacaaagctggatggagaatgacttcgatgagttgagagaagaaggcttcagacgataaaacttctccaagctaaaggaggaagtgcaaatccaccgcaaagaagctaaaaaccttgaagaaatattagacgaatggctaactagaacaaccagtgtagagaagtccttaaatgacctgatggagctgaaaaccatggcacgagaactaagggacgaatgcacaagcttcagtagccaattcgatcaactggaagaaagggtatctgtgactgaagatcaaattaatgaaatgaagtgagaagagaagtttagagaaagaaaagtaaaaagaaatgaacaaagcctccaagaaatatgggactatgtgaaaagaccaaatctacatctgattggtgtacctgaaagtgacggagagaatacaaccaagttggaaaacactctgcaggatattatccaggagaacttccccaacctagcaaggcaggccaacattcaaattcaggaaatacagagaatgccacaaagatacgagaagagcaactccaagacaaataattgtcagattcaccaaagttgaaatgaaggaaaaaaatggtaagggcagccagagagaaaggtcgggttacccacaaagagaagcccaccagactaacagcgaatctctcggcagaaactctacaagccagaagacagtgaaggcccatattcaacattcttaaagaaagaattttcaacccagaatttcatatccagccaaactaagcttcataagtgaaggagaaataaaatactttacagacaagcaaatgctgagagattatgtcaccaccaggcctgccctacaagagatcctgaaagaagcactaaacatggaaaggaacgaccggtaccagccattgcaaaaacatgccacattgtaaagaccgtcaaggctaggaagaaactgcatcaactaatgagcaaaataaccagctaacatcataatgacaggacgaaattcacatataacaatattaaccttaaatgtaaatgggctaaatgctccaattaaaagacacagactggcaaattggataaaaagtcaagacccatcagtgtgctatattcaggacccattaatgtgctgtgttccattcaagacccatcagtgtgctgtattcaggagacccatctcacatgcagagacacacaggctcaaaataaagggatagaggaagatctaccaagcaaatagaaaacaaaaaaaggcaggagttgcaatcctagtctctgataaaacagactttaaaccaacaaagatcaaaagagacaaagaaggccattacataatggtaaagggatcaattcaacaagaagagctaactatcctaaatatatatgcacccaatacaggagcatccagattcataaagcaagtccttagagacctacaaagagacctagactcccaaacaataataatgggagactttaacatcccactgtcaacattagacagatcaacgagacagaaagttaaccatgatatccaggaattgaactcagctctgcaccaagcggacctaatagacatctacagaactctccaacccaaatcaacagaatatacattcttctcagcaccacatcacacttattccaaaattgacaacatagttggaagtaaagctctcctcagcaaatgtaaaagaacagaaattataacaaactgtctctcggaccacagtgcaatcaaactagaactcaggattaagaaactcattcaaaaccgctcaactacatggaaatggaacaacctgctcctgaatgactactgggtacacagcgaaatgaaggcagaaataaagatgtcctttaaaaccaatgagaacaaagacacaacatgccaaaacctctgggacacatttaaagcagtgtgtagagggaaatttatagcactaaatgcccacaagagaaagcaggaaagttctaaaattgacaccctaacatcacaattaaaagaactagaaaagcaagagcaaacacattcaaaagctagcagaaggcaagaaataactaagatcagagcagaactgaaggagatagagacacaaaaaacccttcagaaaaaccatgaatccaggagctggtttttgaaaagatcaagaaaattgatagagcactagcaagactgataaagaagaaaagagagaagaatgaaatagacacaataaaaaatggtaaaggggatatcaccaccgatcccacagaaatacagactaccatcagagaatactataaacacctctatgcaaataaactagaaaatgtagaagaaatggataaattcctggacacatacaccctcccaagaataaaccaggaggaagctgaatccctgaatagaccaataacaggctctgaagttgaggcaataattaatagcttaccaaccaaaaaaagtacaggaccagatggattccacaactgaattctaccagaggtagaaggaggagctggtaccattccttctgaaactattccaatcaatagataaagagggaatcctacctaactcattttatgaggccagcatcatcctgataccaaagtctggcagagacacaacaaaaagagaattttagaccaatatccctgatgaacatcgatgcaaaaatcttcaataaaatactggcaaaccgaatgcagcagcacatctaaaaggttatccaccatgatcaagtgggcttcatccctgggatgcaaggctggttcaacatatgcaaatcaataaatgtaatccagaatataaacagaaccaaaggcaaaaatcacatgattatctcaatagatgcagaaaaggcctttgacaaaattcaacaccccttcatgctaaaaactctcaataaattaagtactgatgggacgtatttcaaaataataagagctacttaagacaaacccacagtcaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattacaaaaagaggaagtcaaattgtccctgttggtagatgacatgactgtatatttagaaaaacccatcgtctcagcccaaaatcttcttaagctgataagcaacttcagcaaagtctcaggatgcaaaatcaatgtgcaaaaatcacaagcattcttatacaccaataacagacaaacagagagccaaatcatgagtgaactcccattcacaattgcttcaaagagaataaaatacctaggaatccaatttacaagggctgtgaaggacctcttcaaggagaattaaaaaccactgctcaacgaaataaaagaggatacaaacaaatggaagaacattccatgctcatggataggaagaatcaatattgtgtaaatggccatactgcccaaggtaacttattgattcaatgccatccccatcaagctaccaatgactttcttcaaaaaattgggaaaaaaactactttaaagttcatatggggccaaaaaagagcctgcattgccaagtcaagcctaagccgaaagaacaaagctggaggcatcacgttacctgacttcaaactacactacaaagctacagtaaccaaaacagcatgatactggcaccaaaacagagatatagaccaatggaacagaacagagccctcagaaataataccacacatctacaaccatctgatctttgacaaacttgacaaaaacaagaattggggaaaggattccctatttaataaacggtgctaggaaaactggctagtcatatgtagaaagctgaaactggatcccttccttacaccttatacaaaaattataagatagactaaagacttaaatgttagacctaaaaccataaaaaccctagaagaagacctaggcaataccattcaggatataggaatgggcaaggacttcatgactaaaacaccaaaagcaatggcaacaaaagccacaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaaagagctcaaacaaatttacaagaaaaaaacaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccacttagaatggcgatcattaaaaagtcaggaaacaacaggtgctggagagtatgtggagaaataggaacacttttacactgttggtgggactgtaaactagttcaaccattgtggaagacagtgtggtgattcctcaagcatctagaattagaaataacatttgagccagccatcccattattgggtatatactcaaaggattataaatcatgcagctataaaaacacacgcacacttatgtttattgtgtcactattcacaatagcaaagacttggaaacaacccaaacgtccatcaatgatagactggattaagaaaatgtggcacatatacaccatggaatactatgcagccataaaaaagatgaattcatgtcctttgtagggacatggatgaagctggaaaccatctttcttagaaaactatcgcaaggacaaaaaaacaaacaccacatgttctcactcataggtgggaattgaacaatgagaatacttggtcacagaaaggggaacatcacacaccagggcctgtcgtggggtgggggagggaggaaggatagcattggaagatatacctaatgtaaatgatgagttaatgggtgcagcacaccaacatggcacatgtatacatatgtaacaaacctgcacgttgtgcacatgtaccctagaacttgtataataaaaagaaaaaatattatttaataaaataaaaagaaaagtataataaaaaaagaaaaaaaaagtatttgcttacagcagtccttcccattattttgctaaaatatgacaggattattcatgttcattatttagtcacagtgtagggagtttcttttaaagttacaacataacttgaagtggacaaatcctaagtgtacacaaattttaagtcattttttaaaaaatatatatgcacccgtataaccagccggattcaaatatagacaatttctcagaaggctccttttgcctcatcttagtcaacccagaggttctagctattctgatttctatcactacagagcaggtcttcttgttcttgaaagtcacataaatgaggttgcatactgtgtagtcttttgtgtcttggttcttttactcaccattctgttaatgtgattgctaagtgttgtaagtgggagttgattctttttaaatttcaggctatatttcattttatggttatactacaatttatttatccattctactcttcatgacatttgggttgttaccagttttaggctaataaaataaatgtcagctaaaaattaaaagctgggaggaacattcttgaagcatcttatgcactgatttggcttgagtgtacaccatatattggaatttctgggtaatagaataagcacatacttcactacagttgctgccaaaagttttcctggatgcttctattattattctctcattccatcaacaggtgatgtttcagttgtcccacatctttggcaaaatttgattttatcatttagccattggtgggtaagtcgacatatctgactgttttgctttttgcacttgtgttttttcttattgtagttttaatatgcattttcccatgagtatcctcattatgcacattttcctaagctttttgatcagatgaatagcctgttttgtgaggtgcccagtaaagagtttccccctttttctatgttaagagttcttcttatactcttgacatgagttctttttttggggatatgcactgcaaataccttctcgccatctgtggcttgccttttcactctaagtagtatcttttattgtaattgttttgttggtaatttgtttcctggttttttttttagctttagaacttccagaaaaaaaatgagtttgatatattcagattgcttctagaaggatttatgttaatcacaaatctgtattttggaattctaaatactctgaaactttaagaaattttaagcaatatctcatttagttattataaaaaagaatagcaaaactttaaggttcctttagcactgtaactttatattgataacttaaatatcactgtataaagtccaatttcgtgaaacctctaattcagctccattttacattatgattattctaaacagtatatttctgaaaagttttaagcatggtagctatacatataatttccaccattacacaaatgaatcatagagtaatcttaacaaaatagagctgctgttacattgctaaatttctacactccaacacaccctatatttttagactatacagagcatataagatcttccttctaagaacttagacattcaaaagacatccctacctggagatttctatattgactttagaaacaaataaatatatggaagcaaatctataccacatgacacctcatctcctagagaacatcctattaaaaagtgctccaaatatcccattttttctttccaattcagtagcttgggttctttataatcaaaacagcagttggtatgtttagggagtttttttgaggtaaagataattctaagaatgaatgtaataaaaagaagagtcaacatctattgagttcttgctgggttttaggtattgtctaaatgttttacaaatattaatttattttaccctcacaataatcctatgtcttaggtagtattactgccccattttgtagatgttatatagtctgccagtaaccacatgcttgcaagaggaggaactatggtatcccagggcagcctggcttgctactttgggattttgatggattctgagaagccaccttaacctttgcacaaatctagaatcaccacaaatcttgaaggtttagatattaaccaacaatttgtttttttgagttatatatgtttgcaaagacagacatggacatttgttgattgtcaggtggcaactgaaggctatacattggcttttaaaaatccgaatggtttttaaaaatctgaatctgaatccctttatacatagcatgtacatttctattcgtcacagtttttaaaacaccgtctgtatttaacatctctactttctacaattaggctgactggcttcttaaagcaatagaatttgagatctttggacactaaaccaaggaactgcaagaaaagaaagggagaccggtatttgttcttgtctactgggggattcatgtcttacatcacaggggacagtgtcaacaaaatgaaaattttctttgtggcttgtcaatgactgccctttataccttcctttcaaagaaatgtttctatttgtttcctcaacggtatctctggatctccctacacagcccccaaaataacatttgtaatttattttgattacaaattagggatgtagaaagaggatgggaacctgatttattaagcccccattttgagctaggtagttcgcatattatatctcacttatttattcctgggggaaaaacaacgtaacaataaacttaaattttgttttatttcttcaacatatgcagaagaagaaagtggtgcttagagagaggaaaagtattgccaaggctacagagctagaatatgtgtagagaaaactaactgtgctcatttcaccccacagtggggcctccctgttatctggataaaagtcatgaaagcttagcacgtagaattaaaccacagctttatattttgcaatagtgtatatttcaaaatgaaaaaaaagagtcacttttagcattttacagcttctttaatctaaaattttgcccattggagactaatacctattttttttgcttaaatgtatttcttagacaatttacattttaaaccagcttgaatgccatattttacacacatacgtatttttatggcagatcatttaatagcaatacgtttactgttgtgggattatttaaacatacatggttctagttaaggtatattttaaaaatcttgcattttattgcatatgattcaatttttgctgtgcaaagataactgctttaatgatggtcaaatattttttgaaaactaagaaaagcaatgtttattttgcatacaaaaataactttatcttcaattatatacattcatttatatgtcaggtaaataagaagcatttcctctgtgcctcaccagaaaattagtgtaaaaggtaaatatggaagaaaacaaatgagatcttgaggcataactaaatgattcagcattatattggtaaataagcatcctggttaatatgaacttatttcctctaataattccgtgacatagtcacaaatgttttaagagacaactggagtcttggtagctggagctatacaacaattaatttaaaaaatgtaaacatggagcctaaggacacttaataaaggtgttaatgggctttgggtggctgtcctaaacccattgaaattatatgcaaataggtgaatactgtgtttgtgtgttatgtgaaacagatggcagcttttcttagattttttaaagggtccactggtctaaatgtagtataatgaccacaatgatgatattcactaatatttattaaatgctttgtgctttctcatgtaattataacaacaacccaatgaaacacaggttgagaatgtcttatgtgaaatgcttgagaccagaaatgtggcagattcttgatttttctcattttagaatatttgcatatcccaaatgagaaatcttggggatgggattcaactctgaacatgagattcatttatgtttcatatatacttcaaacatacagcctgaaggtaattttacacaatattttaaaataatttgtagatgaaataaacttttgattgcaacctgtcccacgaagtcaagtgtggaatttttcacttgtggcatcctgtcagtgctcaaaaagtttcagatattagagtatttagaagtttggattttcagattaggaatgctcaacctgcagttacattattaacccaattttatagataaaccaaatgagtctcaaaatggttgtcatttgacaaaaatcacagcatgtaggaagtgaaacctactactactaagaggtatgcagtctgttccttgagcaaccttgtctgatataatagttcctaattgcatggggttttcaggcacttgaaacacggctagtgtgagggaggaactgagtttttaatttatttaacgttaacccatttaagcttaaagttaaaaactgatacagttccgtttttagaaaatggtaaattatgcttgaagacacttggacaggtggatatacttcttcaattgtaaactgtatgaaatctacatacaggttaagcatttctgagaaaaattcagcatccaaatcaagatgtgatgcaagtattaaaatatacaccagattgtgaagacttgataaaaaaatgaatataaactatctcacgaatgatgttcttatattgattgtgtgttgaaatcataacattttggatatatttagttaacaaatttattacacttaattttacttttttatttcttagtataactactagacaatttaaattatataattcctattacatcttcactggacagtaagcactgctgtagaacaatcatgatatcatatagaagggaatgaaaaataaaatggtagaatgcctttctagattttttaaaaacctttattaatttagaaagaattcaacaagacaaacatagagtaaaatttttcttttttttcattttttatcattattatactttaagttttacagtacatatgcacaacgtgcaggtttgttacttatgtatacatgtgccatgttgctgtgctgcacccattaactcgtcatttagcattaggtatatctcctaatgctatccctcccccatcccccaaccccacgacaggcccggtgtgtgatgttccccttcctgtgtctctgtgttctcattgttcagttcctacctatgagtgagaacatgtggtgtttggttttttgtccttgtgatagattgctgagaatggtttccagcttcatccatgtccctacaaaggacatgaactcatcatttttatagctgcatagtattccatggtgtatatgtgctacattttcttaatccagtctatcattgttggacatttgggttggttccaagtctttgctattgtgaatagtgccgcaataaacatacgtgtgcatgtgtctttatagctgcatgatttataatcctttgggtatatacccagtaatgggatggctgggtcaaatggtatttctagttctagatccctgaggaatcgccacaccaacttccatgatggttgggatctaattaaactaaagagcttctgcacagcaaaagaaaccacaatctgagtgaagaggcaacctacagaatgggagaaaatttttgcaatctactcatctgacaaagggctaatatccagaatctacaatgaactcaaacaaatttacaagaaaaaaacaaccccatcaaaaagtgggtgaaagatatgaagagacacttctcaaaagaagacatttatgcagccaaaaaacacatgaaaaaatgctcatcatcactggccatcagagaaatgcaaatcaaaaccacaatgagataccatctcacaccagttagaatgacgatcattaaaagtcaggaaacaacagctgctggagaggatgtggagaaataggaacacttttacactgttggtgggactgtaaactagttcaacctaaagtaagatttttcaatatttatttataacttgaagagacaggtgaaaaagaagatgaaattccacagactaataaaacatggcttggtttgacacttggaaaaataagatttgaatgctaagacttccaagaagaataaatcaatatctggaaatggctagctagccaaagttaattttgagaaatgtcactgaaaagctctgggaaagttatctgcaattataatctctacgctgactacacgaaatttgtgaaaaaaaattttttaaagttaaaataagaatcaaggaaaattaaaataaataaacaaaataaaacatcattatcttgtgatacagtgccccaagcttctactcctttggagcagtccttagtgcccaaggaaatgacagctcagaaatgaagtgtttaacacagaacttggtgcatagaaggtgcccaggtgggaagaagtttgtaggtacaatgtaggaccaatctggagcaggaacagaatgtactcaggattattacaaggccgttgcccccattatggctctgaggtagacaaggagaaaaaaattgcttcactgacctgccaaagatgacatttgcatctctgttattatttagaggaagacagcacctctgcggactcatttatggtattttttctaaattagccaggttccaattcagattcacataactctttagggaatataactcaaaatctctgtcattaataaaacactccaagtcataagcagtcaggtgtggaaaccaagtctcctagattaacaagtatctggaaacctacatctaattgagaaagaaagctacatatgtatatattcaatacatgatgattgtaaataataaaataaatgtgggttttgatcaaagtcaacaaataaaacatataactcataataaagctactctattgatatgataaatttggagggcaaattataaattacacatacattccattattaaaaaagaaaacacatgagggcaatttaaaaaatatattcttttccgtcagcatttccaatggacttatattaatctggtggtttgtcttctaaattgcaagatggttcactgcatatatgagaaaatcagcccatactagcagatcttaatgaattaaaaaatcttttgaacattcattcaagggttgactagtaagttcagcacctgcttcaatgtcttaattttaaaggatttcccatgatttctctgtctctagtaggaaggatttacacagatttatatttgcactataatctgtcttattttttaaagagatcttatggtgcaactcctgaataataagagtgtcaaaaatgatgtattaaattacaggggtaaaaaatacttatttttattatttatattttgggagttgaagttacatgtaaaaaaaaaggagggctgatgaattgacataagatgccttaatttaagttttatttaactcccctttcattaagattaatcaagcattttctaaattaccaaactgtatttttaaagtatttgaaaacaaaaggaccacgcattttccttaaaaaaattacatatacatttatatatcacattgcatgcctgtactaaaacatctcatgtaccccataaatacatacacctactacatacccacataaatttttaaaaaataaacaactgaaaatgtatatctttattgtcatcatcttcatgaaagaaatttatatatgtattcccttcaaataatctccagttcaccttaacgtagttgtaaccataatgtatattcaatatttgtttcctttttctacacttgtaccacaaaatatttcccaaattgtgacataacccacattgccattctttttagtggccacaaaatgtttcatcttatgttaattatagttatattaagaaaaataggcaggaagagaaatagactgcaatagcctcttaaataatggcaaactttagcatttttcactattacttgcttacaaaccaagttatttctttaactgctaaattaatagatttcaagttataagtcaaaggtaattagcctaaaataaaaaattattactaagtggcttaaattatatcttgtaaaagatcagagcaagatgaattttgagatgtacaaattaaaagattttaatgttttctgtagttacagttctggtatgcatttaatttggccctgaggtatttaatcacatagaaactttacaatacacatgcaaatgaagtttgaaattaattttgtcttagcatagtcccactgctttgccttactagaacatagggacatactgttctgttaaggtaccatgcagaatgacagcagataatgcaaaactctcttagtgttcacttccatttgattataaagggaaaaatatagaagcagacaaaaattaaaattaaaaatactaaaattaaggaattgtatattgacaggaagagtgttcattagagaatttgtatctctgctttactatgtggtatcaggtgctcaaagcagtcatttgatttttgtaaggtccagcacaatttagctccagtcgtccatctgtagcaaggtgtaagaatgatttgcccaataggagttaagtctatttgaggtgataaaaaagcgattgatttttaagtggcataaacaatgtccagaagtatgctgaaactaaacaaatgtccagaagtatgctgaactaaaaaatattattaagagaatatcaccgatagtagagtacatctgaagacttaattctgtgagaaaatgacttggagaatttggtaaaaacttttttcaaaattttattatagaatccacataaattaattttcattattaacaaatcagcaacagacacaattcaaacataacaatatatgtatatgcacatgaggacctaaggaaatcaagtcaggtcctaaaatcaggcaagagtactaagataaattaaacattcttttatctctcactttagttagatttttatgggacattacatgtgttagcatttgttatgggttgagttgtgtctcccaaaaaaatttatatgttgaagcaactgtacctgagaatgtatttagatagagggtatttgaagaggtaattaagttaaaattaattaactagggtgggccataatccaatctgactggctgactggcgtccttttataagaagaggaaatttggacacacagaaaagacatctggggtgaacaagcacagagaaaaggaagccctctgcaaatcaaggagagaagcctcagaagaaactagacctgccaatacctcgatctcagacttccagtctccagaactgtgaaaaaatacatttcttttgtttaagccacccagtttgtggtattttgtcatggcgtccctaaaaaactaatacagcaagttaggctggtcaaaatgtgacaagaagaatgaagttgccccttctgaagatctgccaagatgtatcagtacagtagtcccctgtcctctgtggggagtatgtcgatgcctgaaatctcagacagtgctgaacccatttgctgtcaatcagaacacatttctgttcatgtattccacacacaaattgaatgcctttttcatcttaactaagcacttatcatgattgtggctgtaactgtcgcagtttgcggtgccacagcaaaactagcatttttttttttcttcacaatttcatgaatagaagattagttcttacagaagatcttagcaatctcagcatataatttttttctctcatattacatagagaactttcaccttttcacttgaagcattttatggctctctggcatatacgaatgaccagcatcactactgatgtgctttggggaaacttaattacctcttcaaatatcctgtatctaaatacaagctgaggtagtggggcttcaacatttatttggagaagtcagataaggtggcttgaaaacaagcataatgatacagcaacagtttacctgataaccaagatgactatgaagtgactcaagcattgtggctccactgggcaaaagaggattcacgtcccaaaggagatttcatcccactatttagaatggtgcacaatttcaaacttatgagttgtgtatttctggatttttccatttaatattttcagaccagagttattctctagtaacgaactgaaactgtggaaagggaaaccacagataaaggcaggactactctaccactgctctgaaagtgaactgtggcagaagcactatacacaatttagttaataagcgatattagcatctactttgcatagatgtggaacacagtctacacacttcaagaccttctgagtttttcagtttgggaaacaattaatttaaacaatatttagtgttgtggaggaaggatattttgttttaaatgtattgtatgtgaagcatctttgacattgagataaaagtgggaggcagataggagtggttttggagattaggaaaatagattcaagattgggtgccattttctaagactattttcaaaaaactgtttaaatatatgtaacaatattaatagtttgaccattcataagtatacaatttgtcagtacattcactatgtaatatcctcactatctatacctaagcctttttcatcatccccaacaaaaactttgtaaccattaaagaactgccactttcctccccttccccagcccctggtaacctctgttctactttctgtgtctgtcaatttgcatatcctagggacctcttataaatggaattacacaatattagcatagagtcaatttttgaagtcttagagataaacaatgtcactcagagaaagagtggtggtgtagggagtgggggataatattaggaaaaatcaaggaaaaggcacaggagtctggatctctcttattacaataatacaatctgctccactcccctttctgtctccttgattcagtggaagtaagaaaacttttaatgaacatattgtacataagagatggtgcctgagaagtttatgaaacaaatgatcatagaataaattatttttgcaatgactcatatacatttatagatatggggaataggtattttggaatcttttttaaattaacactatttatgtcccactgtagaaccttagggaaaattatttaaattttcatatttccaccagaatctaaaattcagagatacctgtcatccagcaagaattgggattgaaataataacaaagaggtactgtgacttatggcttagaaggttcttatacacaaatcattttatttaaccttacaaccatgaaagactggtattattattttaattttacagaataagttggggcagtcaaggagattccagataggagagcaaagaccatcttctttccaattacatatatagattttcaattagagattttactttggaaaaattttaggtttacgaaaaaaatgcacaataatatagagtgtgtccatgtgccccttacacaattttctcaaaggtttaattcttatattactatgagacatttttcacactaagaaatcaacattgctgaattactattaaactccagactttgtatttgattagttttccacttgtgcttttgtatgttccaagatccaaaccatgatgccatgctgcatttggcatacataaatatttggggagttattaaatactggagtttacactgttgtgctttaagaaattgagcttggtcaaatacaaggaaggaaattgtggatatatcaacagtttgttggaacattaaaccttatttttgtatgacaaataaaacttaactaaataaacgcacaagacaccatcatatatatacatatgatgtacatatatacatatatatataatggcaagatgattttacatatatatgttttctgtagttacagaaaacatttcatgtatatgtgtatatatatgtaaaatcatcttgccattcctagaaaaaattaaaaatgcagcattagaaaaaaggaaactaagtttaaatgactcatcaataatttttaatagacaaacaataatgtatcatgtcacttgtttccttttctttttcagtgagatagctttgcaagaaattcttattactcaatacaatgttttatagattgtttcataagtatcaaatatgcttctttggtattgatgtttcttgtcctactaatgcatactcattcatttaaaaaaattttcaaatatatttttacctcaaataatgtatatattggaaattttatctttctcaaaagtatgggttgcttaatattgagataatttctaatgggtaaaatttaccaggaagccacttgcaaaaactttaaaaatgttattttatatgcctttgtatctgtcttactttaaccactttttgttttccttgaaatatataatttagatgatagaatttcagtttaagatatatgtcaaatatttctacttttcttcattagtttttgagatataattcttagccttctctagattttcctgcatattatctttggcattgaacaggtagacatggctcacatttacatcaggtaaagtgtagaattcaacttaggagatgacaacatttaaatatattaatatcagtattaagagttcttagggcagtaatcattgtaaaaataatattattgaacagttatttcacactgggttcttaagtgttttacttatcataaagcataatttaatacaccaacacagcttcctagggaacagacactaggctagtcacttctctataaaatacacttattttccctaatttacaattataaataaacattataggtatataaatcctgtgtataaccgtaacaggagaagtagttttaaaatatcaaatttaagtcatcaaatatttcagtggctttatctaatattgtttatttcattttagacttattaatattttacttcacgtaatcaacatgtatatattaaatcatcactctgaattcaactcaagagctcagatctttctaatatttgtagttttctgtcactcttgaacacaaaggttatattgtttatatgcctatgtatctcaacacacctgctcataatcgcactaagtaatttatttgatgattgcaatgacagcaaaaccaaactacccaaacacgtgatatgctgttctacataaagtcgatttttaaaaatcaatatcatcattatcatcatcaaaatcactaccaccaccatcagcactgtcaccaccatcatcatcagtaattcattgagttgacatacattatcttactctatattctgccaaggcaagcttcaaaatcaaatgatattagatatcttaataatttccataatttaacaatgtgaagctctagctatataagtcaactggggggatattttaaacaacagaaaattggtttatataagctagacaaatgtagtatacatatgttctttaatggttctgattttaaactctggaaaacagtattgtctttttaaaatttctatttagctcagtgtagagcctggatgctaaatagaagctttacctagcacaggcatctttctaatcttttcttaaaatttttttgtgggtacatagtagttgtatatatttatggggtacatgagatattttggtacagtaatgcagatacttttgtatgagtagtaatcacatcatggaaagttgggtatccatcctcaaggatttatccttcatgttacaaacaatccaattatactcttttagttatttttaaatgtacggtgaagttattgttcactatagtcaccttgctgtgctgttaaatactagatcttattcattctttctatttttttttttcgtacccattaaccatcctcaccttcccccaactaaacttctcagcctctggtaaccatccttctactctctatctccatgagttcaattgttttgattttcagatgccagaaataagtgaaaacatttttttctaactatcatttttgtacccagtaagcatccccacctccccattaccctcccactatctttcccagcctctggtaaccatttttctactccctaccttcaatgagttcaattgttttcatttttagattccacaaaaaagtgagaatatgtgaggtttgtctttttgtgtctggcttatttcacttagcagagtgacctcctgttccatccacgttgttgcaaataacaggatctcatttttttttatggctgaaaagtaattcattttgtataagtatcacattttccttttccattcatatgttgatggacacttcagttgtttccaaattttggctgttgtgaacagtgctgcaacaaacatggaagtgcagatatctctctgatatctcatttcctttcttttgggtatatacccagcagtgggattgctggatcatatggtagctcaatttttagctttttgaggaagctccaaactgttttccatagtggtcgtactaatttacattcccaccaacagtgtacaagggttcccttttctccacatccttgcaagcatttgttattgcctgtcttttggatataagtattttaacttgggtagatgatatctcactgtagttttgatttgcgtttctctgatgaccaatgatgatgaacatcttttcatatgcccgtttgccatttgtatgtcttcttctgagaaatgtctattcaaatcttttgagtattttttatttggattattagacttttttcctatagagttgtttgagctccatataaattctggttattaatcccttattagatgggtgtgttgcaaatattttctcctattctgtggattgtctttttactttgttgtttcttttaacgtccagaagctttttaacttgatgtgattccatttgtccatttttgctttcgttacctgtgcttgtagggtattgctcaagaaattttttctcagaccaatgtctgagagagtttcctcaatgatttcttgtagtagctttatagtttgatgccctggatttaagcctataatacattttgatttgatttttgtatatggctagagataggggtctagtttcattcttctgcatatggatacccagtttttccagcaccatttattgaagagactatctattccccagtatattttcttgacatctctgtcaaacatgaaccttcaaagtgtttgttatagtggttgcactaattacattcccaccaaacgtgtacaagggttcccttttctctacatccttgccatcatttgttattgcctgacttttagataaaagccattttaagtagggcaagatggtatctaatcttaattacgttaatgcatgatgccattgactgtattgacttcttagtaataatcagggcttcttgagttcggtttccaattatcttcataattttagtttgagttctattacttacctcttttctccaagatcacttaaaatagtcatggttattataactatagaaataaggcatggtttattataacaataaaaacaagcttatattttagttgtatttgcacatatataaaactataacttaagccattgtagaagaaaaagttatttattctctagtttattttccctttttgaaccaaatgagaagctgaaaaagcaactagattttggaaatacaggcatgttttctgtctgttttccctgtgttctttacatcttgtatcctctttgtctactgaaattccacatgtgcttccaaatttagtgcaaactctttccactgaggacttttcagtctattccaggccatggtgaacacacttttttttttctcaacagtgttagtaggtacagtcttcttttctccgctaattaactatatgtgacttcctacatttctagtatcctcattttacttttttcttatacttttttcccatgtgttcatgtcttgtttctccaagaatatagtaagtacttcctttgagactgaaaaatcacatcttacaatttactttccctgtcaagcctggatcaatgtctcacacacattaagcaatcaataatttttgtttgttttatagaatgcagagatgcatggacaacgctctaggccaaaagagtgacacacaatatgctcggcactgtggccaaatcagatcctttacataattttgctaatcttttgttatttatgcctgttacatgaatatcttaaaatttataagatgctggtatagcttcacagtatgattatggccattttagttaactttaaacacatttttagaaggcatttaaaaaatcaacaagtgtgtagtttagaaaagatgattcagaattacactaaataaatatacatacaaattatgttttcttgcataactatctattcgacaaattaaaggtcagcaggatgggattacactctcagcctaattcatgctctgtgaaaatgaaatatactgacattctatattctactgggacacatgatctgtacctattttaagcccatggctcttcacaatccattgtttaaaaatagatcagttctgaactttggagacaggctcagaagggcattaacctctttcttgacagttaagtttgccattttgctctaatcaaatcagtataagtctgctcatgttaaaaatagacattcttgctttgtacacattccaacaggcactcataaacagaaggttctacctagttctattaggttctactaatgaatctaattagtttttatttttaaatatactgccagcatttatagaagtatacatgagtcttatgattctaacatttcaatatcaaattttgatgctaaggcaatgtctccaggaaactggctgataaaatgaagggaaagcttactagcagattgtttgaatacattccaaaagaaatggggcatatgatattgctgggtttggtgtccctcctgagtactggcctgataccctttgaatcaccctttcagcacttgcaaataactacatacaattagttatttaaatgtttgtcactccctaaaatataacagctgtaagagctctatcctatttttcactgcattgtagtaacattaagagttaaattctactgtgtacttactatgtgccaggcacttttctgcatttttatgtgttttgctcacttaatctttacaactctgtgaagcagttatgatcattattcacatttcaagatgagaaaaatgaagtacacataagttaagaaaatagctcagagttgaacatctagttagtagcggagctggatttaaatgaggcttgtggaaggagggccatctggtaatcgtgatgtgaaatagcccctcagtagtaggttctcatccattatgtgttatatagctgaaaaattgcgtatacttattaatggtggtacagaaaatcacaaaaaggatttaaactatcccaaacaatgaagctttggatatttctcagcagccaggggcaaataagagcatgttaagtggatgggaggagaatcaaggaggagggctctccagggaaagccaggtcaggcagcaactgagagggaggggaggatactagggattactgaagccaactttgcagactcatacatttgactagacacagccagagcgcaaccagagagtacagattagagataatgaatataccacacagtaatagttttaatttaaaatgctatgttttggggtaacatcttaagaattttcctcagaaaactgtaatgttcctttactatctgacccaagtattttagtgcacagtggaatgataattttttaagatgactttacaatcacttcccagaaggctgacaattccagtggagctcagtgtgcaggacgtacagcctagcttgaggatgaacaacacacaactgttatctgccactgtgaatcttctataccttgaagtgtctcaatatttaggtttggacaggggaacttgaacaattgtttgatgagtcattgacataatctaggtagaaccggtgtagcaatggttttatccaatttgggctgctacacaaaagtatcacagactgggtggcttatgaataaaaaaaaattatttctcacagttctggtttggaggttgggaaatctaagatcaaggtgctggcagactttgtctagtgaggggccacttcctggttcatagacagtgagctttttgctgtgttctcctcatatggcagaagggatcagagatcactctgggacttcttttataaaagcactgatcccattcatgagggctccaccctcatggcctaatcacctcccaaaggccccttcctcttaacctcctaatatcatcaccttggggattaggatttcaacatatgaactgggggcagagggcataaatactcaccttagtagcaatataaaagaaaaaccaacatattttctatctattccatgaatgtgattgggttatagtgattgattagacagaacatttgtataccctctataatggtaccttcctcttcgccccaccatctttaccccatcctccaagtgagctctgcattgaatgactaatgcataaacacggagaacttttaaaagtttttaaagttataaagtatttttcttcttaaagttaaaaagaaactattttttcacataaaaataggatgttatgtcatacagtgcatataccaaacataatcacagaggaatctaaagatgccagcatgcttttgtaatacattaaaaatacatggaccatagtataactgacagtgatactaagaaagttctgtggacagaagactttgttttgagcatcacttttcttatccatataagcacaagcactactgttctcttggcaaaatgctgtctctaagctttaacactcagtcactctgagatgatttgccaagtaggtaatccttatttattgtgtacttattaattttttccacgaagtaattacaaaatatgtactatctgagggttggagtcatagaggaagttaagaaagatagtccttgcttttccagatcctgagttcatatagcagaacagggaatgaacaaataaatattaagggcaaataagacaatataataatatgcatacaacaaaaacactgatgtgattgatggagaatgactgagagggaactaatttggatgagcttctcagggaaggcctcttcaggagataacatttgtattgagatttgaacaataagaatgggctagttatctgctaaaggtgtttcaacaatttgtctctaacacacaaaaaaagataaatcacctaatttttgccacaaaagtgaaaataggagaatgctttcaataaagtagtgtttttgaaatatcagctaactgaattaattttatatgcatggtatgaggtttttgtaagaggtttcaaagttctcacaaatgtagttcttaccgccattttacatcttcgggcttcacagtattaaaacacattgaaaggagagtctgaactataaaatggataaaacatagtacagacttaactgataatgaatatagactaattttaactttctttaccactgcattttacattctttctctacttttaggcaaaagtcatttgtataagtttgtgagacaatgaaggtatgacctattcctcacttttataagtttctgaattcccagacttgtgttaaatcactgctcttaactatatattaatgcctcaaattatgcaatactttcataagctttcttatttaatgaagtattttaggttgaaatcatactataagataacatgttgttgacataaaattgaatttatgatgagcaattctaatcatgtatattagatgtgtgtatacacattttaatatttttatcttttgtcacaaaatacatatcaaataattgaactttgcctttctggatatcctagttcactcatttagcatttatttgtcattcaatgtcttctatgtgccaggcactttctagacactaagaacataacagtgacccaaacacacctttgcctaagttgattcctcctctcccaagtgaaacacagcttttgaaaggtgaattgatatattttactgctttttagacattttttgtaatctatcactgtgacttgaatgtagtaggtacataatactccaatttgatgttatatttctcatcgttcttactaaacttttcttcaaaaatcaggtctgggtttttagactcagtgtcattttagtaataacttgttatctttctgccatacgtttctttactttcttattctactcatgctttttcccttcaaataaactgttaacttatgtatagcattaaacttagacctttgtgtgattctgatattagaaaagcaaaagctgaagagtagggaagcacatggagaaaccctgttttcacctttacaaggtgttaactggctgagcatttcatgcttccacttctaggatctctcattttattaagcagtcatgattcttagtatgattttcattcacgactctgttaaagaagaccttttactcagtaaatatttcatgacttcctactgcatgctggttactagaaatacaaggatattaagcacagctcctatccccaagaagctcatagtctttaaagagataataaactaacaaatgataaatgctgtgagagagacagagtagtgacagaaaatttatgaatgaggttaggtaacttataaatggtaaaaatgcttacaggaaagtagaaggtaagctgagtagaaaggaatgaagatacggtagcatgaagaaaggcaaaaaggccatcaatagcatttattttccaggaaattgtcaataatactctatagatgaagcattaatgtgaagaaaggaagactaaggcaggccatgaagagcctctgtgtcatatgaaggagtttgggtgttttccctgaagggaataagaggtcatgagcaggttctaagaagaaagttacattgtcaaatttgggttttatatcaatcaatatggtagctctgtaatggaatgcattttagctaattgacattcaagccagggagaaaagttgtgacagatgttgaggtaatgttgagaacctgaatatggcatttaaatatataaagaaaaaatattagtcacaatttagcaattgaatgattgtaggaattgaggaaataaaaggtttgtcagaggatgcacgtaaaagtgaaaagtggatattttttccagtgaagatcagtgtaaattatggtgtggcaggaggaagaatagtttttaatttatgtatgtatttatttattttttgagacagagttttgctcttgttgcccaggctggagtgcaatggcatgatcttggcccactgcaaccagtgcctcccaggttcaagtgattctcctgcctcaggctccctagtagctgggattacaggtgcccaccaccactcccagctaatttttttgtacttttagtaaagactgggtttcactatgttggtcaggctggtctcgaactcctgacctcaggcaacccacctgcatcaacctcccaaagtactgggattacaggcatgagccaccatgtccggctgggaagaatagttaataaaacacatgacacagaaaatgttcttgttatcttcattatatattaccttgagaattttctgcctagaagaatacttcccatttaagggtacacattactagggttcatttttattctcagttgtgctgttgtctttctgcagtctttcaatgagattttattctggaatcctaacttctccatgccttcttagaatatatgcttcaatttatcttgtctttctgtcttttgatttgatatttattcctgatactgtctgttggattacctttgtctccttgctatgatctgtctcactctactttgaacctctccaggcccctgagaatccaatctggttccagtgtcctgaaattctgcttttcttgtgaagaagttttagatttaaaaagcaaaatatgttgatagagtttttttttttaaacaactgataccagggtcttcaaaaagcttatggaaggtgcatattatgaaaaagctatatatgaatttcctattttctttatcaaaataaacttgtagaaacttcttacaacacatctgaataggatctagtttaaggcactaagaagaatgagacatcagttttaaaatagcctctctcagagcgatatgaattataaaattgaagcaggagcaaacatccaattcatgctgaagcttggatggaagaatgagctatccatctataaactgctaattcatttggggcatcatttccataaagttttagtaaaaaatcctttttgcattccctcaatgagattttaactagataacatttccttaacttcttggaatatatccttcattctatcttatctttctgtctttttatttgatctttattcctgatactgttttgtaaagaatgcttcacagaaactttatggaaacaatgtcctaaatgaatcagccgttcacagatggatcactcattttaagaaggaatgagacaatgttgaagatgaagcccataacagcagatcatctgcatcaatttgcaaggaaaaaattcaacctgtttttgccttatttgaaggagaccaatgattaatagcggaaacaataaccaacatcgtagacatcacaattgctcagctttcacaattctgactcaaaaattaaacttaagcaaactttccactccattagtaccaaaaccattgcagccagatcagctgcagataagagtggagctttcaatggaagttttaaacaaatgtgataaatatcctgaagcatttcttcaaagaattttaactggagataaaacatggctttgcaagtatgatcttgaagacaaaacatgataaaaataatggctgccaagagatggaagtggtccagtcaaagcaaaagcagactggttaagcgcaaaggtggctcatgcctgtagtctctgttactcaggaggttgaactgggaggatcacttgagcctgggaggtaaaggctgcagtgagctatagtttcaccactgcactccagcctggatgacagtgagaacctgtctcaaggaaaaataacatctgcttattatgagaatattttcagagagttagctaaagctttagcagagaaacacccagggaagcttcagcagagtcttccaccactacaacactcccactcactctgctcatcaaacaagggcaattttgtgagagttttgatgggagatcattaggcatctaccttatcatctcaatttggctctgtttgacttatttttgtttcctaatattaaaaaaatctgtaaagggcacccatttttcttcagtgaataatgtgaaccagattgcgttgacatggttaaattcccaggaccctcaattctttagggatgaacaacatggctcgtatcattgcttagaaaagggtcttgaacttgatagaggttatggagcttatgtggagaaatgaagtgaatatttttacatttatcttttaattccattttctatgatctttttgaaatcttttcatatatttctttcctttttttttttttgagatggagttttgctctgtcactgaggcagcagtgcagtggatctcaactcactgcaacctctgactcccaggttcaagcaattcccctgccttagcctcccaactagctgggattacaggtgcatgccactacacctggctattttttttttttttgtattttttattagagatggagtttgccatgttggccaaactggtcttaaactcctgaccacaggtgatccacctgcctcggccacccaaaatgctgggattataggcaggtgtgagccactgctcccagcttatttctttcttttaacaaaatataaaaaattgaagtatatttccaaaagcaaaaatagttatacattctaatttgattgagaaatttgtagggaaaataaactaaccaatagcagatatttagcctcatatttttaaaactcttaactggtatcttatggctattcaaaaaatataaaaaacttttagtgggtacagaaatttagataagtttataaatggtgaagatattagttggaatacaaatacttgtttttaaacttatagtaaacatactaggaattttaacaaaatttgaaaacatagacgaaatgttccttgcacataggggactttcaagacaaaagtggagaaaacaaatatgaaaaaataataataacatgggtagaatggataagtagcactcttatattacggactaagtacactgagggccagagaaaggagatataagatccagtctcatagctgatcaaataagataaatagaaataaataggtattatttgaattcaattttcccaagagaggagagacatttctggaacacatgtggtaaaggtgagaaatcataactgattttttcaaaacagcaagttgcacaattttgttgtaggccactttgcaacagacatgacagtgggggaaaggaaagctggagatttagctgtagtcagagtatagagggactggaagatgagcttagggagtctatacttgattcaatttataatgcaaagactgaaagtttctgagcagagaaatgactaacttatgtaaataaaagattaatttgaccgtggtattttaaatggtagtcagagaaatcagaccaaatgctggaaggcaaactaagggaacagtgaaaatagtctatgtgagatgctttagtttaggacaatggcagtgggaaaggaagcaaaggcatgaatgtaagatgtattactaaagttaattgatagcatttgatgattggatgtacagagcacagaaagaaaagctgcaaaatagggctaaagttttacattccaaataacttgtgagaatgactaaagaatgtacagagagactttaagagataaaatggtttaatgatggaagaaaaatgacttcattatataatctactacatgtgtgggtgcaggggatatcatttagctttagaggaaatgaactttaaggcaggaacttagaactacagtttatagaattgaaatgtgagataatataaataaaagataataaattcaaagatacagaatgaaaatccaatggctcagaaatgttgcagtgttaaagaagccaaaaaaaaattaaaaataaaaaaaatatatatattgggagagattcaggaactgtgttttgttaacagcataaaaagtggtcccagcatcttagaaaaattatcaataattaacaggtgtattagtatattataatgctgttaataaagacataactgagaccgagtaatttataaacaaaagagctttatttgactcacagttcagcatggtaggggaggcctcaggaaacttacacttatggtaaaaggggaagcaaacatgtccttcttcacaagatggcagcaaggagaagtgatgagcaaaaggggaagaagctccttttaataccatcagatcttgggagaactcactcactatcacaagaatagcagcatgcgggtaactgccccatgattcaattacctcctaccaggtacctcccatgacatgtagggattatgggagctacaattcaagatgagatttgggtgggaacagagccaaaccatatcattccacccctgccccctaccaaatctcatgtcctcacatttccaaaccaataattccttcccaacagtcccccaaagtcttaattcatttcagcattaactcaaaagtcaacagtgcaaagtctcatctgaatcaaggaaagtctcttctgtctatgagcctgcaaactcaaaagcacattacttacttcctagatacaatgagggtataggcatcaggtaaatacagctattctaaatgggagaaattggccaaaatgaagaggtaaaggcctcatgcaaatccaaaataagcagggcagtcaaatcttaaagctccaaaatgacctcctttgactccatgtctcacatccagggcatgctgatgcaagaggtgggctcgcatggccttgggcagctctatccctgtggttttgcagggtacagcccatctaccagctgctttcatgggtggggattcattgagtatctgcagtttttccagttgcagggtgcaagatgttggtggatcaaccattctggggtctggaggatggtggtcctcttctcacagctccactaggcagtgacccagtggagactccctgtgggggttctgacctcacatttccctaccacactgccctagcagaggttctccatgagggccctgtccctgcagcaaacttctgcctggacatccacgcatttccatacatcctctgaaatctaggtggaggttaccaaacctcagttcttgacttttgtgacccccacaggctcaacatcatgtggaagatcccaaggcttggggcttgcaccctctgaagccacagcctgagctgtaccttggccccttttatcaatggctgaaacaactgggatgcagggcaccaagtccctaggctgcacacagcaggcagcctgtgggcccagctcatgaaactattttttccccctagacctccaggtctgtgatgggaggggctaatgggaaggtctctgacatgccctggagatattttctccattatcctggtgattaacatccaacgccttgtcactgatgtaaattgctgcagaaggcttgaatttctccccagaaagtgggctttttcttttctactacatggtcacgctgcaaaatatttcaaagttttatgctctgtcaacttttgaacactttgctgcttagaactttttttccactagataccctaaattatttctctcaacttcaaagttccacaaagatctctatggcaggggcaaaatgccaccagtctctttgctaaagcataacaagagtcacctttgctccagttcctaacaagatcctcatctccatctgagaccatctcagcctgggctttattgaccatagcactttcagcattttggtcaaagccattcaacaagtctctaggaagttccaaactttcccacattttactctcttcttctgaaccctccaaacggtttcaatctctgcctgttacccagttccaaagtcacttccacaatttcaggtatctttgaagcagtgcccaactactctgtaccagtttactgaaatagcctgttctcatgctgctaataaagacatactcgaaaatgagttattcataaaggaaagaggtttatttgactcatagttcagcatggctggggaggcctcaagaaacttacaagcatggcagaaggggaagcaaacacgtccttctttgcttggtggcagaaagaagaagtatcgaccaaaagggataaaagcaccttttaaaatcatcagatctcgtgagaacttactcactagcaagaacagagcatgtggtaaccatccccatgattcaattacctcccacggggtccctcccatgatatgtgggaaatgtagaagctacagttcaacatgacaggtcattgacaactttcaaatgaaaaactttggtaaagaagctaagaccaaaccataattcattgagtacatagaaaccttttgagaagattggcagtaaaagaaaggagagggcaaagaagtgtaagaaatatgaataatggttggcagccaagatggctgaataggaacagctctggtctacagctcccagcgtgagtgacacagaagatgggtgatttctgcatttccatctgaggtaccgggttcatctcactagggagtaccagacagtgggcacaggacagtaggtgcagtgcaccatgagcgagctgaagcagggcgaggcactacctcactcaggaagcgcaaggggtcagggagttccctttcctagtcaaagaaaggggtgacagatggcacctggaaaatcgggtcactcccaccctaatactgcgcttttctgatgggcttaaaaaccggcacaccaggagattatatcctgcacctggcttggagggtcctacatccatggagtctcactgattgctagcacagcaatctgagatcaaactgcaaggcagcagcgaggctgcgggaggggcaccctccatggcccaggcttgcttaggtaaacaaagcagccgggaagcttgaactgggtggagcccaccacagctcaaggaggcctgcctgcctctgtaggctccacctctgggggcagggcacagacaaacaaaaagacagcagtaacctctgcagacttaaatgtccctgtctgactgctttgaagagagcagtggttctcccagcacgcagctggagatctgagaacaggcagactgcctccccaagtgggtccctgacccctgatccccgaacagcctaactgggaggcacctcccagtaggggcagactgacacctcacagggctggctacttctctgacacaaaaactccagaggaacgatcagacagcagaatttgtggttcacgaaaatctgctgttctgcagccaccgctgctgatacccaggcaaacaaggtctggaatggacctctagcaaactccaacagacctgcagctgagggtcctgtctgttagaaggaaaactaacaaacacaaaggacatccacaccaaaaacccatctgtacatcaccatcgtcaaagaacaaaagtcgataaaaccacaaagatggggaaaaaacagcagaaaaactggaaactctaaaaagcagagcacctctcctcctccaaaggaacgcagttggtcaccagcaacggaacaaagctggatggagaatgactttgatgagttgagagaagaaggcttcagacgatcaaactactccgagctacaggaggaaattcaaaccaaaggcaaagaagttgaaaactttgaaaaaaatttagacgaatgtataactagaataaccaatatagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaagaaaaggaaacaaacaaagcctccaagaaatatgggattatatgaaaagaccaaatctacgtctgattggtgtacctgaaagtgacggggagaatggaaccaagttggaaaacactctgcaggatattatacaggagaacttccccaatctagcaaagcaggccaacattcagattcaggaaatacagagaacgccacaaagatactccttgagaagagcaactccaagacacataattgtcagattcaccaaagttgaaatgaaggaaaaaatgttcagggcagccagagagaaaggtcggattacccacaaagggaagcccatcagactaacagcagatctctcagcagaaactctacaagccagaagagagtggggggccagtattcaaagttcttaaagaaaagaattttcaacccagaatttcatatccagccaagctaagcttcataagtgaaggagaaataaaatactttacagacaagcaaatgctgagagattttgtcaccagcaggcctgccctaaaagagctcctgaaggaagcactaaacatggaaaggaacgaccggtaccagccactgaaaaatcacaccaaattgcaaaggccatcaaggctaggaagaaactgcatcaactaacaagcaaaataaccagctaacatcataatgacaggatcaaattcacacataacgatattaactttaaatgtaaatggactaaatgctccaattaaaagacacagactggcatattggataaagagtcaagacccatcagtgtgctgtattcaggaaacccatctcatgtgcagagacacacataacataggctcaaaataaaaggatggaggaagatctaccaagcaaatggaaaacaaaaaaaaggcaagggttgcaatcctagtctctgataaaacagacgttaaaccaacaaagatcaaaagagacaaagaaggccattacataatggtaaagggatcaattcaacaagaagagctaactatcctaaatatatatgcatccaatacaggagcacccagattcataaagcaagttctgagtgacctacaaagagacttagactcccacacaataataaagggaaactttaacaccccactgtcaacattagacagattaacgagacagaaagttaacaatgatacccaggaattgaactcagctctgcagcaagcggacctaatagacatctacagaactctccaccccaaatcaatagaatatacatttttttcagcaccacaccacacctcttccaaaattgaccacatacttggaagtaaagctctcctcagcaaatgtaaaagaacagaaattataacaaactgtctctcagaccacagtgcaatcaaactagaactcaggattaagaaactcactcaaagccactcaactacatggaaactgaacaacctgctcctgaatgactactgggtacataacgaaatgaaggcagaaataaagatgttctttgaaaccaatgagaacaaagacacaacataacagaatctctgggacacattcaaagtagtgtgtagagggaaattcatagcactaaatgcccacaagagaaagcaggaaagatccaaatttgacaccctaacatcacaattaaaagaactagaaaagcaagagcaaatacattcaaaatctagcagaaggcaagaaataactaaaatcagagcagaactgaaggaaatagagacacaaaaaacccttcaaaaaattaaagaatgcaggagctggttttttgaaaggatcaacaaaattgatagaccgctagcaagacgaataaagtagaaaagagaaaagaatgaaatagatgcaacaaaaaatgataaaggggatatcaccaccgatcccacagaaatacaaactgcccacagagaatactacaaacacctctacgcaaactgactagaaaatctagaagaaatggaaagatttctcgacacatacaccctcccaagactaaaccaggaagaagttgaatctctgaatagaccagtaacaggctctgaaattgtggcaataatcaatagcttaccaaccaaaaagagtccaggaccagatggattcacagccgaattccaccagaggtacaaggaggaactggtaccattccttctgaaactattccaatcaatagaaaaagagggaatcctccctaattcattttgtgaggacagcatcatcctgataccaaagctgggcagacacacaaccaaaaaaaagaattttagaccaatatccttgatgaacattgatgcaaaaagcctcaataaaatactggcaaaccgaatccagcagcacatctaaaaggttatccaccgcgatcaagtgggcttcatccctgggatgcaaggctggttcaatatatacaaatcaataaatgtaatccagcaaataaacagaaccaaagacaaaaactacatgattatctcaatagatgcagaaaaggcctttgacaaaattcaacaactcttcatgctaaaaactctcaataaattaggtattgatggggcgtatctcaaaataataagagctatctatgacaaacccacagccaatatcatactgagtgggcaaaaactggaagcattccctttgaaaactgccacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctgggaatccaacttacaagggacgtgaaggacctcttcaaggagaactacaaaccactgctcaatgaagtaaaagaggatacaaacaaatggaagaacatttcatgctcatgggtaggaagaatcaatatcgtgaaaatggccatactgcccaaggtaatttatagattcaatgccatccccatcaagctaccaatgactgtcttcacagaattggaaaaaactactttaaaatacatatggaaccaaaaaagagcccgcatcaccaagtcaatcctaagccaaaagaacaaagctggaggcatcacgctacctgacttcaaactatactacaagtctacagtaaccaaaacagcatggtactgataccaaaacagagatatagatcaatggaacagaacagagccttcagaaataatgccgcatatctacaactatctgatctttgacaaacctgagaaaaacaagcaatggggaaaggattccctatttaataaatggtgctgggaaaagtggctagccatatgtagaaagctgaaactggatccctttcttacaccttatacaaaaatcaattcaagatggattaaagatttaaacgttagacctaaaaccataaaaaccctagaagaaaacctagacattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttataagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagacaccatctcacaccagttagaatggcgatcattaaaaagtcaggaaacaacaggtactggagaggatgtggagaaataggaacacttttacactgttggcgggactgtaaactagttcaaacattgtgaaagtcagtgtggcgattcctcagggatctagaactagaaataccatttgacccagccatcccattactgggtaatacccaaaggactataaatcatgctgccataaagacagatgcacacgtatgtttattgcggcactattcccaatagcaaagacttggaaccaacccaaatgtccaacaaggatagactggattaagaaaatgtggcacatatacaccatggaatactatgcagccataaaaatgatgagttcatgtcctttgtagggacatggatgaaattggaaatcatcattctcagtaaactatcggaaggacaaaaaatcgaacaccgcatgttctcactcataggtgggaattgaacaatgagaacacatggacacaggaaggggaacatcacactctggggagtgttgtgcagtggggggagggggagggatagcattaggagatatacctaatgctaaatgacgagttaatgggtgcagcacaccagcatcgcacatgtatacatatgtaagtaacgtgcgcattgtgcacatgtaccctaaaacttaaagtataataataataaaataaaataaagaaatatgaataaccaagagcaagttattttggtccaggagtgatctgaatattctagtgggaagaaggcagatttctagggaggaacagaaagatgatgcaaagcaaagaggtggttattaatgttgcaaagtgtttgaatgagataataggaaatgaactgctcacagcaagtcattgtcttatcagggtccatgagatgatccaggaaagtgaagatgggaggaagaataggaatcaaaaagaagaatcagtttgataagaatgagggggagaaaaatggggacaatatagacaatgaggccacaagaaggaattttaaagagccagaaatacagacaagagaacagttctgaggatcataaatagaacaattttccaatacttttttcaacatttaagagcttatgtaggtgagaagctaaagaagataaggacaaaatatcttaataagtttaggtttttctttagagtaacgtggactagaagattctccatgaagagagaaaataaacaatgattatgtattatgcatactgaggacaataaatcttacctctctcagaggatcattgagttcattgagaatattttcctcatcaaagattttgccttggtatctgtgttcatagtaatcatgtatcttctgacgcatatcagctggtaacttatggaatgacatgtattgttccacttgcttatactgtaaggaagggaaaataaaattaaaaaaaaacattgttagggtgtatcagaaatcatattattttgttttgctatattcaataatatttgaatactcagttacaaaaaaaaagaaatcctttaagatgaaggaactaatttacctgggtctaatgtacctattttgtgttacataatgtataaggcattttatttaggtgcacatttcatggaaagaactaagatatcgtggagaggaggcatgaagggagttaagagtgaatttaagggagtagctacagaaaagccagtgatggggcaaaaacaaaatgttatgctatttttttaaattgagttctaaaagaagtatgaaattgtttggctgtcgatttttaagaaaaatctcatacctatggatagtacaataggttttatcttaggctttttggcaaaagatcagaatctaattaaatttggaatcgacaggcagggagcttggcaggtatttgcagatcattcatacttcaacaacacagatgccctgtaaattactgagaactaagagactatggcaggcttccaatttaggatttaggagaatatcacggtgagactagatccacattactgtatagctgaaagttaacttagacactgaagttcatttaaacaagtaggcgtcaactgtgattgttttaagaactggggagggcattgcttttttggaaggctgatcttcaggcttaattcccgagattgattctattgacctatctgcctatttatatttatacacacatgcgcgtgcacacacacacacccagagagagagagagagattgtttgtaagtagcatccctgcatccctgatagtcaaacaggaccatataagcatggatattacctgggtgcctattagaagagaataatttcaagcctcatccaagacctatggaataagaatttgcatcttaaaaacgtctccagatgactcacgtgcatagatatacaccttaaagtttgagaaacaatccctaggtgtttcaaatgcagggggtcataagaccacacactgaaaaaaaaataattaggtcttaaaaattttgtttcattgtatagatgacagcatcgagtacaaattttaatagttggtaacacaactggataaagatgtcaaaataatatttttcctcatgtaacacacatttgatatactttatatggacaagattttctgaaatattttcttgataacacagctctgactagatctagatctcctgactctttgcccataattattgtaattgtacttggtaattgataatagacctagctaatgagaaacagcaacccattttattgcatctcttcattttttccaacatactttcattttgcaaaaaaattatattgtttgaacattcccttttgaacattagtaccctcaaaggaaataccactttgtcgtgagactttctttgataaccagactgtccatcaaactatttaaagcctgaaggcctatgtacatctctctgaagtaacttgcttgctcaaacactacttggaggggtgagaatctgaaaccttaactgacacattgagatcttcatttctactttcttttccatgcatctcagaaatatgaagagcagcactgaaacttagtagtattttattcatttttgggaaattagtgcttgtatgcaaagacctactaatctagggaaaatataatctgctctatctctgtctctgaatttggaaaattaatccctttgtagctaagaacaaatgttacatgtatagttattttatttttatgaagcttagggttgattgaatctaattgtttttcctcacacaagtcatttaacccttccagatctcatttatgaatcaacaataagagagtatttgactaaatgatcttccttttactttcaaactaaaattttaaagttatatgactatttcttatcatttattcatattgtttgaagtttgaatctatattactattttaagcattcattgactcatagtaactattgatctagcaaacattaaatgattattgtatgccagtagttctcaaggtgtggttgccaaaccaccaatagcacttgggaattctttataaatacacattcacagtctccactccagacctactgaatcagaaactctacatttgggacacagcagtatgtgttttaacaggtccttcatacacaaaaatttcataatcgctgctatatgccaagtactgtgtcatcttaggacataaggaagcatgcttgagtgagcgtgggggaaacaaagtaaatttagttttcagcaagttaagtttaagatgcccatagcacatcctaatgcctctatgtaggtcaggcactcagagaagaaaatatatacatcattggtgactaagaagtcactaagggaggatgtgtcaaatgaggcgaaaaggctaaaaagtggaacttatgttttaaaatcagctgagccaggagactgattaattaagggtactgttaatacctgccaagatgtgagagcagaaccagaaaaacatgattagaaaatccaaagaaggattaaatttcacagggggtgtggtcaaaaggaatctattctaagaaaacaggtactgaacagtggccagtgaatttggaaattaggtagtaatctctgttagaatacaacacactaaaaacaggagctttttctttttctttttgtctgtttctcccacacctaacaagacttgcaagaatgtatgaaaatatcacttccatgtgatgtgaataaaaataaccaactattctttgaaaaagacacttagtagtggtagtcagaccgtgaaacaaactagatgttacaagtaatgtgtaagttggcaaagtcaaaaaatgataaaatggcaaactttctaatagttgtagtaatatactatatgcaaaatatgacttagtatatttagtagtcacagacaaatagatttttgaaaagcaaggatgccaatacaattctttggaaacataagatcaaaagtttattccatcagatctaaagagactataaaataattatcacttaaaattctaatatatttttatttttaaaagtttctgtataattataaaaatttataaaagtatgcatgtacatgattattaaaaatgagatctaacaagagtgtttataaaacacggcaaggatccagtttcaaacccaccagtctcacttttccatgttaaaaggtgtttaatccatatcactaagcaatatgcttgttcccgtttcttatatagataattacaggcattgtttataaactaactgtcataaaatggtgttttgccacttacagtaccccaaatcttcctttctcatgctatagctgtgtcactagtgttaattcttaccttagttgctttgtacctttatgcaccatgtttactattatttcttgttcagataactctaagatactttaccaggtgaaagtaaaaaaactccctcgttcactttcatttgatgacttctgtcatctctaatgttacaatgtaaaggtagattataactttgttcctataattggaacttccaaactcatagtgttaacattactctggccatgtaaatatttaccacaaagccaaatggtgtgagtatttgatgacatttcctttcttgctcatcagtagattaacaagacttgttcatccaatggatttgttaatcctgcaattgctgatcacatttatttcttgggtaattagccttcatttagtattattttttttctagcctccttatcccaccagatagacattgagttttttcttcaaagattttcctatagaatttctctttacaacatccttggtttggctcagtatttctaaatgccatgtttctgttttggtttatttattcatgttgctggaaaaaatccccaagtaaacgactaagaaagattgtatgttttctgaatctttccatgtctgaaattgtctttattaaactctcaaagttgactccatatagaattctaggttgaactcctctagttggatgttgaggctttggatctgaatttgattctctatgctggatttgatttgtttcttatctttatttaatgtatttagtctctgcattttctcctacctttctctgcattccctacattttctctatatttccccaacatttcccctacattctagaatattttctgaaattcttagaaaacattaattccgcctccttttcgttgatcatttatttctgtacttttaatatttttagtttaaaaatatactaatatgagatttttgaaaatgatttttaggccgcttttattctccaaaatatgtgacatgtctaaatgtgaattcaaaattaccctctagatttagtttcagtaatgtctttggtgacctttccctatgtgtgtatgttaggagtagggatcatgttacaaagcagactgtaatgatttgtgctatggtttggataggattctccaaacttcatgttgagattttatccccagtgttgtaggtgggacctattggaaagtgttcgggtcataggggtggatccctcaaggacaaagattatgccctccctcaggcgtgagtgaattctcactctgttagttccctagagagcttgatgataaaaagattctggcacctctcccctctctctctccctcttgcttcctttctcaccataaggtctgtgcatactcctgctccccttcactttctgccatgagtggaagcagcctgaggccctcaccaatactgatgcccaaacttgaactttccagccatcagaattgtgagccaaataacctttcttctttattaattacccgatcttaggttttcctttttagcaacagaaaaatggactaagagagaagataatggaaaatagaagtggcaatggaaatcataagtataataaccatcacgagctgtctatgaggtgagaactgacgaataattgaagggaatagaaggcaatctaatagaagaatagtaagcaatctaaagaattttaaatcacatttatattgtttttatatccatgaaatgatacccttatttataaaactgaaacaccttagtttatcccctactccttcatcccaatccttaagacatcaccaaattatgtaagttttacctaccaaaagtttcaataattttccatttctctgcatcaccattctggtcaaagctactctctctccttcaactcatgaccagcttcttaactacattcactgtacctatttatacatgtcttcctccaactctaactcattttccatgattcagacagagacatctttttaaaatgttaatctaattgtcacccctaaaggaaactaaaaatatttcaccccaaatatacctctttgacatattttgagatggctgttcagagggcctgcagacaggaatagccctacaaaggtgccttttgtggggagatttgcatctgtggaggcaataaagtgaaataaataacagatgcaagcaagcttttcctgacgccccgcttgtccatgtctaggaaagattaacagagagtctgacaccttttaagatctgacagagaaacatttaccatagactatcacctattttttctgagggctgctacctgtacatctgcacaagattgcctttactccatgcctttcttcttctgctctaactctgacaatctgtcttgccatgccataagcccctattctttctgtaaccccaagatggtataaaagcatcaatgattgggcatttctttgagttttcatattttgtatgactcctgtacatacatgtgcagataataaatttgtatgcccttttttcctgttaatctattaccagtttgtgttatagagtcagattacaggtcttcaggaataattttatacacttcacattcctggaagacagggataagaagctgtccttcccattgtattagaggggcaaatcacataaattgaaaaatagcaaattattaataattactcatcaaatcagagggaactttaagttcatgattctatccccatgtctcaaatctataaaacactgcctataagaagttaactttttactttcaggaagcatcaaaaaaaaaaaaatatatatatatatatatcacctgatttataatatctcaagataattttatagtgtagtgcccacagtagagtcttacctgtggggtatctatgtgtacattggcatcaatacacatcaactactatttttgtgaaacaaaagttaatacttttttttaaaaggcaaaagactttttggtgagtgatggaactaatttccatgttcaaataaatcataaatgctacattaactagctatttgaaagtaggctacactagctgaaatagagcttctttaaactttatttctaggacaacctacagcatcagatgaaaggcatagaccttcatctgccaaaataaacatgcatgaaaatgtgttacaatttcaagggtgtttacacatatctgagtgtcaatttaaaaatatctgagtatcttaactgaccacattaagttttattggcattgtaaaactccatgagtgctggaaccagtggtgtcagtgtttaatctacactatattcttgacttttgactttgagtatatatatatatatatattttttttacctttcagtttttcagttttttatatgtcaatttgaaatgataatatctaacgtactgggtgccatgaaaattagtagtgatactgcatgtatgttatgtgataaataataaataataaatagtaattattagaaatatcattaaaaagcaaacaggttaaaaatccagttgaataaaaatatatgtctcattctcaatataaacacagcaatgctaaaatggtttctgaagaggtatttttcttatagaataaaaaagtataaattttatattccagtgactacatgtgttttaaatgtaatttgacaaataataataaataataagaaaatatttaaaattgtttgctcttcaaagaccaacaatcaactttctttttaacttttttatgtttaaataaataatcactgggcttatgactaatctatcttaatttttaccaagaaaaattctagtattgccagctatttacacagcaattgaagccataatttctctttattatcctacatttaaaaatacataaattcatatatatagaaaagctgggtaatatgctaattcatttaacaagtattgtttctagaatttttgcagcaagattgaactattttcaagaactatgctataaacacagcaacatcttcaatgcatatcttttagaatttttttttctcagtaaaaatgtgttgctggttattttatgaaaaagttttaagtcacatagtctttacatagtaagtcatataatcataaaaataacatgaaatcttcctgaatttgattttcaataaaatgaatgggaaaaaactaaaggaaaatcacaaatgagggaaagcagatggtttagagatttgtttgctttttagcagaagtttgagtcagatactcctattttatcttcattttatatttccttttttggaaagctgggtaacaaaacatagatttttctatggaataatgattatttagctctcaagatatgcaaaagcttttttgaaataaaatatgtatctactttgcatggaaaacagtcaaaattccaactgaatgtaattttattttattttattttatttgtttttctctgagatggagtttcactcttgttgcccaggctggagtgcaatggcatgatctcagctcactgcaacctctgcctccagggttctagcgattctcctgcctcagctgtagctgagattacaggcatgcatctccacgcccagctaattgtgtactttcagtagagatgggatttcaccatgttggtcagactggtcactgcaacctcggcctcctgggttctagtgattctcctgcctcagctgtagctgagattacaggcatgcaccaccacgcccagctaattgtgtactttcagtagagatgggatttcaccatgttggtcagactggtcactgcaacctcagcctcctgggttctagtgattctcctgcctcagctgtagctgggcttacaggcatgcaccaccatgcccagctaattttgtattttcagtagagatggggtttcaccacattggttagactggtcttgaattcctgacttcaggtgatccacctgccttggcctcccaaagtgctgggatattacaagtaaagcgtgttattcttccatccagaataatctcttccaatacaaatagtcatttgctttcttgcttatggaacttagctatccattcagatatttcacaagaaactatactttcatctatgtaaaaatgcaggattcaaaagaacttggaagttgtttacactacataggttttcatttatcaattattattattatgtttttattttataatggccaagttgagcattgtttttgaaaagtcaatttaacattgtttaagatttaactaagcatgtaattgaaaaaaagtgatgatgagactttagtgtatttagcaattagaagaaaatccttgattactaaacaagtaaattgtctgtctaaaacatctttagtatgttaatttatttgtaattatggaataagggtcaagggttagatgattggtagaagtagaaaaaatcattataaccattgtaatacagctaaatgtgtgcttgaatatttttaaaatcctttagttttcctgctctaaatgactttaaactttattactatagttttgcttggtgtgtgtgtttgtgtgtgtgtgtgtgtgtgtgtgtgtgtgtatctatctatgtgtagggaaatgatctggcccttaattgaacaagagtatggactgatataacatgcctaccatggttaactcaatcactcttccatttttttaaattggaccatttaaagcattttatgctgtctcaactttcctatttccttccctcaacagtttctttcactcacagaagatgactttacatagaatttcaaaaagaaatagaagcttttacttaagaatatctactaactcatttaaagagaaatctattttttctccttctgtctttatttctcttataaacaatgaaagaagtgtttctaattccatttaaagctactctttcacctgtatttgaatgtccagttacaataattaaaatcataatcatatctaacccttggatattaaatgctgttttcctggcactcaactaaaccttttactcatatttacctacttaatcctcataacaacagtgtgagattgctatcatgatcttcattttacagataatgaaattgaggcacagagaatttaaataacttgcataaagtcacacagctaattagtgctgaagccaggatttgaatctaggcaatatggcttcagactgtgctcttatttgctgcatgacattcttgtcatcaaaaaatgactctctattgatcacaagtagccctctacttaccatcctatttttcttctctcctttctcaaccagtttcttgaaagtgtggtctacttttgttatctaactttctacttctcattaaaaccttcaattatagcttccattccttctatttcactaataatactcttgcatttccattatttcctgattactaccatgatacttaattagatatttcacaaatataccaaatatatatatatacatatttgtgatctgaatatatataatatttacatattatatatataacatattatatatatatacatatatatatatatatatatatatctgaatagtactgaacaccagtggttaacactattgatgtcccatacaacgcgtctttccttgtaagctgacccacctctgacctcaactgtaccaatggtggaaagtccatctcagggtttttgcatcagggctctctgggaactctagaaaacttgctcagctcaacctagagttgcatggtcttctggggggtgaggagaggtgtaggttacaccacataaggcaacgttcaaccaatgagggacttgagtctccagattaataacagcccctatccttcagagaaacaagtataaggttcattctacacagttcctcagagagtgtcagtaggactaagccccaattgtctataactaaaaaaaacctcaataatatacccttcattagattttcctttttcatggtgatatggtttggctgtgtccacattcaaatctcaacttgaattatatctctcagaattcccatatgttgtgggagggacccagggggtggtaattaaatcatgggggccagtttttcctgtgctattcttgtgatagtgaataagtcttacgagatctgacgggtttatcaggggtttccgcttttgcttcctcctcattttcttttgctgtcgccaaataagaagtgcctttctcctcctgccatgattctgaagccttctcagccatgtggaactgtaagtccaattaaatctctttttcttcccagtctcgggtatgtctttatcagcagcgtaaaaatgggctaatacacgtggtcttactactcctgtttcctaatcctgattcttaaagttcttcctcagtaaattacccaccccaaattcttttattaggctctgctactaggagattccaaactaagacagtattacaaactgagcccttcctcctaagacatcttttcctgtgtcttctccatccacatatggttctggctttcgtgtttcttctttggctgctcttttcagtctcatttgttggcatcttttaatagttggtatttccaaagactatgcccaaggccgccttttcttttcaccttacgtattttccttggacaatccttcccactcacatgacttcagttactatcaatataccaccaatcctcaagtcaatggtccagcagagaacaaatccctgatctcgactcgtaagcctgttttccctttaaacatctacccttacaacatgtttcatgggcacatcaaacgcaaaattgaaattgtcttcctttttcctgcatgtcttcaagtcaatggtccagcagagaacaaatccctgatctcgactcgtaagcctgtcttccctttaaacatctacccttacaacatgtttcatgagcacatcaaacgcaaaattgaaattgtcttcctttttcctgcatgtcttctctatccaacctgcagcctaggctacagacttggttttgggtacactcatgtctctgtttccaacgtattttactttaaattttcacaaactaaccatcttgtcatttgggagttaatttttaatgccactttctctgagtaattttccctaatgcttgtcttaaatgttaatgtaaattaaaataatatgagaattttgttaacatgaagattcacattcagtatgtatggggttgaaactgaaattttagtatttctaacaagattctagatgatgctaatgctggtagtaagagaattacagtagttgagatttagattagattagatgagctatttattctcctataacatcaagtatttcccatgcattggctcttttcacactattataatttctactgaaattacctgtgttctttgcagaccataagcttcctgaaggtgttcaataattgattaattaatatgttctaaaatattatttattgtcaaacatattatttagtctttgtcaagaacaagctttgaagtcctttttaaaaataaaagtgccatttttttcatacgatcaaatatatgtaaatcatttaaactcttttacatatttttatttttatttttcatgttagatttagggaattcatgtgtttgtttgttatatgggtattacatgcataatggtggtgactgggcttctaatgtacccatcacgaaactattgaacatagtactcaataggtaatttttcaaccctcacccacctcccattctccacccttttggagtccccaaagactattatctctatctttatgtccatatgtacccattgttttgctcacatttataagtgagaacatatgatatttgattttctgcctctgaggtatttcacttagaataatggcctcaaactccactttgctgcaaaggacatgattaaattattttttatggctgtgtagtattccatacatatatacccacattttctttatccattcaactgttggtggatacttatgttggttccatgattttgtcattgcgaatagggctgtgataaatatatgagtgcaggtgtcttttttatacaattatttatttctttttgggtcaataccaagcagtgggattactgggttgaacggtagttctatttttagttctttgagaatctccatatcgttttacttattttttttaaaaaagacttctaatgatacagtagaaacaagcaagtcagacacctatttgttgtcataaaatacctacttttcttttcctcaaaggcaggtaatatgccttaagcagttgaaggatccataacttagtttattaaattttaacttaaatgacctcccatttaatttcttaaaattagatgattaaggacataatgtttcataaattataaagccaattagcataaatctagagatactatttcacaccagggctaaatctactaggctatcaaagattgcagcttttagagcaataatttagataagtttgggtgattaaaatgatgcaaatattttgaaaatgtgggtgcactgattgttgttacattatagcatttgtgtgtgtgtgtgtgtgtgtgtgtgtatgtgtgtacattctcttctttgtatgttatgtgtgtgtgtggtaattcttcaataaaaaaaggaaatttaattatgtttaacttccattccattgggaagatatattcactatctgcaataaacagttaagtgatttttaagaaataatatattcctaatgtcctttttccacagccccaacaaattttttaagcttttagtgatagatgataaattattatgtaagccctgtatatatatgaaaatgcgttaaaaacagtaatagcttaaaacaggacattgtttaaatatcactaatcttctacttcattattttagtcaaaatgtttcttagcattagtaatagcttgatttacatttgtaaatctctctagtttgtttgaaatgcaactgtttctatcttattgtttgtagctttccaaatttaaagcaactgaatatctgaggatatggataattactaagtgtaaatataatctgaagaataatttttaaatgactcaccagcaaattatcatgcagaagcaacatatctgatgaagaaaggagcatttataatgcttaacttttatctttgtatttgtttttcaaaagcgaaaaattctaacaaagatattccttcagtacaaattaaaaacctgattttctttacattcataatataaaacaagatcaaaatggatgttatcatggtacttatcaagtctgaatgatgtggtattaagaattaatgaagaagaatacataaatattaagaagatttagtcaacatctatgtttcagatccaagtattgattggttatcagtctcaacataaatcaatttgaatttttgtgctaatccaatgggggaagtgacaaaatataaacactataatgatcattagtaagtacctactaaagagtaaggagatgttattagaagaaagtgcaaagtgttgcacagcagaataagaaaaatcatagtccttgagtcttaagttaaaaatcgagtcttatttaagtaaaatccatattggtgaatatcaatgattgatttcaaaagaattacacacatatatgtatgtattttgtatacatacatgtcatattgtatacaaaagatccatattggtgaatatcaatgattgatttcaaaagaattacacacatatatgtatgtattttgtacacatacatgtcaacatacagaaatatgaatttctgaatgtaagactatatatgtaacataaattgaacaatactttgaattggcagtgagtttttagttacctgttgacactgctttgaatttgatagcaactcaggaaagtagcataaccatgatgcatgatgttaccagtggtaagaggacaatttcagaaaatcattaatggagtttataaaagaaaattgatccaaactttctcaacttggctagtatgaaactaatggtcactggttgatctaaatctaaaatttgactggcttttcagaaccaggtcaccatcgtaacttccaaataagtttcctgaagtagtgagagaagacaaagaacttccaatctaactacaataaagtcaaaactaccttattaaaattagaaccattcatcaatacaaaacaaaacaaagtttccaggtaaacttcacagcaataattgagagcagctgcttactaaaaatttagggacctaatacaaagccagtggtttcagataaaatgagggtgagtcaagataaatgtgttatcaggcaggaagtgaattggctgttatgggttatgcaaagtaaagaagtgaaatgcaagaaatggaccaataggttactggatcttgactgtagatgaggtgagaagagagcaaaacaaaggagtttccagttgtgttccactcaaaccataaaggaaccaggagcttacactattcctaacaatcaataagattttttgttaatttattctaatagaagaagagtagattctgtttcaattaatacacgttttgtgttctcacattataaacaatttctcaaaatcagctgaggctgcaagataatgacactaatttgatcttttcttctattttcgccatgctgaatgatcttaaggagacacatttaatccatagtcactgctaatgaacattttcttagtcaggtgtttaactaggcaatgagaaaattatagcaaaaacataattatttttcctaaagttaagatggtgggctaaggatgagttatatacatttaaatagaaatgataaataatggaataatttgatttggaaattattctagtgcactatttctcttctatatcaacattaattgatagagaatgttgttctctcccagttttatggctttagactctatatatactggtaagacctaaatatgtatttctaggctagactactccattaaatcaagattcatatactaaatggcctaattggcatctccacttgggtgtgtactgaagatttaacatttaacgcatccaaagctgaaatccttcatcaaaacctcatcttactagtgttctgcatatcagatgagtttctaccgggagctggggccaaaagtgtaaagtttttgttttgccatatttttttctctcatacaccgcttctgtcagcaaattttattagatgtactattttttccattacagtttcattgaagtataatttatataaaataacatccataaattaagtgaacattttcgtgagaaatcatcatcatgtggaggttttagaatgtttccatccgttccaaaagttccctcattcaccttcatagctaggtcatattccctcccctggtcccaggaaatcactgatctgttttgttgtcactcttattttccctgttctagatttttacataaatggaataacatttattctttttcatgtggcttttttttttcactgaggacaatgtttccaagatatattcatgttgttgcatatatccgtagatattttttctttatttctgaataatattcctggatctacttttataatgtatttacctgttcacttctattgctacaaacagcccagtttaccatgaatttgtatgtgtatgattgtgatagccttctaattggcttgtttccccttttgactgctcataattcattcttaactcagtatctcatattatccttctaaaatgtaaatctgcccatggcataactttgtttaaactttccaagtattccaatcttagatggaaagccaaaatatttcaataacctgtatgggcctatgaaacacagcctttcatggcctatcctattactgtccttgctcactcagccccagcctgattggtactctcaagcctggaaggagagtggggagcacaagagtaacagagaagtcaagaaatagatatattcgcatctgcctgcatcatcaatattcttcagtggtaagaaatttaaaactataatattagaataatacagattatagaaaatcctgtaaaaattgaacatttgacaagtgacattagtatataccccaaaacactccagtgcatgtatctaaatatcactgcattgtagttttacttggtaaaggagtgtgaacattattgacttaattgattattccggatcatgagcataaagaaatgtaattatagcgcaagctaaaataagatacctaagagataagagaacctctaggaataaataatgttagctctgtattttcttaaatcaagttttcaagtttgtaaataacaataacaaaaatagcaggaacaaaatatactgtgctataagacctgatgtatgactggaattgtacttccactggggttgaaataaaaaaaaaacctctcagttaattttttcttgggaaaaattataatggtatgagattcatattttctttgaaaatataatagcatatatatgttttcactgttaatggagtatgttaaactactgcaatgtgaagaatacaaggttgtttttgttcttcaaatagacataactttatataaaactacaattaccaaatttgattaaaaacggacatatttatccaatattatcaaattaaaacaagttaaaaaaacctgaatatataaagatgttaactgaaaaacttgatttataggtactccctattttcctgccttaaaaataatgtcccattacattaattttttttctatattaaagtagatattttagtgggtcagaaacattgggcatatattcaacatactgttataggtcatagtagaaaacagcacatatacaccttgtttcacagccttctgaacttcaacatcagagttttgaagaagagaaccttcctcattgctacctttataaattaaaaaatataaactaaatgtgtaaataatagaaactacatatttttattgatgttcaaagtttttatataattataaacaattctcccaagagataaatataatttatcatatatgtgtgtgcttatttattcttttccaaactataatgccataaggccacagagctagctattgtcatgcgccagcaataactagaaacattttcccctgattgtagaatggtattcttactcttcactgacacaaaatgcaaaaaaatgttaaagataaatattttttatgtgcacacactctaaaagaagtaatggcagtatagtgatgatggagctaaatggaacatttaaaaatgtaaattttaaaaattctttttactgattctccataaatatgtatatttcgaggagtttggtgattttatttgctaggataagcaaaggagaggagaaaaatatatcaaagctagagaaggaagaaaacattacagacgttgggacatatattgggtaaactgtggacaatgagaattttgaaaagcagtcttaagatacaacataccagaatctctgggactcagctaaggcagcgataagagggaagtttataacaccaaatgcccacattgaaaagttagaaatatctcaaattaataacctaaaatcacaactagaggaattagagaaacaagagcaaatcaaccccaaagctagcagacaggaaataaccaaaatcaaagctgaactgaagaaaactgaaatagtaaaaactgtacacaaggtcaatgaatcctggagttggttccttgaaaaaattaataacataagtcgatagaccaccagctagactaataaagaaataaagagaagatccaaataaaaattcaacaatgacaaaggggatattaccactgaacccactgaaatacaaaatcctggctgggcacggtgactcatgcctgtaatcccagcactttgggaagccgaggtggacagatcacgaggtcaggagtttgagaccatcctggacaacacagtgaaaccctgtctctattaaaaacataaaaattggctgggcttgggggcggtcgcctgtaatcccagctactcgtgaggctgaggcaggagaatcacttgaacccgggaggcgaaggttgcagtgagccaagatagcaccatttcactccagcctgggtgacagtgagagactccatctcaaaaaaaaaaatatatatatatatgtacacacacacatacacacacaaggtgtatatgtgctgttttctactatttatattatatataaaatatatataatatacattagtaatattatatatgaaataaatataatatacattatattataaaaaatatataatatacattatattatatataatatataatataatataattatatattatattatgtatattatatataatgtaatatatatagtatatatcatataatatatataatataattatatatatattatatatataatataattatattatatattatatataatataattatatatatattttatatataatataattatatattatatatataatataataatatattatataatatgttattatatataattatattataatataatacaattaatataatacatattatataatataatatatataatatatattatattttatatataatatatatttatatatatatttatatatataatatatatttcatatataatatataatatgtgaaatatatatgttatataatatatatcatatatattttacatattatatataaaacatatatattatataaatatgtaaattatataaaatataattatataaatatgtaaaataatatatacttatatataaaaatatataaaacatttacatataaaaatatataaaacatttacatataaaaatatataaaacatttacatataaaaatatataaaacatttacatataaaaatatataaaacatttacatataaaaatatataaaacatttacatataaaaatatataaaacattttatataaaaatatataaaacattttatataaaaatatataaaacatttatatataaaaatataaaatatttatatataaaaatatatacgtatttatatataaaaatatatacgtatttatataaaaatatatacgtattctatacacaaaaatatatacgtattctatacacaaaaatatttacgtattctatacacaaatatatgtacgtattctatacagaaaaatatgttcgtattctatacacaaaaatatgtacgtattctatacacaaaaatatgtacgtattctatacataaaaatatacacgtattttatacataaaaatatataagtattttatacataaaagatataaaataaataaaaaataatatataaaaataaaattatataaaatatatatattttacatatattaaatatataaaatataatatatataaaatatatgtagtatataatatataaaaatataatatatataaaatacatatagtatatcatatatataaaatatatagtatataatatatataaaaatatatgtactttataaaatatatgaaatatatgtattttatatattttatatatgttatatataatatatattttacattatatataatatatattttatattatatattatatatattttatattatatattatatatattttatatactatatataaaatatatatttcatatatttaatatataaaatatatatttataaatataatatatattttatataatatatgtaaatatatattatataaaatatattataatatatatccctcagatatacatcatctataatttatattatatacattatatacatcatctatcatatacaatatatacattatatacatcatctataatatatattacatacattatataggtcatctataatatatattacatacattatatacgtcatctataatatattacatacggtatatacgtcatctataatatattacatacggtatatacgtcatctataatatattacatacggtatatacgtcatctataatatattacatacggtatatacgtcatctataatatattacggtatatacgtcatctataatatattacatacggtatatacgtcatctataatatattacatacggtatatacgtcatctataatatattacatacggtatatacgtcatctataatatattacatacggtatatacgtcatctataatatattacatacggtatatatgtcatctataatatattacatacggtatatacatcatatatattacatacggtatatacatcatatataatatattacatacagtagatacataatatatataatatatattatatacataatatatattatatatattatatacataatatatattatatatattatatatataatatatataatatctattacatatatgtatataatatatattatatacataatatatataatatatattatatacatattatatataatatacattatatacataatatatattatatattatatacattatatacataacatatatattatgtacattatatacataacatatatattatgtacattatatacataacatatatattatatacattatatacattatatatattgtatacattatatacattatatacattatatacattatatatatataatatacatatccctcagagagatatatatatccctcagagactaccacgatgaagaaatgggtaaattcctgaacacatacaacctcccaagactgaatcaagaagaaatgtaatccttatacagaccaataatgagtttcaaaattcaatcagtaataaaatcctgccaaccacaaaaagcccaggaccagatggattcacagctgaactctaccacatttataaagaagtgctggtagcatttctacttaaactattccaaaaacttggggagggactccttcctaactcattctatgaggccagcatcatcctgataccaaaacccggcagagacaacaaaaaaagaaaacttcaggtaaatatgcttgatgaacacagatacaaaactcctcaacaaaatacttgcaaaatactatgaatatatatatatatgtgtgtatatatatatatataaaaccatatatatgtagatagatagatatctttttcttcaagtgattttgtaaaacttatttttggttcatgggtatatatatagagagagacagagagagagagagagaactatactatagttcatggaaagttgaactatactatagtttgtcgacagcagtgtgggatttctctaagaacttaaaacaggatcaccatttgactctggaatcctattattcagtatatactcaaaggaatggaattttatatatatatataatatattatatataattatatataatataatattttataatatataatatattatatataatatattttataatatataatgtattatatataatatattttataatatataatgtattatatataatataatattttataatatataatataatattttataatatataatatattatacataatataatattttataatatataatatattatacataatatatttcatgatatacaatatatataatataatattttatgatatacaatatatataatataatattttatgatatacaatatatataatataatattttatgatacatattatatataagatcatattttatgatacatattatatataagatcatattttatgatacatatgatatataagatcatattttatgatacatattatatataagatcatattttatgatacatattatatataagatcatattttatgatacatattatatataagatcatattttatgatacatattatatataagatcatattttatgatacatattatatataagatcatattttatgatacatattatatataagatcatattttatgatacatattatatataagatcatattttatgatacatattatatataatatcatattttatgatatatcttatatataatatcatattttatgatatatcttatatataatataatattttatgatatatcttatatataatataatattttatgatatatcttatatataatataatattttatgatatatcttatatatattttatcttatatattatatatgatataatattttatcttatatattatatatgatataatattttatcacatatattatatatgataaaatattttatcacatatattatatatgatataatattttataatattttatcatatacaatctataatataatattttataatatatattatatacaatataatatgttataatatatattatattatatataatataatgttttataatatataatatgttatataaaatataatatattatatataatataatattttataatatataatatattacatataatatatataacatattttatatataatacattatatataatatatattctatatattctatatagaatatagaatatatattctatatagaatatatagatatatattgtattatatataaaatatgttatattacatatataacatatattatatatatatagagagagagagagagagagagagaaaatgactagagctgattctcttggcaatgtgtggatgctactagaagatggcctttaacgaccaggaagttgccctcatcagacaccagattggctagtgtcttgatcttggacttgtcagcctccagaactgcaagatataaatgttgcataagctaaaccaaaacaaaacaatcttctaaaatttaaaggatgatgataacaagcatgataacatttggctggtgatttaaagtttgcaaagaatgtttaatagtcccaactattccatgagtcatgcagggcagacgtgattatgtttatatcttcatgaggaccctgaggttcactggcaggaaataacattcttaataccattcagcaatttccttgtgtcactgggattctgaaccatgtattttatacatagaacacatgctcactttttttctgtgaattatctgtcatatattggtaagggagccagttaaaatcttctgtgactttctgacattatgatttcttagaagatttcaggtaattctaatgttcagccaggtctgagaaccactggtctagaataagaagagtgcaaccaggtgtttgtcatgtgagaaaaatagggcatatgaagacttgttgagaaaacttggaatgctatcttggacaagaaagtaattataagaaaaggtttgacttagctctactgtactaggcagaactagagaaaatggtggaagttatagagatacaggtgtcagaaaaatagaagccttgaaattcacagaattaaaatatcgcaataataaacgtaagccttgtgaagttgtagccttcagaaaactgctcaaacaaaaatggacaaccatagatcaagaaaaatggtggcagtcggaattcaatgcagatgtaaaaaataactagatctcagatttcaagatacttaataaaatttcacatttgtcttgagacctaattcccattcttctgttcatgactatttaatattttgtgcatttgttaaatattaataatcaaaacaaatgtgtttattaaaaatgatcttttttgcttctttctttgtggtctgatctattttttaatataacttttcaaatacttagggggctgttttttacacaatcacttgcaacctaatctttatagccttagttgacagactgcctgctgaaactaaccgagagcaaagttaatgactttggtaaggccagttaaaaaaaagtgatgtatttgagaaggcaagaaatgcaaacactccttatacctacatgttgacacctatctccctaagactcagcagtgttttagcttaattatttccggttttgtgactgacctacttgagatagttagaagtcaggtaggtatgtgactgggtgttactataaatacataagactataacaaattgggttgtagctcaaacctacagctagtggaagaaagcctcccaagagggctgtatagaaagatggtatttagtcttagaaataattactggcataagccctgaaagttatttatatagaatagaagaggtcagatgatattaagaaaggggatctccttaccctgtatcctcaaccagtactatacattaatgaattatgtgtataaagatgacccaaaagacatttaaagtgccttttgggtggtccaaaggagattaatacatatttagtatagaaagagacattcagaactggagggcaccacagagataattaatctgactatgttaattttacagatgaggaaaagaaacccagagaggcaaattcatttccacatattttatacctagttagcaaatgtcaggaagaaaaccagggttccaatttcctaatgcgtaatctttgtcattatccctcatcaaccctaccattcagcatgttttgttgttcttcagttcttattaattcttgggtcaaacttttatatcctttgtaactacaataattataaactagagtgccaattttcttgataactctagataaagaggcatttagaaaatgtgtccagcaagaaagaagtattccattctggagtaaccgtatatgttccatgtgagtttgagaacctgcctggagccaggcaacatcagaatatattctctacctctaactggaaaatttaagcacccctatctccatgtggaggttgataagtaattgttgtctatctatccattcattgattaattttccaatgttgggtcactgtttgttgtttttctttcatgtgcacttttttaaaaattatactttaagttctagggtacatgtgcacaacgtgcaggtttgtcacatatgtatacatgtgccatgttgctgtgctgcacccattaactcgtcatttacattaggtatatctcctaatgctatccctcccccagcccctcaccccacaacaggccatggtgtgtgatgttccccttcctgtgtccaagtgttctcattgttcaattcccacctatcagtgagaacatgcggtgtttgtttttttgtccttgctatagtttgctgagaatgatggtttccagctttatccatgtccctacaaaggacatgaactcatcttttttatggctgcatagtattccatggtgtatatgtgccacattttcttaatccagtctatcattgatggacatttgggttggttccaagtctttgctattgtgaatagtgccctaataaacatgcgtgtgcatgtgtctttatagcagcatgatttataatcctttgggtatataaccaataatgggatggttcggtcaaatggtatttctagttctagatgcttgaggaatcgccacactgtcttccacaatggttgaactagtttacagtcccaccaacagtgtaaaagtgttcctatttctccacatcctctctagcacctgttgtttcctgactttttaatgagctcttttctatgatacgctcctcttaatgtgaaacactatttaggaaaattttcatttttcatggtctctgaattgtatctaagaaatatggtatctaagaagtattacttttgagaaattaaaacttaaatttagtgaaaagtttgtgtatgtttgaaactatgtaaaggaaataaaacacaaatagcctgggtaatgtccaatctggtatgataacatgaattaatcaatttatgtctgtataattcatccaaagacacaagatacttccttatttttatgaatgtattatgaaacttctatttgtgtttttctgcttaagaatacaaataaaacattgtggttaccacaaatctgtataagatctatgaggaaagcttagactaacaaatattttcatggaatgcataacaaggggcttggatagtgctataaaacacaatcttagattctgttttttattaaaatactacttgatacagaaagaaaaccacatctgaaaattaataataaaaaccaataggaatgatggggagtgactctttaatgggtaaagagcttctgtttgggataatggaaaagttcgagaaatggatagtggtgatgattacatgacaaaataaagagaaaaaaagagaggcatatttacggtacagatatgtaaatatattcaatatatattaagtaaataagagagaacttgaggaacaagtttgaagagttaggatccatttgtcttagtccattcatgcttcaatataacaaaatatcttagaagggatactttataaagaacaggcatttatttgtcatggttctggaggctgggaagtccacaatcaagacatcagcagattcagtgcctggagaggtctgttctctgcttccaagatggtgccttgttgctgtttactgtgtcctcagataattgaagagcaaaaaggccaggcagctctctgaagcctcttttataagggtgttaatgccatttacaagagctcatgacttaatcacttcccaaaaggctccctcttaataccaacaaaatgggaattaagcttcaacatgaattttggagggacacaaacattcaaacagtagcaccattagtctctgtatattctatggatatccagcatatgtctagaaaacattctggaataatttaagttacataggagatttggttatggaggtactcaggttcaaaactgcagagttctgggttactaaatatgtttataataaatggacacatttttcatcagaagaaaatggtaaaaatgatatattttatgttacgtatgttttatgacaaaaaataaaaactagagcacataagacttcatggccatgacacctaataagactcctaataagaattctttgtacattttgtgcctttgttagacctgtagttcccattacacactatagaaaaagtagtattctatttttgtggcaaagaactataaggaaatcgttttattatttacaagatgggaaactttctggaaccacgagataagacatcccgttgcttgctcaaagtgagattaattaccttccttcatgtaaaactagaaaatattaaatgttatttcctcttccagagaaaatggcacagtcaagattagtgtgctgtgagcacagtgataattagcatctatcttcaggtaccctgaatcatacagagttttccattgaaggagagttgttatgatattgcaaagctcttttgaaggcaacaaaactagatttcctgttcaatttcttaaagttaatttatgtaagaatctcaataataattataggattagcaagtgcaatcatgaagaacatagcttgttaaggtatattaaggtgtataagcctcataaaataagatacttttgaaaataatttaatatttttgtaaaaatcattctgagaagttctttgaaccagcagaaacctatcctacgatataagataggaaaacaacttcagataagtttcttcccaaaacgtagattctagggtctctctcttctatcattatggatacatcagggccaagtgaattttttactttctactacatcctctctatatagataaattacaaactacaaagcaatggccatcagaaatttgaaacaaataaagtaaaaaagctcacttaaagctctcattcatgtaaagttagtatttttgtcataatgattctttcccatatgacaatccctcgtcccttactcctcacatggtcagctccatttcatccatcagggctaggtccgatgttaccttgctaaagagacattttccagattcatcacctgcctataatcctctcacatctattccatcaatccagcaagtcctgccacttctcctgcctgcataaatcccagaccttcccactccttgctatatccaagccatctctcaagcccagaccatcacatcttcctgggatctcttatccaattcccctgcttccattcttgtcctaactggacctacaccccacaccacagccaacatggtcttttcaaaactaaaaacaaatcatattatttccctgcttatacctttccaatggctccccattgaaatgtaaactaatcagacaaggagatgcctcctgatctggcctgtcttcctatttgagcttcaatcctactgtccagccattgtcctccgcactgactctgttcctacatcactgactttgaattgctagagcaagttagcctcttcccatctcagcggctgtgtactttctcttttctctgataataaaacatcttccttcagatgtttttgcattcttgtctcagcataagtgacacttcaccagaaaggacttctccaactaacccttctaggagaatagagtaactctcttccctccacatgttattccctatccaattactttgttttatcttgtttagagcacttatcatcatctgcaagcatcttatgcccttgtatgttttagtatttactacctgtgtacactgtaagctgcatgaagacagagacttgtcatgtttaatatggtaccctcagtacctagaaaagagcctgacaaatagaaggtactggatttgatgactgaatgaattaatatatgaattaactggataactctcattattctctaaattcttcattccttttcttcataacaccatattatatcatgtttatacacacacagatatacctgcttatttgcttcttttaaatttttgacttacttattaattgatttttggtctgtctcctccttaacctgtattctacatgaagacagtggtcatatctgtattatccgtatttcaaattttggaaatactttggtgtctgaaatattattagcactaaataacacctgatgaattaatgaatctgataaactattcaaacaagaagaatcaacaggtgtgccttagaaagtacatttccctttctgaattttatctcagatgaaataatgatgaaatcatgaaattacgaaatgatgaatacacccaattcttcactgatgcacttaagcaattgttatgattaaatgggggactttattgtaatgttaggaaaggaaaatttggaaaaatataactactacactacagtagagaaaactttggatcttgtttttcttatctctaaaatgtgaattaattgagattaaaatgatctctatataggaggtttgtcataacgtttgtttgtaaagtgttattgagtaaaaataattaactactattagagatgaagaaaatgagtctctaagagactataaaacttgttgtggtcatgcagttatgaagatgcagagctgggatttaacatttttcagtgtgatgctatcgtctatgcattttctactataccaattgattaaagtacattttaaaaaatgcaatgggcatgtattcagaattctggtaatttgttatagattactaatttgcatgttttattgctaccacctcctcttttaaattagtgtaactttttaaactaaggcttctgaaaataaatgattataattttaaaacatggtacataatttcaaaatctacacctagatttaaattccatgaggaggctgggcacgatggctcatgcctgtaatcccagaattttgggaggccgaggcggacgaatcacctgaggtcaagagtttcagaccagcctggcaacatgttgaaatcccatctctactaaaactacaaaaattagccaggcatggtggcacacgcctgtagtcctgctactcgggaggctgaggcaggagaatcgcttgaactcaggaggcagaggttgcggtgagctgaggagacagaggttgcagtgagctgagatcgtgctcaccactgcactccagcaagggtgacagagacagattctgtttcaaaaaaaaaaaatccatgaagaaatatgaaaactattaactttaattaatcaaaaataacttgggttatttccagataatataaaatgtttgttttttccacaatattttaatagtaaaatacaaaagaatcacagattctcttgccttgtttgtataccaagttagtaattccacatcctctgctccacaaaaaacaaaacaaacaaaaacaaccttatacaacatctgagaaacaggtaagaagttgctaccaaaactcctgaaattgattatatttatttatattctaaaacagtaaaatgttctgtatcctagaaaaagttttataattaatttttgccacaaattctctatctactaaatagggagaataactcatcaaagagtttgctgggggaattctaatgatcaaagcttaacagccaccgtatatactcatgtttcctttacatccccgtgcagtatttggtgtttagtaaagctgcttacaatgccaagtacatttcctttcaagtagataaaagccttgtgatagatgaatgtaataagatactaaaaacacccacagatatctaaatgatgtctatattacatccaatatagtcacagaaaatctttggaataatgtgagatctatggtatttcatattatttcaaagttcatactattttaaattaataaaactcatgaaaatcaattttctaaagtataacttcactgtttatatggccaaaagcacataaacagcactgcagaacataaatttttaagtgaagatttatttatatttcaatatattgctcacttaacattcttgtttactaaacacaggtgatcaaacagggaagaatttaattaaactgttcatcaaatgtttgatctttctcaaataaacttgtttttacggatggaaaaaaatcttagaataataaatctagctctcagtgaggtcttccttggatgttatggactaattttggaggttggaagaaaaatgcaaaggctgatctgcaaagcacttctgagaattttaagttcatcatttatctatggatttctccaaagcacatttgtttgggaaataagaatgctgctttgtatctttgtgactctgctagttagaggtataaatgtggaatctaatttaatctctttggatctcagttttcttatctctacaatgtgaattaattgagattaaaatcataatgaggatcataaatagaaaagtcttccttttttccagaactggagacttcaaaaaattaaacagacaacttttaaactaagaaaatatttgtgtcaatattgtctacatagcattaattatctggatggtaatttagcaatttaaaatgtcgatatatgctaacactagttagtcctgtgcacactcagaatactgactgttttctttattctgattctttagctgttgtgtgaatttagcttccagttaatatctaaaactgggttgagaatgggactattttatattatttttataaaacatggggacctaatatcccttattgctagattttttacattgctcataggagggattaccactgtaactgcataaagagcacttattaatttatgaaagttgagaaggtagtcattcgattttttttaattaaaaaaaggaaattgatttgtaaatttaatttcttaaatttgtgttttcatataacttcctggggcttgcaagagttgaaagctataatattactgccaagaagccaggaagaatgagtcatctagtcaggaaataaaggcaattaaggcttttaacctttcaccccttaaagacattttaacatatttcaatatgatcaaatctattgtgaattttctgaaaatctattgtaaagtttcttgatactttaaacaatatttaccgtatttgcaaggtatgtttcagtggttattaaaaatcccatttgtctttaaatactttaaaaactgggtgaaaaatcggaggaattaaatagtgaatgcaattaaatataaaatgtaagtttcggtgaattggcaaataaaattccacaattaccacattctacttgagtgccatgtgtctgtttgggaataatcgcattcttggctggacacagccgttgtgtgactcagagcctcatttcctcttacagcacatgggacccaatcctctggattctccaggaccagcttagctctacaatcctcctgccagataccactaaaacagaaggagctctcattgtaataaaaatacattttatgaattgaccacattttagtggagctggacaggagtccttcaaccagagtcttatctaaatcaattgaaagctatatgtcatggtcctccattgtattgtgccacagcagtggggacatttcagttgctgaatattatacttattgtacttaccatttttctgttcctccttcttgcttgcttatagatttttttttttttttggacagggccttgctgtgtctcccatgctggagttcagtggtgtgatcagagctcactgcagcctcaacctccccagctcaagtgatcctcccacctcagactcctgagtagctgggagtataggtgcgagccatcatgttcatctaatttatttttcactttttctagagacaaggtctccctctgttgcccaggctagttgtgaactccctggttcaagcaatcctcctgccttgaactcccaaagtgcagggattacaggcatgagccagagctcccagccaaccttttctctttctcttctgtcctttctgcgcatctacttttagcagctctgcatctacttatactgtgttgcttttctacaaagttcaaaggtggagcttagttcaggggctcattattactagcaatctgagctccaaatatgcaagttatttctgtaaataactaaaaaattgttcagtgctctaatcagctcatcatttggaaataaaatttaaaaatcttctcacgttaaaataaaattcagtattttatattctcattggaagaaaaacttgagtctatttacatcctttaatagaaatcttgaattctctctaaatatcacttaataacactctcatgctaaaatttacgatcatttttattatacatgccaatctaaatattttaatagaggcttttccaaaattgctaaagtaacttttaaatttttagttcattaattctagtaataacttcagtaagtgggagacagcaagaaatcttttaaaacaaatatactattgtaagataatttcacttggcaaagcttaagcaatgaatatggaatataatcatttatgttatattataatctgaatatatgttttgatcctttaagtaaaatactggtatagtcagaaaaaaagttgaaaatattttgtcccaaagtggtttatagttgtctcatatatatatcaaaagtttttaatttgtattttaagttcacagtatcaatatattctgttcaaaatgtatgagttacttcatatattcttcagagagaaacattttgacttcagaaagtaaactataatatcttactctcatattattgtttcatactatttatgatacaaataatataattatgttttatacaaatttccttttcttaagaatggcagagaaaaatccacgttagtgattcacaataaatgatcagattacaattgaaaattcaggggaaaactattggtaaataaatattttacatactgaattttttttaataacagtgatatctttgttaataaagaggatacatttaactaatgttttacttaggggcacttcattactcctggtaaataagacacggtgtataagatgcattctagataatgcattccaacatttctaacagatggcttaagagaagatagcaatttcgccctacattttattattttgccacttcttaccctgtatatctccacattctctgtcatctatcaacttacagcaccaggccatatacagtagtcctcacttattagtgggacatacgttccaagactcccagggatgcctaaaactgcagatagcaccaaaccctatacatatactatgttttattcttatgcatacatacctatgataaagtatgatttataaattaggcacagtaagagacgcacaataactaataataaaatagaacaattataacaatatactgtgataaaagctatgtgaatgtttattcgtgcaactttccatttgatatttttggaccatgatttaccacaggtaaccgaaactgaaaacaaaaatatggataagaggagggctatggtgactcaaagtctcagtggttctccattgcctaccaaaccaaatacagacgattttaggccttacagctactattgtttttcaagtactccactgcccattcaaaatatatgaacttcctaagaaattccaagcatcttcctagctcttcatctttgttcttgtatctgtggcacaggccactattttcccacctaaatctcttctctgcttgttccctatggatagagttgttgagtggtcacagttctgcttagttagaaaaaatttctcagcctccttgagtagaaatatattaataattaagttctcatcaataaaccatgagaagaagtaatatgcctgtcccgctgtgttctcttcctcttgtcatgagctggaagacaaacatgtctcctgcacagcttcaaacatgcagacaagaacaataccctagggtggtgctggtctctggaccggtagcagcagcagcatctgagatcttgttggaaacacaaattctcaagccccactgcaaatttaatgaagcagaaactcaggaaatgtggcccacaaatcagtgttttaacaagcttttcaggtgactatgaggcacactaaagtttggaaagcattgtcctaggtgatagtggaggaacaacttggatgaacctatattcacaaatggccatttggagcagtgtcatcccacttacccctctcatttcacaaagtttatttgtgaaatcatatagttctttaagttattgaattgttgagtctctgtcttacagaagtttagtatttgtcctaatagtatttttcaatatataatggctatttagtattcccaccctgtttaatatgtccacccgctaaaatggaaatctcacctaggtctctgcaagtttgcactggaaaactgtgtaacgccaaagaagaccaggccagttttgccttcctttaatctattatacacactgttgattaacattttttaaaaatggcaaatctaatctcatcactcttccatttcaaattgctactagactctcaaggcatttaggctacaagatagcatggttgcctaggcctataaggtgtcacctaaactgatccctatcagcctctccagtcttatctagagtcatttcacctttctctctgttctagctacactttctatctgtctgttcatgaactgtggtaagcttcttcatacctcagttttttctcatgaagttcactttcatgtcttacttctcatctttcaggtctcttctcaaatataatataatttcttcttctctccccccatttcaccctacagtattccatatgaatcaagtaaaaaatcttaaaatctcttatctcgcctgtacatttccactcatagcattaatttcctaaaaaaataatgtagtgctttctatgaatcattctattaggtgaaatatcctcctaaccccacccactatattacaagaagcttgatgagaggaggtaccatgtctacttgctcactatgtgcctagcatctggtagtaggcctgacacatggttagcattctgcaggaatgcatggagtgcaggaacaaaatagattatttgaagctcaaataacacgacaacttataactgaagactatttggatcctacttacttataaaaatgttgtttcctaaagttttatctattagagttatctctacctacttaatgggctcaaattcctgcttaacatatttgtattaatgattccatcagaaacaattttgatcaaggaatcttagattctaggttaggaatacgtcgtatctcatgcactgttgtgatttatttttctaaaagacaattttaattcagacttaccattgctaagtttttcaaaggatatccctttaataatgtacaatctcatcattccagaattcaaaactatttttggccataatctaggctatttcacactttccccagcaaggtagctattgtttcattcaaattagactattcaatatgtctcatacatctctacctcagggcctttgcacactttgttcctgtctgccagaaattctctcagaatttggacatttttctgagacatttctctcatggtgactaatcctgcctgctgattacctcttcattcttcaaggtccatttccagtgcatcccagtaaagcggctaaccaaacacaagttacatgcaggttgattcttgtcaatgtgggttcttatcagattagtggctccctggtcaccaggtttccctgtgaaagtgcttcacagtttgtttctatcttatgacatataaggaatacaaatacagtaagaatacttgaaagagaactttggggagtaaactcaaaaattcaaacagttctaaaatatcaaatgcataatcaattaattaaatggaaaatacagctctactttagagctataaaaagaagctaacatatgtgctgtaaaaaataataaatgtaaacagcaaaaaactaaattaaggtttagtatggagaaatctttagcactttgcacagtcctgaaaatgtgaatatctacaatatacatgtagggcattccagcatataacttagagcattgacacagaaattatcactggggaaaagggatgccatatgccacagtgggttatatcaaaatacaaagtttgaaaaatcatgggatatgtgatttacaattggtaagtttctgtttttctatttagttaaattaagtctcaaactccctcccttataaagacttactccagactttataacaacacttagttaatataaaaattatttgccccagatgagaatataaagcaacattgttgtaccaggagcctgatttgctagcaactccaatggctacattaagttattccaagcattgtcacactggtgttttcctgcaagagaatctcacagaggttcccagccctaggatctccctcgcctgagaacgtttggctctactaccaatttaacataccacggtatgttaaattcagttcccgggaagcaaagtacatgctgtagcctaataaaaaatttttgactaaggtactatgtgggagttgtactcaaggcattcttatttgtaaaggaaagaggaaagcatttaagaattatgaaggaaaccaagtgaaatgcttgattgaaagcacttggatctcagagctagctcttccccttaagaataatcctaatgcacattagggtatcaaaacattttttatttaagtactcagtcgatatgatttttcaaggtcaagatcattataacttcaaagtccctctgctcttctgaaggcagatgctactgaatgctacaaaatcagcaaaccaaattagtaactcaactaagcttcttgatgtaatgaagatgggctataaaacaggatgtaacttttttcttttaaaactaaataatggtattattcataaatgattatgggcattactccaaactgttcctctttgctcagccattattctagtcatatagcttaaaaaattgaagacttagaattacatgacaataatgacaaactctcccatctgtctttctgagagaggaggctccatcatctcctgaagcagaacacacccatgattagcccaagactaagaaatggcttcaaatctgatgagaggcactttgataatatgcctcttgctcccagggaaataaatctcagaattctagaagagaaagcagattgaatatttcatttctaaaaagtgatctgtgttcaagcaaaataaaaataagaaaatggtccttatactccctctggacagagagagtaaatacggtaaacaaatgactatacaatggcatgatcaagaaacattcccacagccttccaaaggaaaaggcagaatctatgtaaatagtgaaaggggtaaaagtatttaagggggtggagtgaaggtaagaatcacttggtatgttgagagaacaatgatccttaagaatttaaggatccttaagagttgatttggcgccactcctcctacatccaaatttttcttgaagagcatataaccaagaaagtatatatcttaaccataattattttattttaaatgagctgaaataaactctattgcaaatgggatttgaatagcttgaagataagagcaggttttggtccctcaccttttgtgtctgggtgtaccattagcttacacaaatttgaaatattaggttgatttaaaaaaattaaaaatgtatctatggaataaatttatgtggcagttctgattatgggccttcatttacaagaaaaaacaaggatctatggatcattaattaaaactaagcaattaaacaaaaacatttgcctgagctaaataggtttagaacattattttttggtatgattacataaaattgaatcattttatataggtggataatgattacatattactcctttgtatagctgagagagtacttacattaaactttaccttcttttccaaaaggccactaatagttatcatatataggccaggcacggtggctcatgcctgtaaccctagcactttgggagaccaaggttggcggattacttgaggtcgggagttctagaccagcctggccaacatggtgaaaccctgcctctactaaaaatacaaaaattagtcagaaattgctggaactcgggaggtgcagattacagtgagccaagatcgcgccacagcactccagtctgggcaacagagcgagactccatctcaaagaaaaaaaaaaaaagccatcacataaactctttccaagattaacaaaacttgataaatttgtcattttggagaagtttagcgtttttatttcatatactcgataaactgagactcagcacattctttggacattacataacataatcaatatttgaatctaggtatagaactggcttggtggcttggtatcttgtgccctgccattagaaagcacagtccattttaacagctcattttgcacctgccctggaattatgcagtctgattcacagtttcaggatgctattcagtccataaagggatttggaattgataacttcctcacatatttaaagttattctttggtcatattcaagttggtgatattcgtattttaatttacacaataaaagtctttcatgtatatcaagtataccaaggtgagttgcaaatccctgaatcttaagtcatgatttatattgtgccaaaattcttgctcattgcagaggaagaagtgaacacataaagcttctattactatagttatttgattggagacagcgacataactagaaataatagtcagcttcccaggagtgtccaaatgtatgaactaagatgtagtagtataaaaaaccaaggtgatcaaaaggagtttcatttcatgaaggctagatgaagtgcaattatatctagaaaagaaagtgaccactcaaaatcagtttaaaaataaaagaatggtcatcatggagaatttgtctttataggttaattcctttggacattagtaacttaaaatctatggaggcttggcatgaaggtcaaagatggcatgttaaatcttcagggcacacacatttacactaaaaaacacttctgtaagattgtttcaatcaacatttctgaacttatttgaccagggcattgtttttatatatgcataatactgacatgtctgtgaaggacgcttttggattagatgagataaagaatggtctaaaaagatgctaagtaaggactgaatctgtcctatgctcattgaactgcaaatctgagagttatcagaatattgcttatgtaagaggctgtcttctatgcaagtaaaaattgtaaatggtgatctgaggatcataactcctggaggcttcagtcttatcaattctatatagagatcagggggtaaggtgagatttttcctgatagaactagtgaatacattccttttgagagagaagttcctctgctgtgagtccctttacaacctcttttgggataggggtgtgaaaaggctactttctaacacctgacatatggaaaacacttgaaacaaattcatttaaggatctttgaaataagctcatgtggttgggagacatggatctggactctgaataatatctgacaacatgtaaatagtctgcgaacgctggagtctgactatcgtcaaggaaggctagatacactctcctcattggtttggaagagaaggaagaggagtgctaacagattgtctaggagaaggatgcatgagtgcttctctgtggactacatctgaaccatataggagggccagcattccattttgggtcctgcccaagagtgcctcctatcagaattttacctaaataaaaagataataatttagccaaaactcaaagagggcaaatcaccaaagaagctgcacattactcatccactatgtaaagccatgctataagattaaattgaaatttaaacatatacttttcataaaaagtaaaatttttaaaaagtaacataatgtccttaagacctatcctggattacactgactaaaaaatgagtacagaactttagaactaaacttcttggcagaacttggtttgtagacctaaaatttattcttttaatacaaaaattagtcaggcgtggtggcaggtgcctggaatcccaactacttgggagactgaggcaagagaatcatttgaaccccgaaggtagaggttgtagtgagctgagattgcaccactgcactccagcctgggtgacagagactccatttcaaaaaaaaaaagttatattcttttaatcagctgttcctgattacattgttccaaatgccagtaaataccaaagggttatactagttttcttgtcctctatcaaacacttataagatcaagaacttcatgatttgaattattacaaaatcataacatctttgcatacaaatatctatgattccataagtgaatacattgagtttccaagttaaacttggctaatacaggaaatttaaaaacataaactttgtgaacttatttaatatgcaataaaatgctaatcactgcaatcctggaagttaaacatttgttttcttattgagaaaatgtatagcaatgatgcagaccaaaaaaaaaagtgtgaaaggggcatttttattaaaagcaacataaaatgaaagaaaagcaacagtgtaagagaaacatcagatttaacgtgatgtagtcttatcttaaatctccataaaattagcccaaattcctttaagtatataattcttagttaaattcagcattgtataaagtctcttcttccttactacgttcttcgttctttccaattcatttggagactatttaaaaatgaacctcaaaccaatttttgtggtttatcttttcattacttcagtaataaaatgccaacttgctcactgtaatagctagtggcagtataattatattcaagggaaatatctaggttccctttctcatattgtgtgattatagtgttgaaaacttctgtaaataaagcagtaactgaaaacttctttggatgttttgaaaacaattctgagactaagctgttatcactcaccaagagaaatattctagagccattttaatcattactttcagaaacgctctttggcaaggtgcatgactctgtcaggatcaacaaagcccctacattacacattgttccattaatttaaaatattcttatttatctgtcagaaagctactgatgtttggtcaagaatattagtactgtcccaataccctatatttagccctagccaaagaaattcttcatgtgggaaaaaaaaatccaatgaataaatcattgcctatatttactttttctctctcttgtgagaaaagtttagagcagcaatcattttaattagcacattgagcataagaatgcatcacagcagttgttatatccagttttaagactggagagtgtggcgacttatctagatatacaggtaatatatgctcagctaagcatatggattgtaatataaattatgattatagatgagggggggtacagagggacatgcacaatagctgcctgtctccacttaatcagctaacatttttctaacacatacgagagaagggtttattttaactattgacatatgatagaaaatgagccatgataacatcttctatcagctttttacattttgaaatatatagctattttttctgtagatgtaaagtcacatttaaaaagattattattcaactgagaaatgagaagcaaaagatatgagaactatcttgaagaaacctcaaaatatcaaagaagatagtgtgtttttactttaaacattttatctcttttttttttttatagaggagatggtgtagttatcttgaacacaattcaatttactggttcaggttagctggttaaagacattggcgataaataaaacaaattaccttctcttgatactgccgcctcgaagaatccagagactggattaaagcggtggcatggccgacaaacatggcatagcaggtggccccgacgatcatgctcagcatggtaatccagaggtcagacatgctgactggggcttgggctccatacccaatgcacagcatgtgactcatagctttgaagagtgcgtatgaatactgctttccccaagaatcattctgcaacataagataaaaagaaaattgactgagccattaggatggcagaatgaaaagtgagtaggacctgtacacagaagcattataaaatactgaatactggaaaaatccttacaatggagcatttacaaatgtacttctcactaactgtgaattaaatgatgtttttcaaatctttcttactatgatgaagtggaaacagtctgctgttacttacatgcgctttgtcagttttaagtttgctgtttttaaaactaaaattccttttgggacaatggtatgccatgtaataatgacaagaatgaatgctttaaggtttcaaggaaatgtggtcaaatagtattaataatatatttgcaagctatgaaatgcagcagacagtatgacacatacaggccaaagtataaacatttttatcaaaaccatgaagttcagattttaaaaatccatattgatatagctgtatagtccttaccactacaactttccttaaataaaaatttgaacaaatatatattggaaatacaggtctgataaatggaaagacttccttgaagccctctctcgaagtgatgtatattgtaatttgtgtcaggattgaagacggctgaatcttgttggctttttataaaataataaaatgaaataggcaaaagaacatcttggcttatgtcctggagaaaacaataggaaatgctgacttctgagattatttattagttgtaacttctgatgtcatttaaaaaaaattgcaagctcaattttttaaaaatgctgtccaatgtatcttatctaatttttgttaaaatttaaattattttttggataaattttattgaactccctaattcaagtattacacaatttataaaagccagagcaaaatgaaaatgagggggctctggttcaaaatgcgggaaaaaaacttattaaatataataaaatataaagatttttcctttaaaactactttattatttataaaacctaatgtgataacagtgataaatgagtaaaaatataagcttacaaattttaaaaatcaatattttaatgtcatagttatatgtaataccataaataatactgtattaatgtgatattttgattggtcataaaatttttctggcttatttttctgaaattcatttcttagattatcaaaatttatacaattaacaactttattttcaatgatttagttgaaaatgacattagttgctcttggctattggaagattacttatttttaaatttaaatttaaattttaaattttacatatttttaaatttaaaaatgatctttctattaattcaaatgttattaaacctattaggagtattttataggctgtgagattagggtcaacttctgataatttatttaaaaatatatatttgagtacatttggagctgatgattttcatagaacaacttttcaataaatatttaacttatcatgccaatctgtttcataccaatttcacattgaatttagtttttatatctgaatttattttttaatttaactttttacttttaggtaattacagatttacatgcaagttataagaaataatagagagagattctatgtactcttcactcagcttccccagaggtaacatgctgcaaactatagaatagtttcatagtcaggaaattgacattgatataatgtactcatctcatttatagctcagtaatttaagtgtactcatttgtgtgcctatatgtgtgtgtgtgtatttatgtctatgcaattttgtcacatgtgtaggttcatgtatttattaccacagtcaagacacagaataattccatcacaagggtcacttatactgccttttattgaattgaatgttaaatttaaatgtatgcaaggatgttttagtgtttcttctgatatttcctgtaacttgtcaaggccgtgcaaaaaattgaaagtagtttcaagatttgcatataatttaaaatgcctgtttatatattgtattgctatatttttagttacaaagaaagtttaatttaaaaattatcttccttgttaataattggtttaatttaaaacttcatataaaaatcgtgttattttccatcaaatgtgagtcttaaatttaatttgtatttctaagtttatggacatctgctgtgcaattttgcagcagctttcaaaactggacattgtaaacactgaggaattctaatgactttctaaagtgcttactgccgtgcccatgtgtaaacatttattttgtaataatttatttacaaagtttactgcctgagtgccatgggtattgtcttggaatttaggtgggagatttaatatctgtttagatactacagggatggtcccttgggactgatgagcaagctctctactcaccatgggtgttctccctgcctgcatggatagccactttcatctctcacgactgcctttgttgctgctgcttctcctgctgctacagatagtcactcctaatctgggaccagtcctggtttggccacatcagggacacatagcatctagactgctgagtgatgcatatgctgccttgctgctaggccaattgcatgtctcctgtgcctacaggcctgaatctgtgtgtgtgatgctgccatcctgcagctctgctgctcatgttcacaccctgttgtcctagtggacttcacttacaaaacataagttcaaagataaaattattaagagtttcaagatggcaggagcagaacattaaaccaagcacagggttcttttgacagtgaggggctctgtgcaacttcaaggtcacatatcaatgaagccaaacctgcatttgtcaaattaactcttaaattatcataaacttttcaagctattttattttgaatagatatgggtagttttgtttgttgttaatagggttttccaacatcaaatttgtagatttaaacaataaaacagaagattgaaaagcccagtcttataaaccttggaactgcacatagttgctaaaaaataaagaaaataactagccccatttagctgaaaggattgaggttcttaaagtgaaattcactattatttaattataataaaagtcctgctcatattaaattatcctctctatatatgtattttcgcaaaagtaaaaaataagatttaattttaacacaagaaaattagttgtatgtcatattttaatatgtacatagtataataaactcatgcaaaaactcttattttggagaatgagcaaatttatactttactttatcagtgaaaatgtataatactcagaaatacatctaagatttccaaaattctagatggtccatgaacaagaaatggtatatttacatttactaaaatgtaaaatctaattcaagatttcctttctccacataagggtacagacaaggtatattgttaaagcatcttgaggtatttagataaaatggaaataataaaaagttcaatggggtgtcgagtggagactacactttatttctattggtattgtttatttctttttgtatgaatggaggcagggtatggagctggaaaagaaagtttaattcagtttttcagaataatacagctatgtctattctcatttatttcactagagacacaaaacacacacctgtgtatacatgctcttaaatgacttgaaataaatatatattaaaaatgctttttttttttttttttttttgagatggagtttcgctcttgttgcccaggctggagtgcaatggtgcaatctcaactcactgcaacctctgcctcctgggttcaagtgattcttttgcctcagcctcccgagtagctgggattagtaccaccatgcccagctaattttgcatttttagtagagacggggtttcaccatgttggtcgtactggtctcgaactcctcgaactcaaattccatcacctcaggcgatccacctgccttggcctcctaaagtgctgggattacaggcatgagccactgtgcccagcctaagaatgctttcttatttttaaaatcattagcaacttttctattttccattcttcacatgtttccattcctctttctctacctacatttccccaaaatcaggtatggatcattctgtgcctttctccatgttcatataatcacacacacatgcacatacacaaatccatgattctggctttttttcccacaaaaatgaatcctattatatatgctcttattgttgttatcacatataaaatgcctccaaataatctgttgttcacataactatgtaatagtttgttgatcacaccatagttaattcagtcattttttccattgttctccagcttttgccactacaaactattctttaattaaaaactttatccatatatcttttctttctgtcagtaacactcccaagagtgtgattgttggttcaaagagtaagattttcagtttgattttaaaatatattgccagattgatttaaaaggcagtaccttttccaatgtgtaaaaatatactgtatcaccttatagagtgagaaataataacccattgttatttttattagcatttccctagccaaggaatttgagaaggcgttcatgtatttatttaccaaatgggcttgctcatctctaatgaaatttttttttccttattaatttgcaatgcctccttgaagactgggtatcacccctttaactgatatgtgctataaatatttattcctaatttatcatttgcctattgaccttctaatcatataattactcatataaatatttcaattagtttatgtaggaaaattaaatctgtaagttccttggcagctgctggatttctcataatgattaaaaagctatctctaaataagattattcctatgtcctgaatgttttttcagattattttattttttatatttacttatacttacacgtattacctagagaaaggttttttttttttttggatatagaaaagttcacattttctttattctaaattaatggaatgtcttttgtgccagtatataacttttagtaaatcaacaggtctccatatagagaaatatatctcttttattatatattgtctctataaaaatggtatttgtgtctgggctcaatattttgtttcactgctctgtttagccacttttatactgagttttaattaaacaaggtttaattaaacaaggtccttgtttaaaaaacaaggaccatctcaattccaacaggggtttaaactgaactactgtgtgagggaatttgagtaagaccatgggtcatgcaggtaaaaatctaaaacacgaagtttgatggggagtaggagtatttggaggctgagaaaagttaccaaaccccatagtatgtgtgtgtacatatataaaattttagccagtctaaattgtagagaagaaacaggagggaatgaggagcataccagaaatatgacagaatagggaacataccaggcaacacagtgatgaccagagtctgagtccttaaacattttcagtacaaaacgggaagccaatgaaaacttgtgagcagagaatgatatgatctaaaccgtattttaggaagattgatcaggcagaattgcagagtgctggttcttaactaaggatgattttaccacttaggagacatggcaacatacaacatcagcagacattttagttttcacaactggcagaggtgctattaatatctaaagggtagaggccagtgatgctgttaaaaattctgcagttcagaggagactccctctcctgcctcacaacaaaaaattgggaggtccaaaatattagctgtggtgaggctgaaaaatcctgaggtagaggaaggatgtaataaggaccaaatacagaagtcagtataaatgttattacaagtttatgagaagtgaaatgagaacttaaataatataaaagtataaagcaacaacaataacaattttgagaagacagtatctacagaatgtagaatattagggattcatggaaaattcagaaggattaatgaaatataggctttctctctctctctcccccttcctctttctttccttctttcttcctttcctttcctttctttcctttctttcctccttccttccttccttccttccttccttccttccttccttccttccttcctctacttccttccctccctccctccctccttttcttttctttcttttgtctcactcttttatgcaagctggagtccagtggcataaccatagctcatagaatttgagctgtaacctcaaattcctgggctccagcaatcccatatcagccttctgagtagctgagactacaggcataagccactgtatctggtccttaggctattcttcatgaagagtgaatgattaggcataaggatcttctctgttactctacaaggccaatattgctttctttagacactgaattttgtctacacacattgcttgtgtttgcaagggccaagtgaaccataacaaaggaaagtgagcatttaagtagcagattctgaggctggtgttgaaagaattccaagtagaggaatgacatcctaacccctcctccatcatacctacatatcattaaaatcccaggaacaaagggcttgtattagtccattctcaggctgctaataaagatatacctgagactaggtaatttataaaggaaagtggtttaattgactcagttcagcatggccggggatgcctcaggaaacataaccatggcagaaggggaagcaaacacgcctttcttcacagggtggcaggaaagagaaatgccaagcaaaagggaaaaaggtcccttataaaaccatcagatctagtgagaactcactcactatcatgagaacagcagcatggggataactcccccaccatgattcaatcacctcccaccgggttcctctcacagcatgtggggattatgagaactacaattcaagatgagattttggtggggacacagccaaaccatatcagggctcaaggagaaaaaatagattgactgtgataaaacacacacaaaatgttatccttataagcagtatattataaatcaggtacatggttctaaactgttcaaagcaccaattattatgttaaactagtttaatcatgagtactattcttaccatcatttgacaaataatgacactgaagcagagaacctaagcgacttgcccagggttaaaattttgtaagtggaagattcagtgttttcaacccatgcagtctccttctaaggaccacagtattattacattacactgctctcatttttataagcctacaaaagtcataggtttttttgccccacttcgggcatcctgtttgccttattttaatctactaccattgaatgatggcttgaatgggagatttaggctatcatctgagaaagttttgtgaaaatctaggaatgtttgtaatcccattctgccttttttcttgtgttacatggctattcctttttcaccttgtaaagatgactgtattatattttagtgtacattactaatatgatattatatgcgaatgggagactgtatactcaaagtgttttaccatacagtccaaatatacccagtttcatataatctgaatcccacagacaataagcaaataaaatataagggaactgtttcaactgaggtttatcttgttttcattttaggtaacaatgtaccaacaaattgttccttttagattatgtttttgttattaaaagtgttcatttagttaatcacttcacttaggcatcactgaaaataatttttttttttttgaggaaaagatattgagtcaaattaatgggaacatagtaagtacctttgcttattccacctgagaactttctcttagtaataatgcattttgagctttctataggcttgaatgaaaatactttctagtcatcctgtccatattgttactaaatttagggagtcaggatgaagggctatttgcaaaaaaaaaaaaaaaaaaaaaaaaaaaaggaaaaagaaagaaaaaggaatatttattctccagtgtcctagacctcctgacataatatatccaattcaaacttagccactcagtagcctgccatgggaacaaaagctctccagtccactagctttcacatgagctgaaatttatttaatttagggggccaaaactttccattattgaatatcagaattaatttttctttattatttgcaagcaaatacaagtataaacgtgttgaagtaggtaaaatcttaggaaaatctaaaatatggcactcagagactctgaagtgcacaaaccaactgctaaaatattgaagaattaatggataataaagaggtgaaattagaaagccatgagtagagtataaattctttagagctaggctacagaatgttgatcaccatgtctatttttttcctgcagtcattgcataaacatatcatttttatcaattttggaaatgccaatcagatagaaagttgcatttaaaagttcttaaggaaaagaatatagtgtagcataattcatttgcagtcataagaagtataacaggtcatcagtgtcaaaaagagtgtgtttacttgaatacaccataattttattatctgtaaacagttggtctttgaacaatgcaggcgttaaggatgccaaccctgggcatagaatgacttttgacttaattaatcaattaattaattatttcgagacagggtcttgctctcttccctaggctggagtacattggcacaactatagttcactgcagctggaacttctaggctcaagtgaccctcctgcttcaacctcctgagtagctaggactatacacgtgcaccaacatgaccagcttatgtttaaaatttttatagagataaggtcttgctatgttgctgaagctggtttcaaactcctggcttgaagcaatcttcgtggctctgcctcccaaagtgctgggattataggcataagacactttgcccggcgtatttttcttatatttagtgctatgatctgcgtaaaaaacgtttgtacctctgataacaaccttttgccttataagagggtttaaacagtttttaacagtaaaatatagaagtattgcataactaaattactgttgccatgaagagtgatgtctgattattttgagagttcattctcaacttgttccatggtcaattaatcactcaagttctaagtgtactttttcttgcttcaagaatgatgataaaatacaaaatttgcattaaatagacttataaattaaaatttagtgatgcttgatatcacagattttttcttatttttttgatattggtacattattttaaaaataaaaattaaacaaatcaatgcattattttaaatttgacttgttcattcatccaattttttatactaagagttcattggtactatttataaaacaggccccaaatttgacattacttaaatactgtaagtgtgatgtttcaattacaattagcttttcaagtaaatcaaatatttctatggggtacctctttgttaacataaataaatataagcaaacatattttacatatgtttatatataagtattagtgaatatattttatgtgtatgcaagcatatatgcattaatataaagccagcatagaagaaatcagcatacactgaggacttatttactgcaaggtactattataacatcatctcattgctcttcttaacagtgaaacctaacttgatattgttattatggattggaaatgcaaacgttggaaaaattaaataacttgctttagttcacacacttgtaggtgccaaatctggaattcaatcacagatctgtctgaaccacactataaactctcttcattccaaagaccatagccatttatgtcataaccgtttatatgagtaaaattcatgataattatacttttatatgaataaaattcatgataattatacataggattttcaggcattttaagaacataaccataacagagaaattctttaaactatgtttcttctcaaccaccaaaagagagcctctattataccttaaggacatttagagaaaaattatctaaggttttcattagagaaaaacgctgaggtaaaatttcctggagagtgtgaggtcagtgaagatagtttgaccttaaaattgtactttagttttatactttcctattagtcaaaaacttttaatgaattcttctttccacctaaccccaaagcctgggatcaagcaatctatacagttatctgataggaacagtcctctagaagaaaatccttgcccgaggctcagcactccagagtatgaaaggtgcagatggcacagggtgacaggttcaatctgaaacactgagtgatgtgctttcactcaacacctggacaaagtaaaataagtacaatcatgcaccacataatgatgtttcagttaatgatggaccgtacattcagcagtggttctataagaagatgataatggagcagaaaaattcctatctcctagtgatcctgtagctatcataatgtcatagcacaatgcgtcactcatctgcttgtggcaatgtggtgtaaacaaacctactccactaccagtcatataaaagtatagcatatatgattatgtatggtatataatacttgaaaatgataataaacaactatgtcacgagtttatgtatttagtatactacctttttattgttactgtattctttcaacttatacaaaaataaagctacttgtaaaacaacctcaggtatgttcttcaggaggcatcgcagagaggctttttatttttatttttttagacagagtctcactctcgttccacaggctggagtgcagtggcgcgatcttggctcactgcaacctccgcctacctggctcatgtgagtctcctgcctcagcctcccaagtagctgggattacaggcacccaccagcatgcctggctaactttttgtatttttagtagagatggtgttttaccactggtctcgaactcctgacctcaggtgatctacctgcctcagcctcctaaagtgctgagattacaagcgtgagccaccatgcccggcccagaagaggcatttttatcataggagttgacaacattttgcatgctactgctcctgaagacattccagtgggacaaggtgtggtggtagaagacagtgatactgatgatcctgaccctgtgtaagcctaggcttatgtgtgtgcttgtgtcttagtttttaaccaaaagttttaaaagtaaagaaaaaatcaaatagaaaaaaatcatatagaatataagtacagggaaagaaaatatttttatacagttgtacaatgtgcttgtgtcttaagctaagtgttactacaaaaaaagtcaaaaacataaaaataaaaacattataaagtaaaaaagttagaataaactaaggttaatttattattaaagaaaatcttaaaaataaatttagtgtagcctaagtatacagtgtttataaagtctacagtagtgtacagtaatgtcctaggccttcacgttgccttactactccctgactcacccagagcagctttcagtcatgcaagctctattcacgatgtaccatcttttatctttcacactgttatacccttttattttttatactgtatttttattataccttttctatgtttagatacaccaatacttactgtgttaccaatgcctacagtattcagtacagtcaacatgctgtagaggtttgctgcctaggagcaataggccataccatatagcctaggtgtgtagtaggctatatcgtctaggtttgtgtaagtaccatctatgatgttttcacaatgataatattgcctaaggatatacttctcagagtgtttcttcatctttctaatgacaggcatgacattacattgctaagtactattaatgtgcacgtttaaattaattttatgaactttcaccaagcagctttacaatgatcattctcaaattagtagatcatctcttttatggcattcttgaagtgtttaatgctgctattttgaggtttgagcacactggagtgttaaaaactactaacaaagtgaaattaaagtgaaaacaaaaaacgttgtatatatttttgtgctgggctcaagtttctgctctttataaacaaagtagctgcctaatgcattaaagaagcagaagagttaagaatgtctttaatcatatgtgtagtctttgggtgtttatgtcggttatcagatcataaaatttattaaatatgcagttttgtatatggaattcttttaccatatatgagagtaaggcattagattttatttctagataatttgcatatatttcaatttatatgatagatggtacaatgtggaaagaatttggactttttatgataattaaacaagagactatataaaaggctgctatattaacaagctctatataaaagagctaataaataataagctttctgttttccaactgaaagagttttgtaaatgaggggataaatttcttaccgatgtgtgtgttttaatggaaaaatatgttcatagcacgttttgctatgagtaacaattctaacctctttgcaaatacataaatcatgaaaaatttattaaaatctaatgcttagagatgggcataactaaaatatagacaaacttaaactatagagaaaggaaatgtgtatgctgataagcagcttacgtagtaattggttatttatattgaggttaaaaagagctttcccattatctcaaaaatcatgctctcacctttacagattctaaaattccatcttagtaatggtagaatttacccttaacacttaacatgtccacgcaattttgatgacatggtgcaaacatctctgatttttttcttctacctagatttactactgggttggggttcccactaccagacataagaaaggatagtacaataaaataaaatagtggcacattaaatatttttatggtagactgacttttatccatcaattcatagaaagttggaattgtaagggatctgtataacaatttatcctttttataagtacactgaatttcagaatctccatgattataagatcaaaatacataaataaacaaataattaaatatattcagattacccaactttattcaaatctagtatgtaaggaacaatacatcttaaggtcatggaaaacattaagttacttgcccaaggtctgatctggtttgtctaagaattaaaaaacaaaacaaaaacaaaacaaacaaaaaatacaaactcatgtctgatgtgcttgcaagtattattttcattatatttgcataatcataatactgaccatagcacaactaacaatagcagaaacatgagtacagtttgcatagatctcttacaaggaacttaatagacatggtgattatcacaagagccttgtggtagcaagaacagtctttattatcttcatttactgatgtggataaagttcagagtttcattcagtagcctattgggtcatgataggtagcagtatctctctactggatctctaggctgctgattgcagatatagtgcttgcaaatctaattattattgtaatctatttggtaaaatgatgaagatactatgatctgtactgtccaatatttccatagagttatctatttcaggcaaaagtactcttatgagatctgtagctaatcaaattatatagagaaccattctcctatgctaaagttattttaatgaacatttagaacatgaatgacgtcagttaaaactactcccttactttattaaaaaagtatttttaaaagtcatattcttatttacagctaagttataattacataactcagcaacaacgcatgttcctcaactctaaagacatgactttaaattgcaaacaaataaataaagcttcaattacaagtaatgctagaactttgtttattgattatgaagtataacaagataagcctaggaaatcccctgctgtgtaagcctgtgtaaaaaggcagaaagtattaagcacttaaagctatttttagaagcctaattcccaacttaaattcttatcctatgttgtgtattcagtgtgttcttagtatgaaaggcttctgtgtcagttacccatctgagagaacatttagcattgacgtctaaatccacataagctgtatacaagtgtaagttttatcatgtgtagactccttgatctcacagacaacttcacagagaattcaaataccaaatagtatttaagagaggcaaaacacaacttcttagatcaacataatcaagctaaatacccttttactagcactcataaaggttaaatccctagagaatcacttgtctctgataaataaattctccactcacattacatttgagtctctctgtgtgtgtacattggggtgagggcatgaggaagagttggggagagagacagagagagactgagagatacagatttcttttcaaggcccagattattctctctcaggcatatctctcaattcagatgtagactgatttggaaatctgttagcaaacaagcacagagaaaagagtatttgcaacaatctgttttattttccctctctttcttttaacttctgttttttttttttattctacccagttacaagactaaaccaatggtgattcaggcgtaattcctatttctgatgagctcctttcagttatctaaaatcaggaaaaaaatgcatattcaatcatagtattactagtcaaagaaaataaagcgaagcagggcccctttaaaatttagtgcattccacttgaaatcatgctcatgaggatattctagctattttttatggcacagagaagaaaatgaaggttattttacctttaggaaataagtcatttttactgcatttctgaatgataaaaacattaagaaaaaggcaaatgcaatattataatccatttatgagatttctgttttcaggaatggagaagaaatgggcaaaataattaaatagacccagaaatggagcatccctgactccttcagtagaactcttatttgcttcaaatcctaatattacttaatgccaacagttcccacaattctgagtactttgggtatgaagcacaattactggcaatttttgaagggagcacaccacttagtgcaattcctgtagaagagtgaattataatttaatcaagcagaatgccaagtttgccacaaattggcagactaactttaaggaatatatccagacagatcataaaggtgtcttgccttaacctcctccaatgtggagggaaacaacagtatggcttactgacaaagcaagagaataccttaataattatcagcatacatttcttagtcaacagggactgttcaggaaaggaagtaaacattcaaagcttaatgatttctcttgtgcatagcttctgtgactcatgccagattttcctgagctagttctaaaatgatttatctgcttcagtgagtttaaagcatttcatcttcacttttctttgggcactgggaataaaggttaacaaagtcatctgcgtatattgaggtgtgggtatctgtgtatatctaccccaggctggcctagaagaagtgtagcattgtggtctcctttatgtacaagcaaacgtggtagcactgtacctccaggttctatggatagtggagccgggaacagtgtaagtctcaagggagacaactgcaatcacactgcagatgaggtttgggaggatagtacctaattctctgatgacagaaaaaaagacaaagaataacctactcagaaatctctcccatatcttcttctgagaggcttgaaattacctctattaagcttctctctatttacataagaaagtaaaatcaatggcaatgtctctggaaggctgttatttgaatgcgtgtatgttgcatttaagtcagtattcaaatagcctccttccatggcctggaggttgtatagtttgccccagtagggttcaggttgatccccaagaggctggaactgggtgagcacggattgacaaaggatgaagagagcatgaggatcatctcataagaaattattttggggatgaaaagaactgaatagcataaaagttaataaaaatggcagaggttggaccctccaattaaaaggagaacaagttagagtgaatgtatatcaagcacataagatggcatgcagaaagattgctattagttttgaacattcttggcttgcctttgccacctattgaaaatgcagtgtctggttaaaatggggaatgattcaaagggttctttttattctctaatcgattatggtgaagtgacatgctagattagtggtaagtcaccttagaaagttgcctaaggacaaaaaataagatgcgtacaattccatttggggaataaaaagttttacagaaacttagagtaggaaatagctaactcacaagaggttaaatcccagaacatttattattcacaatgaatgtgagatccaagcaaaggaatagagtatcaaagtaagtcaggaataaaaaaataaatattttaatttcagatattttttatgatttacctgaattcaacactgttgagatacagtatcattttgccagaagaggtaaatgtattgatattctttgtaaaccagtcggtgccttgagagaataaataatagcaatacggttattattagtcagcccaacacattgataatgacatagctgactgatgattccaattatacatgccaatttgaggatattcagatttgtttttggttatgtatttttccatagtttgttagctacaccatgcaggagcaaattgcgtaagtaagatgggtgggctgtcaacaaaatttaggttgaaaactttcagaggtagaaatgaaaaaggagaatattcagtattttaaatggcaataaataatcataaggatatgaaggggcaggaaaacttggttaaagtagtgatcttgataacattagccatataggaaaatttttattttagaatgcactatgacatttccaaagacaaatgcaataaggaatcaaggtgttttcaaagacaataatctactgcttggctgaaatattgaaaaaaatagattcataataaattatctttttttaggaaactaaatgatcaacaatatctctatgaatgtacaatacaaaaattaaaggcaatcttaaagcaggattcacatattttgaagctcaacaaattgttgccaaagtgtaagaaaaaacagtaaatacctgaactttgcagcataccctagatattaatcaattagaccatgggaaaaagaacaacagtttcagaaagcaaatctttatggccaattcgccaatattagcctatcataacataaatctgaaggcatcacagggactctgagctaccactcaatagactaagcaggagaaaatcttacatagtcttactattgagtgaactatcacaggtctcactccaataccatcttagttatttgttaatcttgtctccctcctccatgcctcaccttcccaaaaaacaatcaacagactaaaaacaaacctgggttactctcaattatttaggtgaacagagttgaatatcattcatctaaaaaagaggcctctctcttgacttctcatcttatctatatggaggcatttgtctctactcagctttacacaaacatcccaaatctgtgtgtccaaactgaattcatttaacctgagtatgctgctgataaaacatgttttctctgaatccctagatgagtttagtatcacttgattgactccatgctgtactcctcttttctccactgggtgggtccagagcttctagacagaagaacagctgaacagtatctgcttctactgttaccatttaaatactaaatagttatcaggctagcagcctggagagtgcatacttatcaaacaaccaatcaaacatacacaaatgacaattaaaaataatctttcttttgtcccatctctttacaatacacaggttcccattcctgcctagtgcttatctcagggcagtcttatggtatcacttgatttgagactatcttaggccctaggttacttctattattatatatttgccatatgtaaaatgacttggcatccttaataactatgcttgtcttttgtgcatttcttccttgtgacccttaataattctgaggtcagttgtttactttccaaggttttgttaaaaccaaattacacttccgtacactctgtcacaattagatatcatcctgtcatatcttgtaagcagtggttaaatgttaaacttaaccacctgttctttcaccaaccttggactttgattctgcctcttttatttctaggactacataagactttttctaaccatgattttactttgctctgaaattgaaaaatatagcagttatttgttttaatgaaaacaatgttttatcttttattttttcttttctagatcaatacaaattttaaaacaaattttaataatttgccatctcagtttaactccctttcagtccattcttcaaagcatctagttacacgtcaaatcatgccactcccatgcttaaagtttcctcatagcttcaagagtaagttgaacctctcatgagaatcacaaaaacttggtcatgatgtatcccctgcatctctcctgagcaatactgcttaactttcctaagccttataacaaaacctaagattgtactcctgccaccctgagctacttgcagttccccaaacaagccaattcattatttgccatgcttttatataggtagttttctctgactcagtgtgttttctggtctcctttctctttgactggacacttttaacagtgtttcaagatgcagctcattttgtaagtttctcaaagatcgaccttcatcccttcaattcagccttcccagcctggttcagcttcttgtctaaatggccacagcacttgtgcttccatttatcatgtgattgctgtaccgtctgtttatttgtttgccttcaccagtataaccaaagtttcctaagggcatagaccatgtcctaaacatctttgtatccaagacatttagcagagtgattgatatgagtggtatctaggaaaaatattgaactgacttaataacagtatacaaatgtcatcctgtttgataatgtaccttaagttatgttgtaagttaaaaagccagatgtcttcatctgagccacaaaagaaaccagtatctctccttaagattcagggtatttctaactatggttgaaatgtgaactttaaatttaatgaaattaaacagatgcctttagtagtctgatcaactgttctcccaattgatatatgtatagcagatatcataaacaattcagcatatattttaacactaatagaaaacttgaaataatgcaaaatatttcaaatttattaggtattattttaatcatgaatgcattgtcgggggtaagcatcactggctagttttcatacgttcatatatcccactcctcacttgatttactcgagtgaggaatgaaaatgtcccttcacaatgatatatttatgctttcctggactcaaagtgcctagagttaaatttggaaataccactgtagtaatgcaaatattattcttcacatatttttctgaggaaacaaatatggaatgcatatatgatatatacaacctgacaagctacacagcagaaattgcttttggtttccttagatgaagaaaacaaaaacagcactgacattgaaagtaaaaagtgtgttctattactcagatttagaaatgtgactagactagtgaaataagtgcttatagatttggtaagagaaggatgaaggcaaacgcataaatacacagtactatatatatgctattattgtttagccttagatgtttcctaagtatattagaaatgaaagcagaacaactttttcactttcataaacaattaattggataagattgtattcaatatgctcaaattttcattttaaggtagaaaataaaagtggcaaaagttttcccatagaagaataagctacagattttggaaaaataggagacactgaatcttgtctcccctctcccccaacaccttaaaaaaggacaaaggcaacacaaatatttcaaaacttttctgtttttaagtcttagtctttttgcctaatattagaatttcctaggcttcctagaatcattcatgtatggacaaaataacagagaacacatttaaatacactaaagtttgaacctgctttacaaacaaccctgaattagtttgaaattacgtaaaactcaaaattcagtagtaatgagaacattcagatgtggttttctctcagtgcagtgccaggcatgtagtgtgtagccattaaatattagcagattgtttattttcaagagatagctcacggtatctattgaaagttgacattttttttgtctctaggtgtacaaccaattaaacaagtggacactaataaatttccctttcacctactacattaatgtaatgtttctataatattttagtatgttaaaaaaacaaaatcctagcaattattgcagaagccatttttcatcagtattttatactaagctatgttaaggtcagaattaagggtagagtctatagtttgtatttactaagtcctgtagtatttgacctttaaatgctgttttgtcatagctattacagggaaagtgatagtgatatatccagtttcatttctaaaataaatacaaggtcattgcctccagcaggtgactggaaagaatacagtgtgatattcttaattgtgatatccaacataaagctgagaattttttagaccttctgaatgtactcaaaaatataaataaatataacaacaggttatccacagtcagctatgatcaatttaatttagccaagcagacaaaagcagcttccttaaataagagctacccagggtctcattagtgtagagagacaaaaaaaaaaaaaaaaaaaaaaaaaacaaggtcacgctcaaggtgtatgacttcatggtggaaaatttcaatcctccaaatacctcccagaaaagaaaccaaaggctagagaaacaactgtcaggcagatttcaaaatctcatttagaccactgaacaaataaaaagatagaaaaacgtgttaattctaaatatactgatatatatttttacaaagtaaggttgacaaagttgaagttgggcatggaatgtctcttattagaatggcataaagaattcactgcacaagtttgaatctggaaaagtgagtacctaaaataataaagtggcaattttctgagaattaaattttaggaaaaaagtaaacaaaggactacaaattgattttatcaatagatacaaatgcattttcgttatttatcttttaatcttgtcttggcatatttagaatgataaaagaaaaagtgtttataatgtactctgttgaaatgcaagcaaagaaaggtgagaaaacatattcattaaactatatttattcaacaatatatgcaaacataaggataagatacgtttttctacattatacatgcttctatttctccctccttcataaatatgatgaggccaaatcagcattattttttagctcagatgagctctgtgataggctaaaaactatcacctatcacagagctcatctgagctaacaaataatgctgatagcattaatggacttctaatttatttaatattgttttacatgcagcttttaagatcaagcaatctgatcctttctaaaagatattatggtagaataaaggtcacatatttaggctggcaaacccatgaggagaataatagtgcatttcccattagaatctaatgctgataaatcaacgtaactgtcaacagctgagtcctaagattaacacagatgtggaaaaggaaggtaaaatacaattatgaaaatggaagcaaacagtatgcttaaggatgtcagatatctgggaattccttttttgagcagaaaatataaatctataagccagttttcctttagaaagttctaatgcctctctgtaagaatattttattttaatttgaagatttatatataattctatatgtcattaacataatcagatccagaagtatcaccagagcacaaattacacaataaaattgaagtgactatcttcaccacagactgctatgtgatttatagtgatgcatttcaattccacttgcatttgtgcccgctttgtgttagaaatcatcaaagatggagaacttagtttttgccaggtatcttcctggacactttcaggaacttgggatgaactttgggaaagctcagcatgtggtacactatgacactttacaagcttcctatgttgaaaaaacctaaaggactttgagctattatttcatatcttgaaagaactatggcatagcaactaggataggaaagcatcatggaaacactggaacaagttaccaagtaactgcttacccagtaccagcaagtagctaatgagaagcacctcagatgcaaagaaccagcaccctatgagacaggctgataccctcggagtgtgaagaatgagacaaaaagaagcacacaagagtgtgctaattagaaacctaaaggagtactgataaccaggacgccaagcaatccagaatcagaagccctctaagatatttgagtaaataagagagtgtttatattatactaataagacagtgtttctgttacctaagaatgagccattgtactggaaatctctttgtccctccaaatctgttcttcagctaccttttgttcaggaaattgacctgtatggattccaacaacaaactccattaccctctgacctcagttggattaggctaatggagaaccctgaaagaagatcagacagaagaaggaaaatgtgaccagtactggggctcccgctttgaagacagtgagctggctgtgtttcctgttgaaggtcactactcctgtcaatgcagtcctgtctacattactttcttttctgggttttagcattggtaacatttctgttactactattcctggggtccctgatctcctctttagtccccaacattccacccacaacttggtaaacagtcttctttttaaaacttccttcaactttgtaacttaagagtgacatctgttctctgttgggaccctgcctgtgtagcatataggtagaaaggggagaatgcacatgggaaaacggaaagaaaactcacatgagagtcaagaaacattggctcaacatctatcactaataaatctatgcactgaagaaagccatttatcttctctaggcatctttttatttttaaagagcaaatttgcgaagggatctgaagtttctttttgcctttaaaaatttatatttctatgactctaaatatagaaaacatgattataagacagttggtatctgtttttttacatccttcttgcatcctgtggcacactactgattgctttatcaatattcatccttattctgctacagaaccccccaaaatttggggtggcaacatgcccagcttaataaaacatatgatttatacattttggaagaatagggcagccaagtgatttagtattggctaatgaggtaaaagtcaaagttactggatggggcctctggaaacatgtaaggctgtctcaggggaatgtgtgctttttctgccctctgtccttcctattctttcctgaaatttgggtgtaatagttagggtggggaggtcttccggagagtgatcgtggcaggctggtgcgacaacatgtggaagtggcatgccagccttgggtggtctttcaacttatttcctgagagagcttacataatgacgtttttggtgtttctccaacataaagtctttttttatttctctaactcaaagtagaacataatcactgttatacacacacacacaaacacacacacaccatttactcctcgaaacactcagatcaggactctgtacttaaatgtcacaataaagtctacttcccatttttagtcatataagcaatccagtgcctcaaagtttaccagcactgtgctgaaaaccaggtaaggctctaattcccaaagtgacagctaacttgtctaatccatgtggtttccttatcctaaaacttaccagtttcacttacagttagatacccaagagaaactcctgcacaattacacttgttaagaagaatgttcacagcggcatggcttttctttctttcttcctttctttcctttccttccttctctctttctctctttcttctttcttttttttttgacagagtcttgctctgtcgcccaggctggagtgcagtggtgcgatctcagctcaatgcaagctctgcctcctgggttcacaccattctcctgcctcagcttcctgagtagctgggactacaggcgccagccaccaagcccgtctaattttttgtatttttagtagagactgggtttcactgtgttagccaggatggtctcgatctcctgatctcgtgatccacccgcctgggcctcccaaagtgctgggattacaggcgtgagccaccacgcccggccagcagcatggtttttaacaacaaaaaaactagagattgtatacagatgccatgggatatcatactgcattgaaaatgagtcaactacagcaataagcaactatatggattaatatgtcaacaaaataatgagtgaaggaagcaaaccttgtaagataaaggaacagcttattaacctttacataaagttaaaacaaaacaaaaaaaaaccaagaaacagaaaccaacagtatattccaaaaaatatattggtttgatttaatatatattttaaatctattttttaaagtaaaggaactgaaatatacagatttcaatgttgaatgctatcttaaccagtttgggttactcgaataaaatacaatggactgatgtcttaaacaacaaacattaatttatcacagttctgaaagtgggaagtccaaaagtgtcagtatggtggaattcttgctcaggtttgtcatcctgactatgtcctcatgtagcatttccttggtgcttgcacacatagaaagattttctcccctactttttataaaggcactaatcccattcatggggtacaggacacactaccccaaaatatggcaccttgaaaactgagaaaacagcaaaagcaggaaggtcactctctgatcttttcccactttctgtgtgagagctagacataacagaattttctgacctatcttccctgaaatatatataaccctcacatataacaagtgccctgcccatgtgtggaagaaaggaataaaaacacagagatgacaacaagaatctgaacaaacaggccttgctaagtttcccccagtttattgccattagatcatgttgccttttgtccaatcatacttctacatgactgtctactcttcatcaaacctaagcataaaaatacaggtatgcggttttccctgtttctgtgggtcttcctttccaaaggctcttgtgccacataaaactttgtttaaataaatttgtaatatttttctcttgttaatatttcttttgttgtagaggtgtcagctacgaatcttgccgtgggtgaggaaaagatactacttttctctcccctatgatgtcattggagcctctaccctcataactcacttaaacctaatcacccctcaagggccaaacctccaaaaaccattgctttgaagattaggacttcaacatatgaattttggaaagacacaaacatttagtccataaaaatgtcaactttctaacactattattaaataattataaccataaatttgtgcatgtagacagacaaatatttggcttagggcccacttttctaaactaatcaaaccatttcagaaaaccttccagaatcagcaatagtttttttattcaccataatacatcagtttaaaaaatatatatatcacttaactctcccaccccttttatatttctgcaactcacaaagtcatatatgagagctaaaaattaaaatgatcaacctcatgaaaatgagagtaaaatgatggttactagagactgagaagggtagtagggagtgggggattaggtgagggtggttaatgggtgcaatgacatatttagatagaacgaataagatcttgtatttgcctgcacaacaaggtgactacagtcaataatcatttattattatttagttattaaaaataactaaaagctttgagtacaattggaatgttcctaacacaaagataaatgcatgaggtgatggatattccaattaccctgatatgattattacatattctattcctatatcaaaacttcacatgtaccccataaatacatgcacctactatgtacccataaaattttaaaaattaaaaaaatacttattgttaccttctagcttattttacattactgaggtgttaatgggataaaacatgaagctcaagaagcagaatagagatggattactgcatgtggcttaagagtaagagacacaaaaatctcctaaatccatctcctttggtctagcattcaaggtgccacacaatcaggctccagcctcttttcctacctttctaacttactctatttcaatcacccttcacaaagcctccactgtagtcaatctcctaactccccaacaacacttagactttcctgcatcagtgtttctcctaaggactatttttgttcactacattctacatgtctggaaaactgtcttctctgtctacatatttcaatcatatccattcttgaatatccagctcgtattttttcttcttctttgaaactattttcttagacttgctatacaaattctcatttgtaaaaagcttatttgttagccaatctgtacagcatcatctgctctcaactcacttgtttactatcatattaggacttctcgcagtgcctacctagaatgggatagaggttcaataaagagtttccaaacatctaaactccaaaatatcttcaactactctcttgaaattttctttaaattgcatatttttatttttctattgtcttcctacctaaacctctttgagagaaagaactatgcttattgtatacttttcctgatcttgctaaattcattgcttaaagtgctccataaaaattgatgtttgcctttaaaagaataaaaacattaaagcagttgggcacggtggctcatgcctgtaatcccagcactttgggaggccgaggagggcggatcacgaggtcaggaaatcgagaccatcctggctaacatggtgaaaccccatctctactaaaaatccaaaaaaaaaaaaaaaaaaaaaaaattagccaggcttggtggcgggcacctgtagtcccagctactcaggaggctgaggcaggagaatggcgtgaacccgggagttggagcttgccttgggcagagatcgcaccactgcattccagcctgggtgatagagctagactccgcctcaaacaaacaaacaaacaaaaaacaaaaacaaaaaaaataaaaacaacaacaactaaaattaaagctgtgcctaagaatcgtgtcaacatattaatttcctctcttttaaaaacacaccatgaaatcaagtcctaataatttctgcagaaaataagaagattaaatttattttttgagtcaggttacatatggttcagaatcacaacacaggagagaaaaaaattcttcataatcaaatttgccaaaatgttccaaaatctggggaaacagtattactttcactaataagatgccatgaaatgcaatataaaatcacaaatattattaaattatttcataaactacatttggagatttttaaaaataactttagcactttcctattatatatatttttgctgtttattactgacaatgttgaaaatgtatctagaatacagagttgcagtcttagtattttagttctccattaatgaataagattagattaaataaacaatgcgatagaaaaataacgtttactgctgttgtctatcctggaaagcacattcatttctctcatactgtgtatatacatgcatatacatatacacatgtagtttatatattacacataggaaattatccatatcatcactaattataatagatgttttcaatcaaggggtcatttcttatcaatctcattaacggtccatagtttgggtgtttgtcatttgaatataattaaaccggagaaaatggcatcgatgttttattacaattacctagaatataatgcctggcacactgtaactgacagcaagggataagtggtggtttgtactttttcttgccaaacttttaaactagtccctattgccgggcataatataaaatcaacagcataagttaactgcagtggtatatgcccacacttaacagcttctgccttcttaccctgtgcatcactcaattaagtacttaacacagtttatatgcacataattataattaactccatctgtgtggcatttcacttaataccaagaaattcatttatttgatcatttgataaactcaaaaatcattcattaaatcctttgacattaattacaaaagtgcataaaataactctaggataattcttgttaacatattagtaatcacatcaagatgtcaaataatactttcaagtagaactgggtaagttagtgattttagctgagaagatggcagaagaaatttcatatgaggatggtagtgatcgaaagagagggcaggagaaataaagatttagaggagaaaataatctaattcccagtaaattagaacaaagaaacaactactttgtaaaggactaagtaatgaagtagtttgagccatttgaggaagagctttgaattaattctatgctacacattttaaaatgaattagagatttagaaaagaatcattggaattcaaggatagaaatgtattgtgattttattcattgattaagagattttaccgacagaagagtgtgatacggaatcaagtcaggagagaagggaggctggcagattaactaagggatttcgtttgtaacctaaatatgaaataatacttgaaaaagacagatgcttgggaatgacaaaagatagaacacataaaaagcatataacaaactagaacttgatgtgaaagcaaaaatgagctgattaatggtgttgttgtaattctgtgggaatgagaagataggtactaggtatatatgttcctgagccaggataaacaagattcttctatgccgcctctcctctcttaaagtagggtttcatctttctctgtagttaattccatttaactgtttgaataggcaaaaattgttgaaatcaagtatgatgaatctcatgcatgtgattcttacgttgcaatatttacatgtatggtgaatacctttttgttctgtccattttagggctcacttatttggaaacctccaaacaaatggattatggagctaatgtgaatggttagtcatggaaatctctctcttttcttcatgggagcaagaacttaaacaaacaggatatgtccctgatatggtttggttctgtgtctccacccaaatctcaccttgaattgtaatagtccccacatgtcatgggagggacctggtggaggtaattgaatcgtggttgtgagttttacctgtgctgttctcatgatcgtgaataagtctcatgagatctgatggttttacaaaggggagtttccctgcacatactttctcttgcctgctggcatgtaagacataactttgctctttcttccccttctgccatgattgtgaggcctcctcagctgtgtggaactgtgagttcgttaaacctctttcctttataaattacccagtctcaggtatgtgtttattagcagcatgagaacgaactaatacagtccctgagaagaattcagaagcactcaagtctgctcttcatatgaaatctgagaatgtgtgtttatgtatttaactgtactaaaaataaaaaaccttacatttcttctccaattgcctgctaaactaaaggaaaaattttaaactatagtgtagacaaaagtaattatgtaatctgaatttgtaataaaatttagcagtttctatgtcacatgaaaggtatactcaacagtcttgcaatgttttatactatatggctataattataataaatatacatattcattatattataatatgaattttaattcataatacatacctataatatgacacacatattcgagtagtcttgccgtgcttcaaatgagataaggttaaattctttttgcataccagcattttctatgagttgactcctacacagcatgttgacattggtcagctgtatttttcttaaaatgttttcttcttaaggtgcttcttacaagctgcttgtttctaagataccaagataccaagggctgaatacatcacaattttctacctttaaatgtcaaaagcaaaacagaaaaaaaaaatacaaaagaactagtggctgttcccagaatgtagtacactggcttatcttgtttattttttatgacaagtggtaccaaatccaggttttagtttttaggttttagttctatttttatagttaacattaagtcttataactgttctgctaataaaaaatctttgcctctttctaaaatatctgaatatttatgttttctccaaaatctgttcaatctctcttcctatactattcctaggtatcctacaaattaacttgcaaagcagtcaggtgttttgttagatgtgaccaaaatctagatttttgacaacataatttttggggaaaagttataattacattgatcaataattagtgttggtaaaatgtaatattcctaagatatagatacatatatcaaatgtttggttgcactaaattgcttttatttgttcttgtgcttgttgactatagttattgataacatttttacattaaaacaaagtataaaatgtttttatgtcatgtagcataagagtattacaagagagtattcaggtccttgctcaacttggctctgaaaacagatcctgctttgctatgattgtatgaagatagttttttcattatgctccattttcaaaattttagagcattatctgaaggagaactttatatcctcagcctgtgaaatctgtagtatggtggaaagagggtgtattgtagagttagatggttcttaagtaaaattcttacttggttttttacttgctgtttttcattgttcaagccacttaatatctatgaacctgtattcacttctattctttatctatggataaaactcatagaaacattaaaagaattaaataagataatgaatgcaaagcacctggcatatgatagatgcaacatttgtaaatactttgaaaaaaacagaactactactcctagtctcactatgaaacaattgatatattgtacaatttgatttttagagatgattttggtcagtttcaaattttcttctaggagttcagttctcctgttaatgttaatgagtttattttatttagaattttgatgatcaatgtcaagtttctcttgggtccttactttcccttcttctttatcattaacttgcttttcaactatcttattgctaacttgaagaaatttagaatcattcatttaaaaaaaattcatgtcactctaattcactgtgtactcataaatttgtaaaaatgaattacattagcaaattttgtatttaagtatttaatagctaatttatatacacatttaatttttaactttgttttactagcaataaaggcaactgcacatttttatattaaacatttagtatgatttgaactgatttaatatctttcatttattattaaattaatgcattgttatcaccctgcagcatttggaaaccaaatttgggcttgaaataatatagcaaaaagatagaaaggctggaatgagtaacagtccactgaaatgacagaaaaagctgaaatagcaaggaaaggataggaaagattaaaaagctaaataaaatattaatgtactatatatattatacacaatataatgtttcatatgtaatcggaaaagtgcataaggaagtcaataaaggcttgagagaaaaaatggaaacaatattctgtacccaactggaaaatacctagtacaaaataatagtaatgttagccaggaacttgacaaattattttgaataaagtattctaagggctttgaatgcattgtcatttagccctcaaaataacctttagaggtttgaattattattatctttataggtgatggaactgatgctcaaagaagttaatgtgcactctgagaatcacagaatttataagaaatgatggcaatgacaatctcaagattttgtctcaatagccacctcttctagttatacattattgtaaaagaaaccagcccaaaagttagtggattaaaataacaatcatttacttttcccaggaatgtgaaatttgggcagggctcagcaagaatggctcttctctgatctgttcagctttatatgggggcttctcaaccggggctagataatccacttccaatatatatcccttactcacatagctgacaagttagtgctggctgtgtattaaaacctcagctggggctaatggctggggagggagagctcatctcttttgagaggggtgaatgtgaggacacgagttgcatgacagataagaaaaaaaaaggtgcaatcaattaattgatttaatttcccagtgggctgtaaacatttctggaattgagaaaatagagggaataaactggaaagctatgaactcatggccagaaagcagaatgtttgagattttggaaggaatattgaattggtaatgaaagtgtctgggcaaagagcttaagagtgagtggctgtggtaggctggcagataggtcatcgaaggaggtgaaagagtcatctatttggatactgaaatccagaagaaaaatagcagaagtagtagtggacacactgacagtgagcctggagatgagaccttcaaacaacataggaaagtaattttcatggggcataggggagaagtggtggggatagactataatatggagtggtagttaacagtacagtaatgatatcaaagatggatttttttttttaagaaaggcaagataatgttccgtaagcagtaatataaataagaattgagctattataagtacaaagactctaggcataaagaaatacaaacacaaaacaaaaatcttccaatatattatttcttataaatccctggataataaaattaatataaaagaataaaactccaacattcatcaaattatctgtcttacaattaggcagatcctaattacagaaagaataggtaacactgacatgactaaaaatgtgacttagccacagcaatttgctgagttgatctcaaaagtggtaagaccatgttatagtcgatgattcttaacttttattttatggttcaggggtacatgtgtaggtttgttatataggtaaactgtgtgtcttaggggtttggtgtacagattattttgtcatccaggtaatcagcataataacagataggtagtttttttttttttattctctcccttctcccaccctccaccctcaagtctgccccagtgtttgctgctcccctctttgtgtccatgtgttcttattgtttagttcccacttataagcgagaatatgtggtattattctttctcttcctacattagttaacttaggataatgccttgggctccatgttgctgcaaagaacatgatattgttcttttttatggatgtgtagtatcccatggtgtttatataccacattttttaaaatttactccatcatcgggcgcttgtagtcccagctactcaggaggctgaggcaggagaatggcgtgaacatgggaggtggagcttgcagtgagctgaggtcgcaccactggactccagcctgggcgacagagcgagactctgcctcaaaaaaaagaaaaattactccactattcatgggcatttaggctgattccatgtctttgctattgtgaatagtgctgcaatgaatatatgtgccatgtgtctttatgatacaatgatttatattcctttgggtatatacccaatattaggattcctgggtcaaattataatcttgttttaagttctttgaggaattgctacactgctttccacaatggttgaactaaactcccagcagcagtgtataagcattctcttttctctgtaactttaccagcatctgttattttttggctttttactagtagccattctgaatcgtgtgaaatggcatctcatttgtggttttgatttgcatttctctaatgattagtaatgttgaatactttttcatatgcacttgttggctgcatgtatgtcttcttttgaaaagtgtctcttcatgtcctttgccctctttttaatggggttgtttttttgcttgtaaatttaatttattcatagattttggatattagactttgatgcatagtttgtaaatattttatcacattctctatgctgtctgtttactctgttgataggttcttttgctgtgcagaaactcttgagcttaattaggtttccgttctcaatttttgcttttgttgcaattgcttttggcatctttatcatgaaatatttgctggttcctatgtccagaatggtatttcctaggttatcttccagggtctttacagttttaggttctatatttaagtcattaatccatcatgagttgatttttgtgtatggtatagggaacggatccagtttcaatcttttgcacatggctaaccaattatccccaaaccatttattgactagggagtcctttctccgttgcttgtttttgtcaactttgtcaaagataagatgattataggtgtgtagcattatttctgggctctctattctgctctattggtctatgtacctttttttgtagcgccaccatactgttttggttactgtaggcttgtaacacagtttgaggtcggataacatgatgcctccagctttgctctttttgcttaggattgccttggctatttaggctcttttttgatttcatatgaattttaaaatagcttttttctaattctatgagaatgtcattggtagtttcatacaaatagcattgaatctgcaaattgttttaggcagcatgaccattttaacgatattgattttttcctatccatgagcgtataatgtttttccatttgtcgctgtcatctctgatttctttgagcagtgtctggcagttcttattgcaatttttcacctccctagtttgctgtattcctaggtattttattctttttgtgactactttgaatggcattgctttcctgatttggctctcagcttgaatgttgttggtgtataggaatgatattaatttttgtacactgattttgtatcctgaaactttgctgaagttgtttatcagatcaaggagctttttggtagagtctatggggttctctaggtatagaatcattttctctgcaaagggatagtttgacttcatctcttcccatttggatgctttttctttccttctctagtctgattgctctagtacttctagtactagattgctctaggactagattgcttctagtactagattgctctaggacttctagtactatgttgaatatgagtggtgagagagggcatccttgttttgtgccagttttcattgggaatactttcagcttttgcccattcagtatgatgttggttataggtttgtcatagatggctcctactattttgaagtatttccttcatggcctagtgtgttgagggcttttcatatgaagagatgttgaattttatcaaaagccttttctgcatatattgagataatcacgtggttcttgtttttagttctatttatgtgatggtgtgttagtctgttctcatgttgctaataaagacatatctgagactgggtaatttataaagaaaaagaggtttaatagactcgcagtttcacatggctagggaggcaaacgaggtgtttgcctcatggtggaaggcagacaaggagcaaagtcacaatttatgtcttacatggaggcaggcaagagagtgtgtgcaggggaactcccctttataaaaccatcatatctcatgagacttacgcagtatcatgagaacagcacatggaaagacccccatgaccgcaattacctcccaccaggtccctcccatgacacatgggaattatgagagctataattcaagatgaaatttgagtggggatatagccaaatcatatcagatggacacgtttgttgatttgagtacgctgaactaccttgcaacccaggaataaagcctactttatcatgatgtatttgctttttgatgtgctgctggattcagtttgctagtattttgttgaaaactttttgtatctctgttcatcaaaaatattagcctgaagtttatgttgttattattattgtgtggagattttgatttaaagtctgtttcatcggaaattataatagcaatgtctgctttttttctgtttgctgtttgcttggcagatttttctacatccttttactttgagtctctgggtatcgctgcacacgagatgggtctcctgaagacagtataccattgggttttgcttctttatccaacttggcactctgtgccttttaatttgggcatttagcctatttacattcaaagttagtattgatatatgcagatacattcctgtcatcatattcttgtttataggcactaaagcacagctgctgatgtatttttctcttccttcttcctcttctgtcattagcctggcaaaatatgcaatttttatgtgttttgttgaaggttcaaatgcctgagaaatgcaccatttcaaactagataattttatttcctgaggagaagcaaaagtgaaaaaaatgcctttcctttctacattgtgccagcaagacttagcacatgcctaatgtatagtaggtgctcaatcaatatctgttgaatgacaattcaaattggcaaaatatcacatggtgtgggaggataggatataaaaatagttggtttatccttaaacttaactaatgtgatttaaggaggagattaatccatgcatggtatattagttaagcaaatggagtggtgtcccagtgtcagagaaatactgaggttaattcctcactcccccaaaggtgtattcagcacaggtgatttaatagctcaaagattgcttttcacttctcctctagggagagtacaataaaatgaattttaagttgcttctgaagaatttatagacttaatatctgagtcttctgatgcaacctattttctctcttttactgggaaagtggtataatatgcatttttataaacttgtacaagatgatgggttcctaattattggtaatacccttggagacacacttgtggtctgtcctttaggacatctgcaccagcactgtttcaatccaaaaggtttacacagctctgaaatggacatccgcaggcagccttctgaagtgaaacaaagactatttgcatgttagacaaagcttattcagtaggaatcaagatggatggtggaactaaagaacactaagatacatactagaacgtagaaattaaagtagatacaagaacgtggaggaggaacagttgacattttttagaataaattaaatgagagttaaaatcatcactatgcaaagctgcagattgagaaggcatttggccaatgtctgaacaatgacaaagagtatgggtgatttgaaaattgctaattttgtcaaattttggcacatagaggattatattggtaatagctaatattttgagtgttgactatatgccagatatgctaagcattttatagagagttttataagtcttacaacaatgcaaggagtatggcatcattgggtcttttaaaacttttaaagaaaaaatagagaataatcaaagtgaagttctattttcataacatatatatctatattataaaagaattatagtcctgatcatccaaaagagccaatagatatttaaagaatattgtagtcatagatcatctttattttttttaaaaaatgtcacttgctatattgtctttatgttaagactaattgaagagggcacaaagtcaaagctaattaacaacatccaatatgtcagtataagaatactgttatttatatttttgtcaaaaagaaaacatctaactaatttaaggtatattttacagtacagttttacaaagcatatcatcaaatgactaatttatatacttatcatcaaatcactaatttatatatttaaaaagtaaatttatttgtgcaggaaaatcaaatagttccccaatgtattgatacgatgactgaagcttgcatgttatcatggtattttattcttctgatatatctcttgcagaacagaattagtaaataaaatgcatatttcactttaaaatttttaaaaagttgattatttttctaacttcctctgaaacatcagtcattccaatattcaattaaatttttggttaagatagcctgtaaaatcaatatgaaatacattttgctgtttggtaactaggttctagacaattagaaaactatatcaataagataatatcatattttttattttagaaaaggctcaggcaactgttagaccttattaatgacaatgactcaatgtaatgaaaacaaatcacagagatctgctagatttacaagaatacacttgccatacataacactttatgagatggggtgtgggtttaatatcaataaagagaagaagaaaagatattaaatgagactttgataagctggaatctactaatcaaaattctcaatgacattttcttctaacgttctttaaagaagaatcaattcccgcaaatataccaaaaaaagatactagagataaactcacaaaaacaccacaaaattagtaattatgacagaactattctcctatagaacatttcagggggaaaatcctacaacaaatgatacatgaacaagtgtccaagagtgtgcttttcacagtggggtctgttctatagacccccgccaataaaattccattatttcagcattttatctggacttcttgaattattgaattattccatgcatgctgaaaaaaataattgaagcttcagttttctctatatttacaaacatttaactgacatacatataaatacatgactataagaatgtatagacagcacttgtgtgcaatctgctgtatggcttctgtgaatgtcactggagaagactccttatggcacagatttattcattcccacagtttttatttcattttggcagaagattactcagagttttagggtttgtccaatcagcttttaactaagcccagcatacaatgccaataatgaattccctacctaaacccaactaactatgtgaatgctccagatgttcttagctcaaacatctgttgcttaaggcaggggggaggttctgcattgtaccatacctgagttacttgctacatttacatacttcatatgggaggctaattcaatccactgaattttaatataggtcactgtacagaggtcaccaatcatgatagaataataaaatagtgataatttaatgataaaccagtaaaatgaagtaattatgaactaagaagaactccaaaagaaaatcactttactcaatctcagtttgctatggcaagtagtatatatattttattaaatgttttctactgaataattacaatattataaatacaatagtcataccatggtcccagtaacactgacaaggcctttgaaggacttggagagataaagtctgggctccaggaccacacccgtactttgggccagatcatctaggcttctattcacatagtcagttatttatttgacatattgttctgcactttttgttggaataaagaattccaaggctaactacatatagcctagctccctcattttacagatgagcaaaaagagaccagagaaaataagtccgatcaaccagattaaataatacagtaaatgaaaacttggattagaatctagttttcctaattatctagtactctatgccctgcacaatactccctcctttatgtcaaaacatccctactataaacccatgtgtatatggcaaatccaaattggtggcaagtcagtatcagattcgtttcaaaagaaatgcatgcagttttattgttcagttagctagcagttgggaattacatcagcaaacatatgcttaaatgtacacaatagggtactaatttaatacatataataattttagaaagaatgaatgaatcgggtatgatcaagccacataagagaatcagttccattgtatcatagccatcaacataaataaatgtaaatttcttgtcaatgtgattataaaacacaaactctgaaaatgtttttagttaatatatttcaatttcttttttacaaaccaaggcttttacattttctcagtaatattttctttatagataatgaaaggcaaatttcattctggttcttgccaaataaccgctaattataaatgtatagtatttgaataaagtgattttattatttccaagaatacctttttctagtctcatccattcacattcatggtatgcacacaacaaatttgtcacattatgctgttagctgaggtcacaactttaaactctgagactactaaggtgaataaacattttcataaagagtgtgacatttgagtcactggagtcagtgaagaagagaaatggcttggaagcttccttggctatgctgacaaaaaatacaagatacaatgccaggtgcaacaattatctattgctgtataacaagttaccctgaaacttagcagtttaaaagaatactttattatttcttacactttctgataatcaggaatcaaggagattagctgggtccttctggcccaggatctcttctgacagagtcagtacagaagtcagataggaatgcttcatctgaagggctggaggatccactttcagcttttcatgtgtgtattggcaggaggcttcagtggctctgcattgggcagctcatacataacagcaggcccctcccagaacaagtgatccaagaaagaacccaagatagaaggtgacctaatctcataagtgacatatcataacttctaacatattttattggtaacacaggccaaccttggcactatgtaagagggaatttattagggttagaatactacaaagtagtaccattgggagatgtctaccacaccaaatgaaaaagcaacatgttaacacatccaattttgatcatctacaagatatgccaagctggagttaaactgatagaagattgaaagtagagtcccatgtgttgatacagaatggctaagatgttaaagagctcttgaggtagggaattaaaaacacatatgacactttgggaggccgaggagggcggatcaccaggtcaggagatcgagaccatactggctaatacggtgaaaccccgtctctactaaaaatataaaaaattagcgggcgtggtgtcaggtgcctgtagtcccagctacttggggggctgaggtaggagaatggcgtgaacctgggaggtggagcttgcagtgagccgaatcgcgctactgcactccagcctgggccacagagcgagactccgtctcaaaaaaaaaaaaacaaaacaaacaaaaaaagaaaaacaaacaacaacaacaaaaacaacaaaacacctgagttaaattgcagctctactatttacagtgagtgatattaactactcagaactccagtttctttatcataaaattggaatcagttatgtatactttggagttagtaaaaattaaatgagatgatgtacacgtcaggtttcttaacatatagtaagcacaattattaaagtaaaggaacaagtagaaaaaggaatatactctttaatttggtctacaatagtgactaatatgtttctactagccctagctatagaaagagtatggatttaaattatgtctcttttcataacaacccctgtgactataattatggacagctataaattgcctaataagataggaatacccttagactcaacaaatctttcttttgtcaaaagaaaatttataaatcttatagaactcaaaaatatattccaagggatgatctgtatgcattctcactcgtgattatatttttaataagcactatttcaatttaataatatgattatcttgtttattttcaagtaccaatagcccattaaaatttcactggaaggtcactaagaaatattttccttatgaattttagtgtaagtttctctctttcagagaagtgataagtaagcttaatataatggctcccaaaatctctctcaaatacaattccatatacatattagagtggctgtagagcacatatgatgaaaacaaatttcacattaaaaaaataatattattggggatatgtaatgggccaaatgataccttaaccttcaaattaaatgtatagagttatttaatattttctagtaagtttttatcttttagcaaaagagaaaaatgaagtgtaatgaatgatgggttaaaacggcaaagactgtaaattaatgttatttttgagaaaaattgtcaaattcaaatctccctttttatttaaacagagttctgtttttatttccatgaagttattccaactgcgctgtatcatgatgtaagtagagtgatacagtgcaaatggttcagagacactgaagattccctccagaattaagaaatgatggccagctaaccaacaggatattatttttataattgtagtagcagcattttaaaatagctagctaatgattttatgtgatataaatgctagttcacagacgaagacaaacttcctggaacagatgatattgaaggagactggcaggaaggtacgaagaaacataaaacactaacatttgataaaatattatatagaatagtacataatatacattatattagtcatattgtatgtaattataaaaatataacaaaaatatattattaaatatcatatataatatataatgataatattatataatgtattatatagtatcatataatgtaatgtactattattatataacatatatagataaaggatcaacctcaatttggagtaaaagttgagaattttttcaaataataaagatagaaacttagatcaaaaagttcaagcatcactaaaggtccaagactgtcagaaaccaaacatttgttttagtttatcttcactgattactatacttgaggaaatcaagtttaccttcaattagtccttatataggaacaaattcaattagaatgtagaactcccagggtaagataataatgcctacaacactgcctggcaaagaacagtcaagaaatatttgttgactgacagaatgaaagagtgaataatttcccccctagaataacattatgtctgcttaatacttatatttaaattatattcatagctgcttcttccttcataaccaagaaactcatgcccctcttgtgactacccactaatactcagaaatatgacacacattttcaaataagtctgatatacttaggtaggccactgtgttcttgctctcccccagggtgaagtgagctgctgttttccttgctaaccctgactagttcacatcaaactccctgtgctgctgcgtgttgctctgttttgtctacctcaagcatttattgctcactgccaactgctgtgttgttctgcccaaaccacttacttgttgtgtactgacttaaacatttgctcacaggcactttagttcctggtgctgtagctattctgtaaaatagcaaaatagcactctcttctgtcttcaaccctggtagaaactatcacaacataggaaactcagcctcatttagcttttcactttaccaagaacagaaccccaaatctttctatggtttacaagacccattgggatttggctggctcctacacatcttctaacattatttttgttcttctctctcactccactccagccacaccagccaatattgcacttgctgtttcttccttctggattattctttttccagatattagcataacttcttccttcatttccttgagttttctgattaaatgtcatctttttggggatggcatataggaactattctatttttgaaagatctgcttgacccaggttacagtattctgtttccttgctttaaattttgtaacatagtttgtgctgcttgacatattttatagctgtttaatttgtttatgttctatttttttctgagaaaaacagacaactatgaggaaaagactttgttttattatcaatatatttgccattagatcaaagcatataagaatagctactcgagacagaaaacatgaaaggaagaaatgaaggagggagggaagcaaagaaggagcgagagaaggaaggaaggaaagaaggaaggaagggagggagggagggagggaagatatataaatagattgatactatttaatacatcctaatctcaagaaaacaagtggaggcaaattgatcctgtggtatgggaaggggtgttataccttgcacatgcaatactctaccaaatctttttcagtccagcctggacaccatatacttaaaactgaacaacaactcttgtgatacgattaatatgcttgaaatatttttattttatcactgacatgtggattaagaaattaaaataattaagaaaaatcttctttaaatgaaatatttggaatagaaagctagaatctcaggttccccgagtctggtaactgtttattatggctatggatgcagtaaagctctagctcttgatttattaattaatggagtgctcaatatatgtttctcaacaataggtaacatgagaattgaagaagacaggagacattaactttaagaaaacccttaatgctcaacaaattctgcaaggttaatgtatgctgttttacaggaatatcacaactaaaatattttaatattattttttcccttgcaacaataaagaattctcatgcaaagtctttatttaacttgtctgttgtttgtctgttgtgtccttttaactttatttatgtattttatctaggcttgatctgtcagacataagctgtttgataatttatcatattattattgaagcaagttgtcaaaccagttaaattcatgtgaaaaggaattcaaattagggcaacaaatcttcaaagtccagctgaactgctaaagtagacaaattccttttcttctgttttccccagatgctttttacattcactgatttttcttcccttttgtaaatggaggagaaaggaagaattctgttaaggcaggagtctgagacaagataccaacatatctagaggcaaagccagcatttctgttctcaaccataagaacatacgaaattatgtttgattaatttcaggaggtggaaactgagggcctgctggctctaaatctggcttgctgaagctttttcctttggaacacattgttttttaaaagcaataattatataaaatgatatataagtatatatattaaataatataaaacgtgcatatgcatatctatttgtacatatagatgcatctataggtatgtgtatatatatgtaaggtagttaccatatataaaatataatggcatttacaataaaaaacatctgaatattcagctgttcttgatgactctaggtatcattaggcatacatttccacatgataatcattagataaaactgagaagtaggcacattccttggacagagtatgctttaccaattcaccaaagtcatgggctgccttttatcttacatttggtctaattcatacatctatattatgagaatggcttctgtaggcatgtcagtttgctatcaatttttaatcagtttgattaggctagagaatatttgggtaacagcttttggttgaattggtagttttcttcaagagctagtttaacttgatagccccaatttgtcatgtacctaactttttctatatccagtacaatttatatattaaatagcatttttagagaattaagttttcttgttatgcttgacacatagttacaggggaattttgccttcgaaagttggtgtaagatttttctttcccatcatgttaaatgaaacatgatagacaatattaaattgttttttgataaccaggagtttttagataaccataatatattcaattgtagtatgctacgaagaggcatatacagggcactggattggactgaacctgcattaattccatagccaagaattattttggctaacataaattttagaataactatcaggtactttctccatttttcttgctatttgaacttttgtacatcaaattttaggaaagtaaatgaaaaaatacattatctaaaggttttgattagttctattttaatgacatggaaggtgagtcacaggtgtttggttggttgtttatttcatacagatttaactctcctctccaacaggttttcctaagtcccctaagtaaatgtaattttacaattaaaagatttatagaaaaaagatgcgttaactcatccattatctctatatagataagcatttttaggaaagtgtaggcttaattttccataagttttttgcaatgagaataatcagcaatgaaataaactagcaaatacaacacatttatgttagggctgacattacttttggtgaattgtgaaatatgcaacttctgactttcttccctcaagttaaaacataatttaatatttttctctaattgtgttccaaatagaaactgacaaatagttaatttaatctagaaggctattttgttacaattttaaagatttttcttattactggtaataaagacaaatagaatcaatatttataaaacaaaacgtctatggtttatgaaagaaaagccacacatttctaagtttttcagtcaaggatttcatcatcctgatctgccataatgagtaatacaaagttatgaacccaaagcagctacacataagaaatgtactacacagagaaatgtgttgcaaagcaaggagcttttgttttctatttgcataatttaaaagattaactgtaaaaataataaaatctcttgttcaattcatcataatttcatcctttctgctacacttttggcaggtttttataatatgaaggtgtactttactgctttcttaatatctaaatgctctgtcaaataatcaagtgagttcagtaagaggctattaaaaacaaagttaattactaatctgtcacagtctttatttaaatgaatttataaatgaatttaaattagttttgaaagcatcatttcagaatataagcagacagccagtgagtatttacatttcaaagaagtatctactagttagaaaataattgcctgaggaatcaaaatatcttagtatttggcaccaaaattcaactatttttaataaaaatattattgtttagaatctttatgtagttaaaatgagcagtatttcaattatgtcgtatattgaagttatagtcacaaaaacccttagtatgctttacatctttggctgagccttgtctgattcttgtacttgtccttatccttgtttttttctgaatctcttatgggatcttatgtttgtcatatgaaatccattctcttaggctaagttcatcttcttatataacaagatattcttaaatatgaatctataacccagcatactagccacttcttttttgctttttgttggctgcatctttggtgacttcaaccaggttattatttttactttattcttttctttttttctttttctttcttttattattattattattatactttaagatttagggtacatgtgcacaatgtgcaggttagctacatgtgccatgctggtgtgctgcacccattaggggaggagccaagatggccgaataggaacagctccagtctacaagctcccagcctgagcaatgcagaagacggataatttctgcatttccatctgaggtaccaggttcatctcactagggagtgccagacagtgggcgcaggacagtgggtgcagcgcaccgtgcgtgagccgaaacagggcgaggcattgcctcacttgggaagtgcaaggggtcagggagttccctttcctagtcaaagaaaggggtgacagatggcacctggaaaatcgggtcactcccacccgaatactgcacttttctgacgggcttagaaaacggcgcaccaggagattatatcccgcacctggctcggagggtcctacgcccaggtagtctcactgattgctagcacagcagtatgagatcaaactgcaaggcggcagtgaggctaggggaggggcacctgccattgcccaggcttgcttaggtcaacaaagcagcccccaggcttgaactgggtggagcccaccacagctcaaggaggcctgcctgcctctgtaggctccacctctgggggcagggcacagacaaacaaaaagacagtagtaacctctgcagacctaaatgtccctgtctgacagctttgaagagagcagtggttctcccagcatgcagctggagatctgagaatgggcagactgcctcctcaagtgggtccctgacccctgacacccgagcagcctaactgggaggcaccccccagtaggggcagactgacacctcacatggccgggtactcctctgagacaaaacttccagaggaaggatcagacagcagcattcacggttcatgaaaatccactgttctgcagacaccgctgctgatacccaggcaaacagggtctggagtggccctctagcaaactccaacagacctgcagctgagggtcctgtctgttagaaggaaaactaacaaacacaaaggacatgcacaccaaaaacccatctgtacatcaccatcatcaaagaacaaaagtagataaaaccacaaagatggggaaaaaacagagcagaaaaactggaaactctaaaaagcagagcatctctcctcctccaaaggaacgcagttcctcaccagcaacagaacaaagctggacagagaatgactttgacgagttgagagaataaggcttcagatgatcaaactactctgagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactatgtgaagaatgcagaagcctcaggagccaatgcgatcaactggaagaaagggtatgagtgacggaagatcaaatgaatgaaatgaagcaagaagggaagtttagacatgaagaataaaaagaaacgaacaaagcctccaagaaatatgggactatgtgaaaagaccaaatctacatctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactctaagacatataattgtcagattcaccaaagttgaaatgaaggaaaaaatgttaagggcagccagagagaaaggtccggttaccctcaaagggaagcccatcagactaacagtggatctctcagcagaaactctacaagtcagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaactggtaccagccgctgcaaaatcattccaaaatgtaaagaccatcgagactaggaagaaactgcatcaactaacgagcaaaataaccagctaacatcataatgacaggatcaaattcacacataacaatattaactttaaatgtaaatggacttaacgctccaattaaaagacagactggcaaattggataaagagtcaagacccatcagtgtgctgtattcaggaaacccatctcacgtgcagagacacacatatgctcaaaataaaaggatggaggaaggtctaccaagcaaatggaaaacaaaaaaaggcaggggttgcaatcctagtctcttttttttctttttgagaccaggtgcggctctgtcacttagggtgaaatgatgcagtggtgtgatcttggctcactgtaaccacagcctccccagctccagttatcctcctacttaagcctcttgagtagctgagactacaggcatgtgccaccacattctctagctattcaaagtttttatagagacaaggtcttactatattgcccagcctggtctcaaactcctgagctcaagtgatcctcctgtcttggcctatcaaagtgctgcgattacaggcatgagccactcacccggcccaggttattattaatatgttgaaaataactccgatctgaagacaggatcctaaagatgtcctcttacatatcttcatctttgttgatctcaatttatcaatctgtactttaggatctggggagagaaaacattcgctcaacctgttattaacttaactcagttctatagtgtgttagtccaaatatttcatatcagaaagcaccttgtagaaacatttgtataagtacatatgctagtcctaaggttcacctcaaaaagggggaggtgtttggtatatgtccttagcaaggtttgcaacaagatttttcccctcataatatcatatgtatatattttatgatatatatatatatatgagacagagaaagaaaggctaatctgttatgacttgtttcattaaactagagctttctctgaccacgcaacacaaaagagaacattttttgattcactgctatatgttttttataaattacaaagatattatggtaaattccaaacttttcctacataagttttataattaccaaattataatgataattatctcatatataatttattttataatttggtacagaatctcactttgtaaattcatacatcattttcatattccatggaaaaacagttctttcatcattttaattgcttattaaagatcctgtgcaatcagtccatcatttttctctaatatatgaccatcttaaggtgcaattcacataagccaggggattgagctcatttggaataccaaagtattgtctcggagttcaatttctctggactttattccagtttattcagtttaaaatatttcaccttgacagaagacattattaaacaagaagaaaagtattccactaacattctgtcatttatgtggatcccaaatggagggtttattcacttcctggtccttgctccaagtattactaaatgccattaatgtttctctcattctaaatgttctttgaaactaacattttgtctagtattctgcaggtggtagcaaaataaaaacaaagttttacattcaaatactattggtttctttagccacgtttatgcattattaactttttctttttctgccattgttctgttaatatttctaggtatacagtacatctgcttgtactctcagctacctgaaattattctatttttgaaatgacaggaatatataccaatacattgatagggaatatcaactctaactcacacacaaatacaactattaataatagcttttgtgtactgacttgagaagtataataaaaattgttggtcaggcatggtggctcacgcctgtaatcccagcactttgagaggccgaggccaatggatcacttgaggtcaggaatttgagaccagcctggccaacatgggaaaatcctgtttttactaaaaatacaaaagttagccagctgtggtggcccgtgcctgtagtcccagttactcgggaggctgaggcatgagaattgcttgagcccacgaggttgcagtgagccaagatcacaccactgcactccagcctgggcgatggagtgacctgtctgaaataaaatcgttttatttagttggcatatataagcacctttatttacctcaaaattctgtgaagtaattatgattatcatccccacattacagataaagtaaccaaggtacaaatatgttaagtcagttgtccaaggtcacatagctagcataagagaaccagtagaggaatctaaataatctagttccaggacttgattatgctaaccacttcacaataccacttctcatattttgtttaactttacttgcatgcttcttatcagattttgatcacttaactctaaccaacaaattcagtttttgttgaagtagattctcatcatttcttctatgctttttactgtcaactaggcatgccaagagctcatcagtcgtctgctttaaggagattagatgtcccatctcttttccagttctaaggtgtgccctaaacctgcctccattttactacttttggaccttctagtatgctgttaataacacttcttcattaatgtttcttttttttttctttataccgctttatttcaaccttcccagcatgctagatttccatgtagtgtgtacccatatgacacctggtcttctccagttaggtcaatttctttcttaaaaaatgtatctcaataataaattctagcccccaaaattttatgatttcctttagaatatgtatcattctgccatacctatgcataagaatattgaaattgtaagaacataagttggttttttttctttttttgagacggagtctcacactctgtcccccaggctggagtgcggtgatctcggctcactgcaagctctgcctccagggttcacgccattctcccgcctcagcctcccgagtacgtgggactgcaggtgcctgccaccacgtccggctaatttttgtatttttagaagagacgaggtttcaccatgttagccaggatggtctcaatctcctgacctcgtgatacgcctgcctcggcctcccaaaatgctgggattacaggcgtgagccaccgcgcccagccgaacataagttttatttgtggttatctttcaaagtgttgcctcaagagaggttttgataagcttcatattatttctgtttatttcagtagctaacttatcaactgattaaagataaactcccatttttaaataaaaacaatgaaactgaagcaaagtttgattttacccaatcatctggaccttaatatatcagtatatgatttctatattcatacattgatggaaaatagaaggtagtacaagtaaggagactgtggtcttagttccagttctgtcaccagctttctgattgagttttatagataatttgaatgtctctttcctaattcataatttattcacaatcttggtgattatatataaagtacttttaaaaagtgtttttgacactatgattaatgagttatttattaatcaatacagacaatttgcttcacatggttgtgaacagataccacaaaactgctagacaaataaataagcaaaataaataataatgaattgcaggtactaaatattagatatgtgggagcagttcctgtataggaattattgtaatagtagttggtagaattacatccataaacttatattgtttacttcctggacaagaaataaaagatcttaataagaatgtagctcaggaaaataaatagtgttaggatctcaaacaacacatggttatgataaaggttataagttttatctcctttgcaagaaatagggcaggcttcagtaccacctagtgacaatggtgaatggtctcaatggcaaaaaacagcctggaggagaaaagacaatctgcttttattgtattagctatttggcttctatctcctacttctattccttttttcattcttctgtaagataatgtgtttatcctacttttggtttcttcaaattttgcaataatttaattcctgtacaacactaaatcaccatggaaattaccctgttcatacaatgaatttgaatacaaattaaatgatcgagaaatacattcaaaaactttagagcatgacagtctcataaatatttgtatataaactgtctctacatctctcatttatagggtttctattttaacatgatcctttgtataaaaatctgtatttatttacatttctttttaatatttttcaaaagagctacttattaaaaagttctgatctcttggtataatcagaacagaaaaatatagagaaataataacactgatgaatgtaagggaaaggtgcccctcaggagaatgatttccattaaatgttacagattactacattttggtttgatttgcctaatatttactgatttcaggcacatggtaaatttcttttctcttctttttccttaagaattgataactcagtcgaggacagaattacaaaagttgtagactaaatgtaatcataaataaatggcacattaatgcttacttttagcttgggagcaatggggagataataatgcccaccatggaaatgatacctttttctattatattataatttcattgaactcagtaaaaatcttttttttaaaaaagtgaataaatagctgaccttaggaaaaacacaacatcaattaaaaaaatctgaaaagtcacctaaaggccaaaaacatagtttctggaaaattaagaaggtcaaattcaattatatccacatttggtatgtagttaaaattcaacatatttccactagaagcccttccccatgttgtaggaatcaggattttagattatcacattgatcacagtagcaaagggtagcacacagtgatctctaaatacacatcatttgctttgatggacattataagtagatattataaataatattcattctatatttagaatataattagagaccattttaattgactttatgatatgctcaagaaaacgctactggagtatagagaatggattgtgattcactgctatatgttttttgtaaaatacaaagatatggtaaattccaaactttccctacacaatttttatcattaccaagcttatgcatgagaataaatgataacagtccacagctaggtgtgcctatttctctatgcatgaaatatgagatactggatgtagaacagagacaggtattgattaactcttatttggattggagctgtgtttctgaggcacctagctggtaaatactagaagggtatttagttttttttttttgtttttttttttaggttccagggtacatatgcaggtttgctatacaggaaaattgcaagtcacaggggtttgatatagagattttttttttgtcacgcaggtagtaagtatagtacccagaataaattacatctctaaaaacagcaaacacttctaaaaaatgatggggtatataagatagtaagatagaacccaataggtagttttcctatcctctccctctcccaccctccaccctcaagtaggcctcactgtctgttgttccctaaaagagtatttaaatgttaatcataatggccctatgtctagaccctcaaagtttaaagaaaatgggccaattagtctattctatattttaagatctcatttaataaattgcttacagtggttgatacattataagaatatatgtataaaatagctgaaataagttaaaggtttaaaagccaaattcatcataaaatttactcattactccagaataaattacatctctaaaaacaacaaacacttcaaaaaaaatgatgggttatacaatggggttacgaaatgttcgttttaggtttcaaaaagtgtccctcctattctttcttatatcccgcatttatcacatggctttcttcatgtcacttctgattctgtcatatatctctagagtagcataattagactggggtataaagcaggagggataaaaatgagatggaatagaaaaagcaaagtgtggagagcctttcattatgggaagcaactatataatcttgtctggaaaattatctgaaaataggcaacttagcttacataatttaagtctatataagtctcttttaaacagagaatgataaccttgaactctttagaaagagaaagttcatatgaattgcctgacatccgtatatccgtaaattgaataatacagtagaaactattagtctgctattccactgattcccagattgaagacaatgttactattttattccaatctgcatcaattcaaaacaacatttttatgtgaaacgtaaatatatgaggagttcagaaaaaataagatattataattgcctttctttgccagattcttttgaatttacgacagtagtaaaaggaaagaccctaaaacccaacacacacatacaaaacacaatgacttttcacgtatttttcatatacattctgagctcttccagcagtgcagccaattcatggttgttttctataaacataaattggcaatggtttataaaagatgaagttgtctggggctcatgaagtagaatggtatggtgggttcatccttaatccaaggggaaatatggattttataaccagctaccatactgtctctggctttatgcaaatggaataacaattctgtttcagactctttatctttaaaatggtaaatgtatttttactcatttccttcaaaataggtgagataatgtgttatacatacatgaatactatatttgtgaatgtctcaacaacatttagaatagcaaggatataacggagaactaagtctagcaaattaatcattttggaggaaatattagacagcaaaatacttttttttcttcaactttatcaggtgccacttgttagataaggtaatttcatgaatagtgcttcttctgctatttgttgcttaaaatttaagagccagtctatgtaagcgggaacaaaaacatgtttggaacttaacggcttggtcttacattgctaaagcaactcaaggtcaccatagccaatatacaatctcatcaatatcctgtatccctctcgatgatgaaattatagttcgatttaaaattttctgaaatacacattttatctgaaaacaaaatatcagattagagttgatttccttatttttttcctgtaagagaatccacatctgagaaggaagaacacagtatgtgaaccctttcccttttgtgatgaggtcatgtttctatccaatagagagcagttgccaggcagactttgctaattgggagagacaggacagcaaaggagaatcgcaacactcagcaggctgctgacctactttattattataactcataggagctacgaaggcatttttttttccagtagagctacagtgacttgtcagcaaattagttaccctttgttaggtcttaaaaaaaaataaaaaaaaataaaaaaaaataaaatctttctgttatggcagtacgttctattttaaaaaattaatattatcagaataatacaatttctaagccatagaaattcaaatctaaaatagattactgaatctcaagagaggggaaatatatttttaattaagagattttttagctcatttcttcgtaatattactttggctatattatgtcaatcagtcattacctaagtagttaaatgggctctgtaaacaaaaagtgaatctattttaattttgcccttaaatatttgatagaatggcaatagataaaataattgtccgggtttctatattctaattgtatatgtgagcttacatatgaataattctcattgctttttttccaaattatttacttaaaatatcaataaatagctctctcttctctgcccacccagcacacatttattgggatgattatagtttttgagctagaagtgcctgaagtatcttgattccccactctattgaaggttcctgatctaaagccagctaatactacttgaaatgaatgtctctctattttgtgtctccctggccctcggtttttcatagattttatttcaatccacacagggctactactagaacaccactggatgagttagaaaacagactgtactccctgggtatctaaattaagaagagaaaataggcttgcatggcttcattttcaagggaacacagtttggaaaacagaaaaaaggggagtaattcaccagcacttgaaccatgctctttgggcagtgcaaacatttcagagctctcaattcaaattcctattaatagatatgtcatataatttaccatttcactggattataaatgtattcattgttgagcttacattttgtcaagttttatatagtttttagtacccagaaaagatagtttgaataaaagcatgttagaatgtaagcctaatgagggcagggactttgtctcatcctctaccatgtgtttagtgcctagaataatgtctggaacaaagaaatactcaatagatcatttaaatgaaaaaatacataatatacacttaattcatagctaagaagctacgtacaagaaagtcaagtgacttgcataaaatcagcagatttaggggttgaggtaattccgatatgtatgtctttaaatttaattctgcaaatttcgccccctatgtttctgtacaaacgagttaggataggctatgttatgtgtgagcttcaaattaagacatgcttctggaactcaaaaaaaaaaaaaaaaaaaaaagggttgagggcattatagcagcttttcaatgcttatacctataagtgaaatatactgctattcataggccattaattattaattaatagcacagacaggtacccatctaactgaaaggcagctagaaaatatggaaagcacgtggctatttggttgttagtaagtgtccctgtcacattgtttcaaataaaagtaaaatagagtaacctagattttccagtggaatcccttattctctccatatagattttactaattagaccattacagacattttttatatcagtttttttctctgatattgctagattggtttacgcatcttaactttttggaaattaatatatctatagatatgtagagaattagaggcttattaattttgacttcagcaatttagagtatgtccacgagttctaaattcagtaatttagagtatggtcaagtgattgattacttatctttgaaaaaaataacttgagatgcacaaatcattaaaacaaaaactgtataaggaagaccacttaaatagataactgaataattagtttgcacatattttaaaaaatgctgataattaccattttgattataaacaatattttagttagcaacacatgcagagttggtataggagttgtctaggatgcagatacatgaaagaccaattgtctgcactgtagaatagcacttatcaaaattaaataatgcacagattccttcaaatcacaacaaatgaatcattacaatgaaatacccttgacttgggttaaattattttgattataatgttactcaaataaatacaagtataaaactaaaacaaacataattttacaaatcaaatacaaaataatgaatcaacaaatacatcttaatgtaaatttactgtgatgagtaatgctgttttgctaaaaccaagtaggtgcataaaatgtaaatgtagtgctgtaatgccaggttttgtagattgtgtgattttatacagtattctacaactgagtgctatggaatgactaattgacttatccaagtttttcttcattttgactacggtgaaacgtgtacaggatttaatatgttattaatctttcaattggtataaatgcatcatttatttgttatgctcaaaaaccagaattatttgatgtaactcctcatgacacaacctgctccaactacaaaagcatattcagattccatatgtatgacattcagataatcctaaattcataacatgctatgttaaaaccttcaaaatgattactaacatgtaatcatatatttataagattgctagtagaaaacatggactccctgacagtaaacctatagacttttaaagaaagattgctctaggaatgtactgtttagctgaaaatccttctttatctgttctataaagtcattccctaggttacatccgatatttgagattcagttcaaaattaatacgcaagttaacgtgcatcatttattttcttatattcttaaaatgaatatttcatacttgtaattttaacaaaaacccattactcccaatcttgtttataatgatttaatataattttagtgttgtacacctaaacacatagccacaaaatgtcatgggaataaaactaatcttattagaaagtaattatctgctatatccaagattttcattcagatagaattatataattcagacttatttcttgaatgaaacaaaaacaaataatataaatacaaagcaaagttacttcctgttcacgttgtgttttgcaagtcagtatctccttcctagtcaatttaagtagcctgcacttttagtccgctttccgttgttacaacaaaataccacagactgggtaatttataatgaacagaaatttatttagctcacagtcctggaggctgggatatccaagatcttttaaagtttcatgtggtgagggcctttcggctgtcccctaccacggcataaggatagaagggtgaaagggccagcaatcacatgtgaaagagagctggagatagccaaacttatatttataactaacccccttctccaataacaatattaacctgttcatgaggtcagtctgctctttatgtaatcacctcttactagactttgcatcccaacacttctgcagtggggattaggttttcaacacatgaagttagggggatacatttaaaccatagcacctgcgacggttagtgattgactttttaaaaataatatttaaataaaaactttaatgaggaatttagaaagactgcaaaggaattcactgagagagattgaacctacatttatggaatgaaatagttaatataagaatagatatattaaacaaattatcaacactacagttacagatacagtataattatagcattgactttgagtttctcctcatctagctagtgggatacagataaaagtatgggtataagtgcagatacagttaagaaggatataaatatatagtaattaatatttaagaataaaaataatttaatgatggaaggatacaatgaagaagaataaacataaagaatttgttagacccactaatctttattataaataatttagaatcagagcctaaggtcatagcatgtttgtcaagcccaaacccaagaaagacgagtgcattcctgcatatatcctggcctggctccttaattttttgatttctcaacttgattttggttttctacatctcacaaaagatcaatcttgccactttttagtgtcagagctcaaacgttaattttaatgggattttctactgcagttggagtgctttaactaacaggttttgtctctttattactaccttccttaactgttctttataatctatgctgcacaaaaccgtccaacatggtttagagcagaaattacagagtcagatatataagcattctactcttggttctataatctagctgtgtgacattgactattcatttaacttctaaaaactttagtttttctagccaaaaagtggggcaaaataatgtttacctcattcagttgctgtgaggaccaaataagatagcatccttcaaagcacagagttttgtatatagtaagtgtattaaataaatgcagggtgcttttgttctcatattggatttgcacttctccattataactccttgtgcataaatatactttgctttttattattgcaataaatgatttaccaaaactccataactttagaatggaaaaatagtatcttcaaggtcaaatgataccatcaagattctctcttgattcaaaaatggtcttttttatggttatttccttcacatcactattatccacaatataaattaggccaggcatgatggctcatgcctgtaatcccaacacactgggaggccaaggtgggaggatcacatgactccaggagtttaagaccagccttggcgacatagcaagacccccatctcaaaaaataaaaacaataaaataaaataaaataaaataagttatggcttttatatttgaacatacatgacggtttccttctctctacattcgagttacacatggaaaaatgttaaataaacacaagagaaaataaaaaccaacttcatatgtaaatctgcagccaaaaaaaaaaaaaagccaagaagtgaattgcaaattctggaaagatattttgtataatgtcaggatattaaaaaaggttgaaggttgggctatgttggaataaacatactacacacacacacaccacaaacacacacatgaacacacacatttgagcacatatagacatgtttaaagaaaaacaagaatttttttcaataaatgtgtttatcatcagatatattaagtagtatattgccttataattatactaccatatgtactttatagacatcccaaaatagttattttactatatctatgatgacaattggtatttttctgaaagatacataggaaaaatgtaaaataataattttttaccaaattaaatattggttggtgccaatgaatcatcttttggcagtagtgctaatgtttttatactatcctctcagtcagtagccagattatagagctgttgccttttcttctcctgaaaaatacaattattactatttttaccatatactttcctccttcaaaaagataagtaaagtgacagatctataatcaagtagacatcacaggtttgaaaaatgagccaaccaaactactgcttactttgttctttagttatcgaaactaccatatagaatatttctcaaaaaaactgtcaatgataagtgactaagtcacaacaaattaatgtgtcaggtactattctaggcactttctatggtctgaatgtgactcccaaaattcatgtgttagaagcttaatccatattacaacaatgttgggaggtggggtctaataaaggtgtttaggtcatgattgctttgctctcataaatagattaaagaaggctttcagaagtatgttcctgccgcctttccaccttctgccatgtgagggatagatttgtcttctctggaggacatagcagcatggtgccaccttagatacagaaattgaacgtgctggcaccttcatcttgtactctccaggctccagagcagtgagaaatacatttctgttttttataaattacccagtccatagtattctattatagcagcacaaaatacaccaagacaccactggaaatacaggacagaagagaacagacattacattctggtgtggggaacacagaaaaatataaataacaaataaaagtgtatatacatacacataaggtggtcaggagagctctttgtgatttagtgatatataagcaaatattaatgaaatgaagcgagatctaggtaaatataataaatatcaggtcaaatatcaatgaaagcatagaaaagacaaaaagaaaaaggaaggaaggaaggaggacaatagggaagaagatagaaaaggaagaaaagaagacaatacatcttaactgtcaatgtaaatcgccttttttttttcaaatagaaaacctatgctacaatcattaggagaaaaaatcataatctttggtgtccatgtaatttctacaaaaataagccaacaaatcaatagtagaacagtttgagaaaagacagtatttgatttatacctaagggaaaaatgtaaaaatctcataaaattaaagtaccataaaatgtcacacatcaaagagggctattcacagttaaacaatgttttattaagtaaaaatgtaattaaaatgtaatgcaggaagaaaatatgggaacttatacaaaaagaacaaacatttgtgaacacatatgtgtgtatatataaaatatatatagagagatttatagatatatcaaccaaaatattccctgttcttttaattcttttgtgagtgttgagtgttgcattatatagatcaaaacatatcttcttaaaattaaataggaatatacatagctatttaaatcaaatttatactttatagttttttaaatatttacataactttcagaggtaaatttaaagcctaccttttccccgaagttttccttattttccttagcaaaaagtagtatctgaaacttcatttggcttcatacatatttaatctatatctatgctgatgtatctgcctttgcatgttttacaatccctaaaagtgtatgtcttgaacctagtgaaagctaaaaaatgttgatgaaataaggcgttattctaagccacaggcatttttgaaagaatgctgtactgtggtaatattttatgattgtatctttgaaataagatatgcctcagtatacacagaataaaatatataaaagtagatgttgtaacatatacatactcaggaacatagtcaattagtaaaatttagttgtaaccaccctccacaaacataacatctgattttatattcatagaagcaaaatcaagttgtctgtaaacatttatagagaagaaatcagatcattgtaacataattacttaaaaggttttggcacaacgttgaaaagtcagagtgtaaaataacagaatttacttacaaccatttcatttaaagacacccagcaatctggtgggaagtcctgcagtagtggtactaagaactgaagacaaccatcccagtggcacaggagcagcatcatgccgatgagattaaaaattctcaccactgcactggcgagatcatatgtcatgtggaatatctgttgaccaaaatataaaatcaattcttataatcaattttttagaaaaatcaagcatactactgatagtaggcattgatgttgtgtagcgtaagcattgatttaataaaaatatgggaataacttgcagaaatagaaacagattacatttctttatttttacaataaggttgacactccactttatgaatattaaagccaactatgtctcatgagcaacagagatagcatgaatatataaatgtatgtattaaagaacatcgatgttgccagaagtttttatttattgttcttttgcatattttagcaaagctactttaaaacaaggtagcaaaatttacaaatgatgggtagcttctactctgcttctcatctcttgttatattaatagatttgttgaaagacaaagaaaatacccaaggactgaaaaccatatgccaaaggagttcagctgcaaaatatgaagtaatattgataataaattacagttaaatttatagctatgtgagtggagatatttaattgtggatactgaacataaatagaagcctttgagataaaggctacctggatttggtttaaaaacaattgtgcaacacttttaaaaatcataactatttccataaactttttgtatttttatggtacaggctttacttttcagttactccttattgtttgtattttgatgaaattcagtatggtaggttagattatttcagaaaacacaaacattatgacaaatcaacataatccatcaaaattttataaatggaaacaaatacccatctttacatctgtaactactcatttttctagaatttacaagaaatagattcagaatgtgagtcctttctttagcagtttattgtactctctaactggctgctaatatagtttctacttatattttacctagtctagaatagcaaaacccacttgggagcagacctacattgtagaactaagttttgttataattgttaaggaattactgcattaataaatacaattaaatttgagtaagtacttataaacacaataacttcagatatttagaatcactttttgtataattcaccaaaagaatggtgtgtttttgaagtaacaaggtaaacttgtattgaaaaattatccaaaaaatgtaaagaaaaccaaaaaaaatacatttggttttagaaatgatatctttgtaggaaaatatctataattcttaaaatacacacactgaagtactcagaggtaaaatgacagggcatctgtgattttgcttttataaaataaccaaaatctgtctttaattaaatgtttttcagtttgatatatttctatgagcattaattctttctttaaacaatctttttgacatagtaattatagtgagcaaaaagatttttttcgtgggaatatacacactgttctgaattctttttaaaagaaagttggcagttctaattttaagggcaacagaccacatattttgatattcagacagctatacacacaacttattatatagcattaagaattttacttttctgtaagctactttttattttggttttaaatttggaaaacctacagaaacatccttttgatattattccctctgatatttcttggtcactgaatacataaatagaaactctactaacaatttcatcaataatttctcattaaaagttatataatacaacataataaaaaagctttctactgataaagtcggaaaaagtcatcatgaacttagtttttttgttgttgtttagtaacagaatttacatttatatcttaatatttcctgagaaaatcatttaagatgtcttgtggataaagactgcgttttgttgggaaatagtgttaaattgcagaatataaacttctggaaaaaccaggaagcttatcacatttcagcccaattatttgaggcaactaataactatctgaaaatattacaaaatctacaaattataagtatacaggcagtggccatcattcaattatcaggctttagagtggagtatggaatggtctagagaactagcatcgattcttggtagatctgactgggtttttcttgcattttctacttccttttgggaaattagattcttttcatgggctctcaagagataaagataaaataatatgctaagttattcaattcctttaagaaaaccctattatctctaaaatgttctctagagagacaggaccactaatttcatagaggaagttaatggggatataacatcaatgataacactttagaaacactttttgttttgctactatgcattttcatgaactattataagattatgcctagattcaagcctatctgctaccaaatagtcattcccaattccataatgttaggtagtgctagtgctggcttcatacagtaactctactatctttagagtactcagtaagaactcacataattaattttataaacagtctcccttatggacattaatattatgtgttcaaaattgacatcacttttggagctatcccaaaatttaactttggagaaggtacaagcaagttgggtatttttacactggttaatagcagaggcaaatttcaactagtcaaacccatatatcttcatctttatttatctaactgataaaagagcatatgtaaagtatataatattacttgtgatgaatacgtgaatgtgtgcattatctcggcccgatctgattgtcttttgaacccttataactaagatactctggcaggcataatcattacatacgatctgaatactgagattaatagccctgttaaaactttactcaagaaagatttggaatgagaaggctacttccttacggagctcacacatctgtagatagtcaggttaaccaaagaaggaagcatctgatctaatttatgcacagccacaacttattattaataagggcagcttgtaggataaatctaagtgtgactttattcaccttactaatcaagtggctaacactattgatcaatatttttagtttttcttcatctataaggtggacattcttaagtaataaatttccatataaatcaattgtcttggtgctattgcatgaaaacttgacttcatgtaaaatggcaccatgaatgaccctcagtaaattgttactaaatgaatgaatgagagagttgaaggggtttaataataataacataaataaccttttatggtgtaccactttgcttctgtatcttaaacaagggaattaaaacaaacaaaaaaatcaaaaacttcactattattttccatcttctaagtaacctgacttgaaacctaacctcaggttagggtaacagggtaagagggctcagggttggggtaacagaaagaaaggctctcttccccgactagcaatacacttttaagttactttcaagtggtatttacaggagtcaactgaaaaaaatgtaattaaagtaagtttttcagccaggtgcgggggctcacacctgtaatcctagcactgtgggaggccgaggtgggtggatcacaaggtcaggagttcgagaccagcctggccaatgtggtgaacccttgtctctactaaaaatgcaaaaattacccgggcgtggcggtgggcacctgtagtcccagctactcaggaggctgaggcaggagaatcacttgaacctgggaggtggaggttgcagtgagtcgagatcatgccactgcacttcagcctgagtgacaaagtgagactttgatgtgaaaaaaaaaagtttttaaacaactctttaatcttattttcaccatatctagactacaaacaatgtctttaggagacacggtgctttacatttgtccagctcaggacattgtgctgttcatgtgaccttaataagaagaaagatctggtcacaaattctcattgaactttttttatattataggtttagaattttatttagttggagtccaataactccagacaggataaataattaactttctaaaactgaaaaatgctctaggatattttaagtcagaatcccaaattctaccttaatatttgcgaatcgttcatcataaatgtgattttttgtgatattttcccaggagcaatgtttatttcatcttgtttttaaaaggtctttctaaactgcactatacaacagatatccataaattggcttaattcttttaaaatgcttccatattctttcctgatgaactggattcatcggtctttcaatctaatagcttgtatataaaacgaatgaccttaatctatgcttaattatttgttctattttgtcttccttaaccaaaaaactatcaaaaataattgaagactctttatattgtgcattaaactgcttttagtcgttgactttacatactgggataatttctgagctagtttgtgtgatctcaatattgattcaagacttcttaatacaccttcgtaagtatcaaaataagattaagaaaatgggccaaaaatgcctgtcttgacagagaacattctattttaaaaggtgtaaaacaaggttagattcttctgtttctctttatatttcggcacctgcacgatttgttatattttttagatggagtgtatacataccatcctgacacaaaattaaaaaaacagctactcagattcagttgtactgttaacatatattcagggctcaatatgtaatagtcctaatcaatggtaaaataaatattttaaaagccctattatacctctgtgattcttgccctgaaagtcattcaggtcatctttccatgctttaggtacaaagtgtagaaggttttacttcatatgagagaataacactcttcatagtaatctcttttaacactgaccaatgactgcagtcattggatgaatcttatcagtcccctttttaactaggattttatttggactgagaataccttaacattcagaaggtcaaccatctgaacatttcaaaactatcatcttctgtccatagtccaaaagcaataatccactcttcagcctcctccaagtattgtcccatactcatgctcttgagtgctttttacctggattcttctttccactattccttccaaaattcctcctacataatcaattaattatcaaataccctcagccacctcacgaaatgctttctctacttctctgcttttcctgagacttaagactctccccaccaccttcccctccccaaagacgcaacttctctggtagctttctcaaagtttgttcacttctttcaaaccccaatgtcttaggttctgatgtgagtgcccttatttcctcactgccctctgacaacgtcacacgttatttgtccagctatataaaaaattattttcttaatgttcattctatttgcctacactacccataattttgctcatttctggcatcaaacaacctcccaatgtccacgtgccacacatctccatttattaagggctctgtccttttccactgcattttctctgaaaaaaaaatgtcaacttctgattaatcaaaacagccaccttgtatacctaaactttggaagattactggagagcaaactgtgtagcttgtactacttaattttttttaaaggatagcaaccttagttgaggccctcagcaatggtctatccatttccctattcctaacaacaacccattctctctttctacttccccaaagcccatgactatcttcttcagtttcagcttaaagttttatattttcaaaaggaatactcttatagttgaattccctcaactttgggggctagattaacccccaaagatttaaaaacaataaaatctctcaattcctaaaaaacattttaattgaaaaagaatcttcacttcctaggtattttcctaattctttttttccctctttttagtcttctctgtttagcttctcaaacacaactcatcggaactttgagacacagagagagctggcctgccttacagggtaaaacaaatttcttctcatggctatatgtacacatttccaggaggcacaaagcaaaatttgatttccagaaggacagatgtttcatagctactctgggcctctgattctcaaaccaacccatatatgaggaaaatgtgaagatacttcaggctgactttatttcccaaatggtgtatcaaaacttaagaagtctttcttctgagaaatctttttgaagtggcacagatatgatgatacctttgaaacattagagaaatatatgtctcattacatgactgcagtgaagaaaatagtacttttcataacaacgatatgctcatataagtagttatagaacagaatgtattctttatcaatcatgagttgtaaaataaagtataggtgtatatgttattttaatccaggtgttcctttaataaacatatacatgtttgcataaaataaaaagaaagcaattttagacatttcagttattttttagaaacctgttatgtttcttaactaccttttcaactatattttaccttggctattactcagaatttctatatatgtttcattttatttgctgctatgtgatataccatccatttctatgcatacatattttttgcatagaattttaatttcatctatctaaaacatttatgaaaagtgtgttttttatggaaacttgttatttagctttaacagtctgagaataatcagagataatgtattactaagagaaatatcaacaaatgggaaacttaagatatgaatcctttgaacatttttggtaggaaacaatgacaggaaataggtataatgtaaactgtaaaagtacaaactttgaaatctgtcaagcacaatgcctggtggcacagagctcgtgctcaacaaatgtttttcctcctatagaagttattcaactaacaaatcaatttgtataaaggggtcagtactaataaatatctaactgagctgaactgtttctattaattttattcatttttcttcaaatttcaagtcaataccagctgacaacttggaataggtcaaaaaacaaaaatgttttgataggtgacattttggtatagttatattttaatattatagagtcatatttaaaatatcacctattttaatatgataggttattttttaactgaatctacccaaatctttataattcttaagttccttaggaaaagaaatacatcttttcaactttcatgatgaccatgtgacaggtcagaacatttattaattgtaccatgcccaggaaaaacgaaagagcaagcataacctcatatgcttaatttattttaaaaagcagcttaagtgatgggaaaatctaattatgaatgaatattggaaatgaccctactaagaagaaatttcaatggattaatactctaaaaaacagactaaaattaaacaatttaagatcattgtctattcctctattaaaaatttcaaatggctgcaaatgtagacgatatttacaaattgtgcaaccactgacatatttaaatgaggcgaaaaccacatatcttatgatggatctttgaacctcattttaatgatgtttgtctgaagattatttgatgtttactatacacacttaatttccagatgtaagtcagcactaatatattgatttgattaaatatcactattattttctgaagtttttttctaaaatttatcctgagaattcaaaataaaataccaatttttaaattaaaaaggcagtgttcttttcattgtgtagttcttacacattaaaaagaataattaaaaatcctaattataaaggagtgtgtgtgtgtgtgtgtgtgtgtttgtgtgaatgtagagaaagatggtgaaaaagaaaactaatagacaaattagcaatattctattaactctgctttggtttttccactaaaagaagtgagagtgagccttacattggggcaaactgcacaatgtctttaacatcccagcctcctgtcaccattttaagtctaaaaaggcatatgccaactcgcttattgcaccatttgataggtgaactctataggggagataacagaaagaaaaacaggcttctgaaaaaactgttaagatgaaagcaaagcttattcataattttttatgcattggtcatcacagttacatcatgcattggcacagcatcttgttattctggccaggtaagccagtcaagtgcggaatattaatttatttgagtgggtttgtgtcagagatgctctggaagaaacagaggtgttggtttgctgtcttggcatataccttccaaaagaaatcactaagtacatgattttggtattaaaccaataatattgcactacaattctttgtgaacaaaccatgcattcttccatttgattgaacttattaaaatataaaaacatattagtgcaacccccctaaaaaagaacataaaccttaaaaaataaggaagcattggcaaatttgctagcaccccaagaaacaattgagtaagacttgatctactggaaaatggcatgatttcagattcactagttggacaccttccagaaggaaggcatcataatgctccaccaattcaggtaataatagtacatatagatacatgatagatcaccttaagtgccaaaaatacttaactatctgaattgtcgaaagtttattgaagtaactaatctatgtggaagcatccttaaaagtaataagccttatttgtataagtttgatttttcatatcactgaaaccacctattaagtatttgctatgtgcagaaagtaatattaggcactgggttcaccacggcttatgacaacatcttccacatcctcactaaatcacatgaacccttaacttttctagagacctctcacttgctttaatcagcactcatttttctctagacctactggagagctatcataattgttgttttctttaacattatcatgtaatttcctcactctgtctcagtttatagttttatttaagtgggagattggttagaagagtaggtacatgtttgacaatatctttctgtcttacctgtttaataacaccttgtctggatatagaattctagattgaaaataattttctcccagatacttaaagacttgactccattccttcaagcatttatcaaaactatatctttccccaaacataggtttaatttctttagtgaaaagataaagaactttacattaagataaataaaaatggcccaaaatctatgcgtgtgttcaaggggtgggaggcaagaaatggatgatgattcatggaggtataggactgactttaaattaaaattccttccaatatcctgacctattgctcaactacattctccattataacttctgactccaactccaaatgtctcaaagattccactgtacagattggcccccatttcttttgcagactcagttgtagcatatctccgaatgtgattttatctccttgtgtcagtctgtattcttcctccccttgtctttcaactcttaaaaagtttagtgtctgttctgtcttaacgagttccttgcatttgtttccttttgttttatagatgtattcctttactcactttgattctttaattgttttggactcaggagcaacagaaagcccacatgtgttatcttatccctcctgctgaaccatgaacgtttatcttacaatgtgtattttcttcaatcatttgaattggacttatataacattgaaagtatttatataactcaaatccattaactgcatgtttgagcttcatacacttgtattccaagataaatttgaaatcactttgacagtccctctccaattcataaaattatgttggactgctgttactgagttaattaataaattgatttgtgtctatcattattttttcaaaaacttaatttacctcacattcaatctttccttccttgaaaatatggtccacttggcatccagaattatcattttacaattcaaacctgatcatgtgatttcctgcttgaactttcactagacattcaagaaatctttacgaagcccatattcttggcctggcattaaaggtcctttgtgatgtggtctctgtactaccattttattctcatctctcacccttgttctgtaggtattccaagcttaaggcaaacaaaacttgtcatagtaccctttaacatgattgatcagagtctgcatttgtttacatgctattctctcctggtatactaccttccatcctatccattttctgactgatgaccttattcatactcaaatgttgcttcctcaggaaagacttttttggcctctccaaggagaaaattaagcgcttactccaataggggcttgcccttaactctgtaaaagtgtttaatgcattgctataattacaggtttatgtgtctgtgttcttactagatagtgagccctagaggtcaagaattgtattcacaaaacatgcacttaacacgtttacaaattagaagaaagtaaaagaacggaggaaaaggggaaagacaagatggagggaggaagggaaggaggaagggagggagggagggatggagggagggaggaaaggaaagaaggaaggaaggaaggaaggaaggaggaaagaaagaaaagaaggaaagaaggaaaggggggagggagggagggagaaaggagaggggggagatcccagttcagaaacatttggtatgactatatattgtttccaaatactctttgtgactatagaatagggcctctaatctgaaaagaatacttatcacatgtctgtaataaagtaaatttatatacacatttcatttgtaatttgaatacccattcattccagaatacctgtcatcttttgttacatccttcatcacatcacaatatccatgtagtctttgtcatcattgtggtctgtcctcatttgagctcttaattacaaaaatttcattctctggtcacatcttttttgtgtgtctagcttttagttgtcattgtcttactctctctgaactgttttttaattgttgaaaatgcctaacctttacagagttctactttctcctgctctcttttccttgctcatcatcacttttttccatatccagtcagacacaaagatccattatttcaaccagtatcttatcaaaattttcaatactcttctcctctgttgtattcttatggtaatattttgttccaatattaactgactgtccattttctaagttctatacataagcttctatatatctcgagagaaccttacaactgcacaactacttcatggttttaacatcaactatgtttcctatactgtctagtgatattggcgtatttctagatagcatgcatatattctccagtgcagctagttaaaaaacttacccagattttccaaaatctatcatactaagcctgcttacctcaatcatgagaatacacttaactttcaattttattgagaaaacattgtcatttacaaatatctacacttaccctttcttcttacactggtgcatgatgtgtctctttttctctctgatgcctcacctatgtctctttttctctgtgatgcctcacctattttttttctttttttttcttcctatataatcagtgacattgcttcattaattacctcctgtcttcttcctaggactctatgtctgtttttcctcaccatcatttaagcatgcttaaatctttcctatattagaaaattatgttgacctggtattcctctcaatcctctttactaatgtctaattttcttctcaaacactgaaaagttacctacatcttcttcactttttatcatgcattcaacttttaaacatcttgtaacctggcgtttcctatctgtcatctgaaaacatccacgataaaattttcatatactgctgttgctaaatccaattaaaaatttgtaagccacatttggttgacctctaggcacattaatttataatatactctttgatactgctttcttggtttctgaaatgcaagtttctttcttgcttctgatttaattccattttgtttgtcattcatattgagtatcctcaaaatgttcactctcagatctctctagttccaccctacacattttagttgagggaaatcttccacatccatagctttccatttttacttataatcaaggcactccataaccttgacctttaatgaagcaaaatttcttaattctaaaacccacaatcaagtcaatctgaagatgtccaaaattatattaatctctctcacactctacttccctatttcatcctctacatagtataatacacattgatcctgcaagtagcttatcatgaggataatgctagacttactcagttcccttgacatccacatttaattggtgactaagttctataaatctctctctgtaaaaatttttaaactgtaaattccctactttggacaattatcatctctcacttgagttttttcaaaacctcctaaattattttcatctatctagattttccctcacttatcctgcaattggagatttctttctaaaacataagtatgatgatgccaccatcctggttaaaaatcaacaatatttcattaaatttaagacaaagggcaagctcttcagtttaacatataagactcttcatgatgtagtcactgctttcttgccaagcttcatctacttctcagttttttagcctacatatttattttcttttggtaattttacttgaaaaaggtataattcactcctccaactatgggttatacaatcattatcatcagtaaaatataaacttgtggatgggaaggatcataccttaatgtcttggtatctcaaggacttttagcacatgttatttagaacgagaataaaagggacacattttgaatgcggaaagaaagggaaaatgaatgaataaaatctataacctgttaacattaattcatttttatttaaaataaacagcacaaaaagattgaattcaaagtgtcacctagtttaaaataacctgtatatcttttgaaaacctgaatgattttggtgagatatttatttttgctgtcaattctcatagaaactaattgaaatctgtttcttcattgtttatcaataatgtaatagtgaactgaattatgagtatataaaataaactagtgattaagtaaattttgattatacataatgagtatatgaaagcagtgttaatttatggttattgtcacatgttctacaatcataaaattgttgttactggaggaacttggtttctgtgctctaaatgcatgctatgctagcagaatttttaaaatattgatggattggaggtattgtttttattatgacacagactattttgagcttttgagactattttgaattattcaaaaatattagtctccattgatattggatctgacaacataaaaccctctgtattttaaggagttccagatccattatcaatttgagctaatgggctaactctgtaatggaaaactttgactgtgccaaaattgactctaaaaaatgagatctgaatgtattcctattgaattgccatgatttaacttaatagaattcagtatttctgacaagttctaaatggaggcgtccaaaaggttactatcattattatctgggctttcacccagcatttaaactcacaaatcactgtcatgttttctgctaaattcagcattgattctggcctccacattattatttttttcttttggtatgtttatgtagcatgagagttaagagaagatagtattttatattatgtttagcatttatttagagagaaaaaatgcacttttagtttgagtctaacaacagaaaaacgttttaatacgtctacatctatatttacatttctgtcaacctctttttctaagtctcttcaaaaagaatcagcatttcctaaaagacacagatatatccaagaggccaatttctgagttgcatatacagaataacatagacgatagaacttttagcattacattttaaatgaaaatattttacaaagcatattttaaaatcataggtgagagtagctataggacaatatttttacaattagagagaggtaaaagcattctcaaggtttccatagatgtggtcaatgccacaaagctcttctgaggattttagaatcctaaaaccctctctctttcactctctctctctgtcgtgtgaggatgcagcaagaaggcaggcaagcctctgcaaactggtaagagagccctcaccagatacttcatctgctggcatctcatatcttggactttccagcctccagaactgtaagaaatcactatgcattgtttaagccaccccagtctatgatatggtgttaagccacccagtccatgatacagcctccagaactgtaagaaatcactatctgttgtttaagccacccagtctatgatattgtttaagtagcccaagaaaactaagacaagggaggcatcaatttactgttggatttcttgacctttttttcaccttactataattttatccagcttctttaaaaacttaggtctcagcatggcctttaattcctcctgaaaaccttccctgcatgctttgggattgtattggaaatcccttccttatatgttcccaaagcttcctttgttttattttagcatttatcatgctggggcataattgcctgtttatttgtctgccctcttcattagactatatgccctttatatacaggctgaggatctctaatatgaaaatctgaaatgctccaaaatccaaaacattttgagcactgccatgatgccacaagtgaaaaattctgcacgagtacttaatgcaaactttgtttcatgcacaaaattaattaatatattgcataaagttaccttcaggctatgtggataaggctaagtaaaggattaataaataattgtggaattaaaaataataatttaaataaatctgcaataaaataaatctagcaaattgtgctccatattattcccaagatacatttatatcaccccaaggcatacgtagatgagttgttacaattacatcaggacataatttcaaaatcctaacacctagtataaatcagcactgtgtcactgacaacactttgtattataccatgatttctcaaactaactaaagtatttgttccagaaacagaaaacttccatgtttcatcactttatcaagaaggtctgggattcaaccaaaaaaaaaatagaggtgaagggtagactatgattatcttaacaacattgctcaagtttaagagactaacacattgttcagtaagtaaatattgaggaagacaatataatcattcagaatggtgatctaaagtttttctacagaagaaatatcacaaactaaagtacctaaaaatgtgcgttgagaaataatagataaaagccagtatgagcacttttaaagtcaaaggcaggttttcttcaaaataggagagaataaaggtcagggaaaaaaatagctcatagttttattggtgagcaggtccggaaacctggtaatatgtgtttgtaaagataacatagacaataaataaatgagggaagaagataaattattcaaagaagaatttagaaaaggaagcataagataaattctttgaaaaacaacaataacattttagtcaaacatattttaagttaaataacataagtaatgtgcaaaaatgtattgcaaatatataaggaaaacactaacacccaaatagaaaataatgtaaagggcataacatgtctcactaaagaaaaaataagccaataaaagtataaatggtattcaacctctgcataaaacaaaattttaaaacaagctttaaaatgaatggtttttaatgagataccatttttctacaagcatagtggttaacttggaatatattattctgttgagaacgcagaaaaaaagacactcattcactattggttaaaacataaattatataaaatgacaataatacatcagtatttccaaaataatccatatactttgaggcacctataatcccagctactcaggaagctgaggcagaagaattgcttgaacttgggaggtggaggttgcagtgagcagagattgtgccactgcactccagcctgggtgacaatgagacactctgtcaaaaaaaaaattcatatactttgaaatagcaaattaaaaagtaaaagccagctttgtgaaaatactcagaactgtggccaaataatgtacatagggtgctcagggtaaatcagtgaaaaaaacagagatttctactattgtaaaaatgaagaagtttacattctattgggaaaaggggcatagacaatagacagtaaacaaaataaatatattaattatgtagaatgttagcagatgctaaactttatgaccacaacaatgtcaaagctgagcaatgtcagatcagttaacacagatggcttgtccgaagaggaacaagggtttgagcacctgcaatacaaaatgggattatcagtacatcagcacaggtaggcctcatttttaaaaaggttggataaggtgatagttatccgtactaattctgaaagaaaagaatcacagtgagagagatcaaccaatgaatgtaagggtcctaaagtgatgcatgtctggcatattcaaaaatgctaggcaaccagtgtggccagaacagagtagaagaagcttccttaaaactgaagccagagaaatataatgtgtgtggtgtgtctgtgtagattttgtgcagcaatacgaaaaccttactagtgagtaaaagttagctaagaacaatgaggaataagtaaaagtaataaagaataagctgaagaaggcagggcgtggtggctcaagcctgtaatcccaacactttgggaggccgaggcgggcagatcatgaggtcagaagttcaagaccagcctggccaacatggttaaacccgtgtctcctaaaaatacaaaaattagctgggcaaggtggcacgttcctataatcccagctacacaggaggctgagactggagaatctcttgaacctggacccaggaggcagaggttgcagtgaacagagatcatgccactgcactccagcctgggctacagagcgagactgttttaaaaaaaaaaaaaaaagaatgagttgaagaagagaaatgagctcgtgaagagtctggcagtgagatgtcctggtgtgtgagtgactcctaaagaaattcagtatagcatctgaaaacgagtgtggaaaggaaggggaatcagggtaaagagaatgggctgcaattaaagattatattggaagcttgaactatgaatgactttagaagccttatttaggaaagtaacaatattatctcatgggttttgaatagggaatgaaatggctaagttttaattttaggaataccatccctttaactacattgaataattaattgtaaaggagaaaacatagctaagatggaactgactccaaattgttgttggaatagttcaagcttcagataatgataagctgatgctgtggcagaagaaataaaaggcaattgaagaaacagaactgacaatacttgatgatgaactggatgcagaagacaaagagaaggaaagaggcacagtggctcctaggtttctaattgtggtatttaggtaggtggaagcattcaacactcaatataggaaatacaaagccattttaagaggaagaagaacaggatttcagttttggacactctaagtgggtcacagcttaacccattggaaatatcctgtaggcagttacatacacgtatatcatgtccaaaattatagaataaaaagcaaaagttctcctctttatagttgtcttatatttttaactaatcatttcacataccatttcttctcctaatatattctggaaatcaatgacagaatcaaaaacagattaagctttccataaaaatctctgatcaaataatctcttacacaaaaacttctaatgacttaccattttctctggaattaagtaaatcattctagcctatgaggggctcatactgccatgctcgatgtgctgaaataagctcttcaacgtactccttgcttatgacagagttatttgcatatactcaaatatacctacccatggtttatacatttccacattttttttagtgaaagtccacatcaccaaattgcatttattataaacctgctcattcttctacatctagcaaccttttccatgaagctaattctaatacaaaagttatcagtggtttctctcctgacaccccatgcttccattctgtagttttcataagctggtttgtgttattgttttaattaagtattttatatgtttctctaagttttaataacttgacataactctagcttttaatacatattttttaaataacaattgcaataagtagatagagcaacatatccactgaaaactcattaagtttgagcatttgaatgtcagctggaagagatggcatttatataaaaggctgtcagccttcaaaaaagaaagggtgggcatatcagagctaatggcttgttctgagattgagacactcaaatgagaagggaggacagagatcatatcttaactcatgaacaatgactgaaatggaaattaaaataactaggaaggtcaagaataaatgtcccgggacaataaatatgtttttaaacttgagtctgattctattcaatgttattaacaacatgttttctactttagtccctgatcatttttccagagtcagtagactgtaagaaacctacaaaggaaaacaattaagagagatcatcaatattataaatactggattaaatacctcatttggtaggatcctaatacaattagaaagtgtgtaaatagttcttgtaatataactagcatctttcaaacactatgtcatatgaattttgaaaattataattctacacattcagaaagccctaacctagtagttccattattcgaatgctagaatgtaaggcttagagtttaaataatgtttgtttcatggcagagaatagaacagaatcaccattgctatactgccttactagggactaacagttcagtaaaagctacatgaagcctacattttaaaaaggtgaagagagattctgtaaataggaaagcaaaacacattctggcattgacttattaagagacctacagaagaataattaaagccatgcactggcagaagagaatttggcatcaatggctgctgatatctctcatgaacaccaacaaggatgtatataccacgttttcttcctgtcaggaaacagagatttaaagaacctggatctcactgattcttctaatcttggtttcaaactagatatgaatctcattatatatggctcctttgcattttttcatgatttgggcgatggaaactaagaaggcaatggatgcagaatgaattaagaagataggatcaaacctaaaaaggactggtgagaagctgacatagtttggaaagaaatgagaactgatttcagttgtgactgaaagttgtggttagactagtgactggaggactgatgaatggaaaggaacgtgtactctgacatagcagctgaagctacaatgaaaggaaataatctggtatgttgacagatgatctagagtgaatagtgagatgaagacttttttggtggtatgtgtctgggacagactggctttcctctctcgctccataccacatgcacctattccctttcccttttgtaatctttttcttttccatgatgccacttatggcagagtcaaaggaacatagctttgaagtcagatccaggtatgaatttacctttgtctactaccaactgtaattttgagaggtttactctcagtctctgttttcctcatttataaaatggggatgacaaaatatctatttcagagggttgtattgaggataaactgaaatcctaaaagaaaaacaaacaaaaaaaacaaacaaaaacaaatgtagttgggtatgtgataggtgttcagtaaatgatcttggtgaggcttgttttcattttcctttcaattgccaatctgtttccttttggtcttgttaccagttatctgataaattaaactctgactccactattataaaaaacctggaaacgattaaaccagaaagaagacaaaggctgggtgtgagtttaaaggatttcagaaatttgctgatcttctgtgtgcttcaatgtcaggaattagaaggtaggcaggttcacaaacagtggcagcaccaacagtggcagggaaaggggcttcatgccctcaactcacaatatccacctgtccaattctttcatgtggactagaggtatattctcaacctcacgtaaagtgtagcttccaacactatgtatgcttccctcccctttcaagagattgatccccttaacatcctggagttgtcacagtttagaacaaaaaatgaaagaaagaaaaatagcaaaaagactttccacagcaagacatctgggggactatcaataaatgtaatatagttgagacacctccaaaacgatttctgagcctctcccagccccgtggaaccagaatttctgaaagctgtattgtttttttaaatttcaacttttgttttagatacagggggtacatgtgcaggtttgttacattggaatatttcatggtgctaaggcttggaatatgaatcccgtcacccaggtagtgagcacaatacctataggtagttttcaacccgcccctcttcctccctctaccctctagtccacagggcctattgtttgcacatttatgttcatgtgtgctcaatatttagctcccacttgtaagtgagaacatgtagtatttgtttttccattcctgtgttaatttgcttagaattatagcctccagccccaactatgttgctgcaaaacatatgatttcatttcttttaaatggcaatatagtattctatggtgtatatgtaccacattttccttattcagtctaacattgatgtgcataagggttgattccatgtctttgctattgtaaatagcacagcaatgaacatacgagtgcatctgtctttttggtacaataatttattttctttggggtatatacccagcggtgggatagctgagttgaatggtagctctgttttaaggtctttgaggaatctgcagattgctttccacagtggctggactaatttacattcccaccaataatgtataagcgctaccctttttccatagctttgccagcatcttttgttttctgactttctaataatagccattctgactggtgtgatatctcacacagtattctgagtggtattcattgtggtcttgacttgcatttctctcatgattagtgatgttgaattttttttcatgtgtgttggcgacttgtacatcttcttttgagaagttcatgtagtttgcccatttttaaaatggggttatttgatttttgcttgttgatttgtttaagttccctgtagattctggatattaaggctttgtcggatgcatagtttcgaatatgttctcccattctgaaggttgtctgtttactttgttgacggcttcttttgttgttcagaagctctttagtttaattaggtcccacttgtttatttttgcttttgctgcagttgttttgggggcttagccaaagattatttgccaagctgatgttgagaagagtacttcctaggttttctgccatgatttttgtagtgtgaagtcttatatttaaatctttaatccattttgagttaatttctgtatatgatgaaaggtaggagtccagcttcaattttctgcatatggctagccagttatcctagcactatatactgaatggggagtcttttctcattgcttatttttgttggccttgttgaaaatcagacgtttgtaggtgtgcaactttatttccaagttttcgattctgttctgttggtctatgtgcctgtttttgtaccaatatcaaactcatttggttattgtggctttaaaatatagtttgaaattgggtagtgtgatgcctctggctttgttctttctgcttagggtagtgaaagctgtattttaaacaaatccccattacatttttctgcaaaataaagactctaaaaacttggccaggctcagtggctcatgcctgtaatcccatcactttgggaggctgaggcgggcagatcacaaggtcaggagattgagaccatcctggctaacacggtgaaacctgcttctactaaaaaaaatacaaaaaaattagccaggcgtggtgataggtgcctgtagtcccagctacttggaggctggggcagcagaatggtgtgaacccgggaggtggagcttgcagtaagccaagattgtgccactgcactccagcctgggcaacagagcaagacgccatcttaaaaaaaaaaatccgtctaaatataaacagaattacttcattggacttccagggaagccctttggtgcagacatgactcaaagagggggtccccttgccctccccctctcttccttttaaaatgagaatgtgacagtgaggtcatcggcagttatcttgtgagtataataaacttgatgcctccacagtctaagactagtggagctgagaataagtaagtttattctgctcctgatgacctcggacattccacataacccctggactctagatgttatcttaggtctctaacaacagtagctaaacctaatcctaattgacacagtgcttatacttttattaagttattaattttaaaaaagacatcagaaagtgttcaaagtcaatgtgaatgtcagtgtttggtccagaactgagtactgattttgtgcatgagctcacattcatggggtgggtggaagcatgcttggcacagaaatctttagaaagaaaagcagctctgaaggccggaacacctgtgatatatagggcacaggtggtaatttggcaactgtaagcctggccttttgagctgtggccaaaactaaatttggataaactcattatccatacatatgccctaatttcctgatagatttcagtcagatgtggtaattttctgctcagcttccttatgttatcacttattacatttgctaatgggggcggaaaaactgttctaggagaatatccaaaagcaattgattggtttgtattataatgtaggcgctaaaagaattagtttatttcaaataagtgacgacttgatgccttgtaaatatcttccacacatgcctcattttagttcttcctactaaggcatatgactatcaacactgttaaactttgcatgtaaaccatgttcctttcctctccatctcctcattcttctgaatgtctccactctttcaggtacataaaaattttttagaaattacccccaaaatgtgaaagtacaaaaaatggaagcaaacttaaattttcctcttattaaaaattatgactaaacaataaaacaaaacagttttttcatctcatctgcataattacacataatttctattttatgaattcccaacacttacgcagaagggaaatactcatggcttataatttatactttcataaaagtgatatgtttctttttttccaaagaatcaaagagttaatatattcactacttgtaaaaaaaatacaactcaggattagaaaagaggaaagttgtcaaaagatagtacgatcgttcttagccttgcatagtagaaaagatccaagggttcaaaaccaagtattgttaaggcatgatgttatattctcatgtggtgtgcagggggtgaaggtcactaaagaagcatcaacagatggtatcagcaatgataactacatgttttcagaagtaggttcaggaaattatcctcctacatggagattagttaggccccatagttaggccaagctaagtgacaataatacaagtagctaccatatgagtgtttaccattgtatttgagttatgcactatcagtatattaattcacaagttagaaaatgaggcttacagaatttgagtaaattgctcaggacctcacatactaagtgatgcatgtaaggttcacatccatgcagtctgactttggagatcatgttctaggcttcacaaaatattttctctatttggcatgtaagacattcttcttgttgaaagccatatcaagactgggagaaaggtgtttatgtcatccagaatgtctgactagtctcccatacaagattttgcgataggaggaatcatagctattgattaattggtaagtgcttatatttatatccactgtcaaagcctcaaaggttgtggaaattaggtaacttgtcaaattgtaccatactggaagaaatagagctagattttaaattcattctattacaaaaaccttgttttttacccaacatgacatggataaagaactactattctcctactaaacatataaagagtaactattgcacatgatattaaatatactctcatggggtgtattcagaaacatacatcatcaatttttgttgcactggctacatcttcatccttcatgtggccatcacgttctattaatgatgatttttaaagaagtttcaaaataaattttaaagtcatgcaatagaattaatagcaaagctactttaaaatataacaatgtactaacaaacaaatgatgaaaaactatcttcatagctcatcaaaatctttaaagtataatttgttaaatattttaggaatattgtacaagtataatatcacaagaaaagatattgtaagggaatacacctaagtctatgtatgcaattaaatattcatgaacttttataatcagaagataattcatataaatcttcaaatatgaagtcaataatagtaactgaccaaaccaaaccatctatgttaggtggtaaattagatgttcacaattatcacagttgtcctaaatacagtctctactgcctaattttcacaagtgtctcttctatgtttccattggtgtttcctgtaagtcgtcagatgttttacatcctctttagcagtaattgtttcttacttccttaagcagtataattgtaaaggatacagcaaaactttgaacagtcctctgtacctaatgccaaaacaatctgaaacagaaatgtcagtattttaacaactttaggtcattaatcacagtctattcaatagtaattttcattgctgaaaaatgtttttgattaatatacttaaactgaaaatcttgttcataatatcagacagatatttaagaatttgaaaatgatgagcacataaattttgctgtactcttcatttggtaactatataggaagaataaaagttttcctaaaaatatttcttgttcaatataaagtatatttttgagagcggcattgtacatttaaaaggttagtaggatgatggaaattgtgcagtcagctctatgtattctgttggttagagcaatgcatggtggcccaatcactatttttaatatatctaggccatttcaaaattaaaaggcatatactgtcagagttttgcccctgtgtgcacttcacaaacatgaaaatccactgtcatagggtgacttttcaaagacatatgtgcacatatgagggcattttctgatttttttccaattgagaaattatacaaaataatgtaagttcatgttccaatgtctatggctttaatattttgcattttcaaaataatgcaagaacagtattatgaagtagtatgttacacacaacaaggtttgaagaaaatttagtaaaacttagtcaagttacttctttcaaaaatcttgaaagtctgaattaagtaaatgtgtagccagatctcatttgctgagcgacagagaagaaacagaagggtttcgatctaaaaatattgatttgatatctcctctttttaaatgataaaacacaatggattttcatacttatgagaagttgaactacactgtgaatatagtaatcttgactagagagtatacaacgtgtattaaatgtgaatcatttaaatttggatgaatacatatgcaacctaatactaacatctgcccttattccttgttcaagtcttggctcaaattttacattctcattgaggtcttccttgaccacctggtttattattgcaaactaccttctcccaacactaccccaacgacctgtccctacacttataattctcttatgcttcttttaattttttacataaaattaaaaattgatttcatgaaattatgtaatttacttttgattatgcttatttctgtgtgcctctgctaaaatataaacttcagaagaatggggaacttagacactgaaaggcatttagtagctcaataagtacttgttaaaagactaataatattggcattgaggaaaaactgatgaaaatacttaatttctccatatctcaataatttatatcaaacagcagggactgtttatattctgttgttatataaaaataacaccagtcagttgtgctttcattgaattccatataatattgctttaaaagatatacggcattttcgtattttcataaaatatattgaaatgctctaaagagctgccagagttcataaaaaacaatcttgcaaactggctatagtacttggaaaagtggaagcaattcagaaacttcaaaggttgcagtcctactgagaaagatgtagtaagttagagaatattggagaaagcatagataactatttaactatatgataaataatttcacagccactgctgttcctccagccattcctattcttcatgttttggtatttatatttagtttatattttatactaggtgttttgaccacaattgtgtcaagaaactgaggaaacacacatcttcaaagctcacctgaagggcactgcagtttgtgttatgaaaggcttttgccttaaagccttgattttacaattcactgaataaaacagttgctgaatgcctgccacaaatcttgtcccgaaatatgaaagtctggcatgtactcaatgtacctgactctcagacaggtaaggcctcaagaaattcctgagcagggaatcgttaacttggagttcagaagagttgggtgttggacacaggcttcagagaaggcaaaatatttaatctgagttacatttggagtaggatttctaagcgaagatgccagaggtatagcaagaaattgcagaaatgcaaagttttgttgcattttggggagaattaatagttttctgtgttgggaagctagggcatgtaggacaactataaacattgtgcctgaaaagataacttggggttaagagccttgaaactcatggctagcatttaacttttattctgggaccaatagtggggaatccctgaagcaatttaacaataaaataaaaatgtatttaaatcaattccagaataaaagtgtttttctgttaataagaagcttgaaaagtacacaagaaccatggctggagtggattggtgattcttcagaaattccatgcatctcccacactctaattcatgacaataaagtgctctctgtttccaccatgattaaagctgtggtcaaactgaaccttagcttctcgttagccagatccttaggcaaccagcttcagtttctccagtaaaggcaccaaagtatttagcatggtcagcttataacgagtcaatctatgatgagccaggcattgtctaggtgaagtgttctccaagatgtggttcctggtctatagaagcttcacattctaactttagagacagccagtgaaggtacgaagtagtaggcaatgtgatataggctaccatagtgggtgctatgacaaaacatgacaaacaactaacctagtccatctggggctgacaattagggatgtcaggtttagcaaatacaaatatagttcattcaattagcgtttcagataaacagtgaataattttttagtatgagtatgccccaaatactcaaattttactgggcattctgtattttacttggcaaacctactgacaatactttttggataagacattgctggagcagcatctttacgtatagaaattaaccaggtgaaacatgttaaaaagaaaatttcaaacacagggaacaacatgtgcaaaatatgaagcaggggagaaaatagctcatttggaaaactgcaaggaaattcactataactaggtcatagaatgccaacagtgcaatacagatacatttgcaggttagtcaggagtcagatcatgatgagattggattgttttcctgaaagaaacagataccaaaggtcttgctgatagattcgctataaatttgtgtttttccaaaactgttggtccttcattgatgcctgacaaatttatgggttttgctttctttacataaatgtaatggtattatttattttctccagttatttcaaacatttgtgttatcttccagcctccttgtcccttcctctttctgagcattcttaccaaactgcttctttcttcccagaaatagataaaatgtgatgccacaattcccagtcaacccttacccattaactctcctccagttcacacctaccacttctgctgctgacgtaatcataaatattaaagtgtttgaccaacttttcttatgattcttactcttttcttggtcttatttcacattgcatgcctgtatcaaaacatctcatgtgccacataaatatacatacctaccatgtactcacaatttttttaaataaaaaacttaaataaagatgagtctcccctttcttccaactttcatacatgtataattcctcaatttttgctccagaatagaaaccatcctttcctaagtacccttgacctttctataccaatcatcctttgcctagctcattttatccacttcttcctctcaactggccctatattccaggcaggagcatgttcaaggctcttccatcttaaaccaaaaactttccctcaaattgcccaccttaaccatacatcagttttcctatctttatgaatctacccttgctatataaacactttctctccttaagtcactaaggcttggcttctgcctcctccatttatctaaaccatcttgcagcaaagtaataagcgaatcacactcggaatctgtatatgaaaattaaatattaacatgtattgccctagaactctacaatattaggatatacatattttggaaataaattttatattctgttattcccagcaacatatacaagctaactcatacttggtaagtcttacgtcaagctttatccaaaatcagcatcaaattttccctttaaagtctcacaatgtttctacaattggtgtccatactccaacaaacacataacactctgtgagtatatcataattatgatatcagttgaaacattaaaaaaaacaaatttgaaatttgagcaggtaggggcctttaacttaccttgtgcgctcaagtattcacactgtccaaacctttgccactttttcatagacttgctagttacttattaagagacttcataaattgctcaacctctttgaacttttttgatttcctgtatgcctcattcatttgtttacttacttattctgccagtagtttatgggtgtgctttgtatttagacatgtgctatgctataggacattttcagttgaataacgtaattccaacacttcgtgtcctttattttagctggaaaaattaatggattattgtgaagagtgaatgagaaaaataatatgtgcaagcaagttacagaataaaattccaggtcttgaggaaattatgcagggcctctataagaaggtaaggaagtggtgaaagctaggctggggttctctatttttcatgaattcaagatctgacatggtgtattcctaaatgattaataagtactacctatatataaatgtcatgttaacacttatgaaattttatcagaacatggaaatacataaccaagtataacaaaccaagacaaacacttcatttgtccaacctcatctaaaaattttagataatcactgaatttctaggcacctttatcatgcttcacaagcagcagattaagctaacacacatcatatgtcatgagtgttacaccagctactcctacatcatgtctagctatcatatccagcattttactacaaatcatttcttagaagaaacccttcagtacaggcagaataagcactagagatgcactagaggcagggagccatttttaccctcccaaaacccactctctctctcaccaaaactctgtgtatgtgtgtgtgtgtgtgtgtgtgtgtgagagagagaggataggtgtgacaaataagctaaatcaagctttgagaggatcttagacttctttaaatgaatatatatatatatatatatatatatatataaaatttgaagtaaaatcttcttttcttatccatgctcgtcaaagttctttgctaaaactgtgtgagacagtggcgttaccagcaacagtttttttgttttttttttttttttttgagacaagagccttgctctgtcgcccaggctggcactcactgcaacctccacctccccggttcaagtgattctcctgtctcagcctccaagtaactggggctacaggctcgccccatcaagcctggctaatattttgtatttttagtacagacaaggtttcaccatgttgcccaggctggtcttgaactcccggcctcaggtgatccaccagcctcagcctcccaaagtgctgggatcacaggtgtgagtgttacattacattttaacacatttctttttaagatgtaagtacttgttatcatacctttattttgttttttgttcttagaaaaactctttgaggcatgagaagaaactagagtatggaaagcttagaaaagtctgtggattggtcaagctgggaccttcatacaatttaatataacttttagtccaggataactcataaaatgtcctggaagtgaactgtaaaatatagagagaatcattctttcttataatgcagtatatattaattgtagactatttctcatacaaattcttgtaaaatattttactaggcacaccttataaatatactgagactaaatatgagtttagtctcaaaaactactgagtttttgcagctcaactgattctggatttttaactatttatttattttgcataattgaatgacaaatctgcaatgacatatgtatatatagatatatatattcacaaaacacaaacatatatataaatttcagtcaccaagaataaagaaataatgaggcgtcacgatcatctgaaaacttatcttatactctaacaaaaaataaatcgagttaaatataattttctaatgtctccaagtccatgatttttcctcattaatgtaatagttttatatattccttttacataaatgaatgtttttacactaaaatatctatgttttgtgaaaatttataaggaattgcaattttaagttcctttttgtgtctatgtttctacttttattagaatatatttaccaatgtatttcaattgtgtttctttttttttagcttttatttttttttatttattattattatactttaagttttagggtacatgtgcacaatgtgcaggttagttacatatgtatacatgtgccatgctggtgcgctgcacccactaactcgtcatctagcattaggtatatcccccaatgctatccctcccacctccccccaccccacaacagtccccagagtgtgatgttccccttcctgtgtccatgagttctcattgttcaattcccacctatgagtgagaatatgcggtgtttggttttttgttcttgcgatagtttactgagaatgatgatttccaatttcatccatgtccctacaaaggacatgaactcatcattttttatggctgcgtagtattccatggtgtatatgtttcacattttcttaatccagtctatcattgttggacatttggcttggttccaagtctttgctattgtgaataatgccgcaataaacatacgtgtgcatgtgtctttatagcagcatgatttatagtcctttgggtatatacccagtaatgggatggctgggttaaatggtatttccagttctagatccctgaggaatcgccacactgacttccacaatggttgaactagtttacagtcccaccaacaatgtaaaagtgttcctatttctccacatcctctccagcacctgttgtttcctgacttttgaatgattgccattctaactggtatgagatggtatctcactgtggttttgatttgcatttctctgatggccagtgatggtgagcatttttcatgtgttttttggctgcataaatgtcttcttttgagaagtgtctgttcatgtccttcgcccactttttgatggggttgtttgtttttttcttgtaaatttgtttgagttcattgtagattctggatattagccctttgacagatgagtaggttgcgaaaattttctcccattttgtgggttgcctgttcactctgatggtagtttcttttgctgtgcagaagctcttgagtttaattagatcccatttgtcaattttggttttgttgccattgcttttggtgttttagacatgaagtccttgcccatgcctatgtcctgaatggtaatgcctaggttttcttctagggtttttatggttttaggtctaacgtttaagtctttactccatcttgaattaatttttgtctaaggtgtaaggaagggatccagtttcagctttctacatatggctagccagttttctcagcaccatttattaaatagggaattctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgagggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcacgtcgtctgcaaagagggacaatttgacttcctcttttcctaattgaatacactttatttccttctcctaactgattgccctggccagaacttccaacactatgttgaataggagtggtgagagaggtcatccctgtcttgtgccagttttcaaagggaatgcttccagtttttgcccattcactatgatattggctgtgggtttgtcatagatagctcttattattttgaaatacgtcccatgaatacctaatttattgagagtttttagcatgaagggttgttgaattttgtcaaaggcattttctgcatctattgagataatcatgtggttttggtctttggttctgtttatatgctggattacatttattgatttgcgtatattgaaccagccttgcatcccagggatgaagcccacttgatcatggtggataagctttttgatgtgctgctggattcggtttgctagtattttactgaggatttttgcatcaatgttcatcaaggatattggtctaaaattctcttttttggttgtgtctctgcacggctttggtatcagaatgatgctggcctcataaaatgagttagggaggattccctctttttctattgattggaatagtttcagaaggaatggtaccagttcctccttgtacctgtggtagaatttggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgaaatagtttcagaaggaatggtagcagttcctccttgtaccactggtagaagttggctgtgaatccatctggtcctggactctttttggttggtaagctattgtatttctgtgggatcggtggtgatatcccctttaccattttttattgcgtctatttgatacttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgttgctcttgcttttctagttcttctaatcgtgatgttagggtgtaaattttggatctttcctgctttctcttgtgggcatttagtgcataaatttccctctacacactgctttgaatgtgtcccagagattctggtatactctgtctttgttctcattggtttcaaagaacatctttatttctgccttcatttctttatgtacccagtagtcattcaggagcaggttgttcagtttccatgtagttgagcggctttgagtgagattcttaatcctgagttctagtttgattgcactgtggtctgagagatagtttgttataatttctgttctttaaatttgctgaggagatctttacttccaagtatgtggtcaattttggaataagtgtggtgtggtgctgaaaaaaatgtatattctgttgatttgggatggagaattctgtagatgtctattaggtccacttggtgcagagctgagttcaattcctgggtatccttgttgactttctgtctcgttgatctgtctaatgttgacagtggggtgttaaagtctcccattattaatgtgtgggagtctaagattctttgcaggtcactcaggacttgctttatgaatctgggtgctcctgtattgggcgcatatatatttagcatagttagctcttcttgttgaattgatccctttaccattatgtaatggccttctttgtctcttttgatctttgttggtttaaagtctgttttatcacagactaggattgcaacccctgcctttttttgttttccattggcttggtagaccttcctccatccttttattttgagcctatgtgtgtctctgcacgtgagatgggtttcctgaatacagcacactgatgggtcttgactctttatccaattcgccagtctgtgtcttttaattggagcatttagtacatttacatgaatttgcagcagctggtactggttgttcctttccatgtttagcacttccttcaggagctcttttagggcaggcctggtggtgacaaaatctctcagcatttgcttgtctgtaaaggattttatttctccttcacttatgaagcttagtgtggctggatatgaaattctgggttgaaaattcttttctttaagaatgttgaatattggcccccactctcttctggcttgtagagtttctgccgagagatccgctgttagtctgatgggcttccctttgagggtaaccggacctttctctctggctgcccttaacattttttccttcatttcaactttggtgaatctgacaattatgtgtcttggagttgctcttctcgaggagtatctttgtggcgttctctttagttcctgaatctgaatgttggcctgccttgctagactggggaagttctcctggataatgtcctgcagagtgttttccaacttggttccattctccccatcactttcaggtacaccaatcagatgtagatttggtcttttcacatagtcccatatttcttggaggctttgctcgtttctttttattcttttttctctaaacttcacttctcgcttcatttcattcatttcatgttccatcgctgatactgcttcttccagttcatcgcattggctcctgaggcttctgcattcttcatgtagttctcgagccttggttttcagctccatcagctcctttaagcacttctctgtattggttattctagttatacattcttctaacttttttcaaagttttcaacttctttgcctttggtttgaatctcctcccattgctcggagtaatttgatcgtctgaagccttcttctctcagctcgtcaaagtcattttccgtccagcttccttccgttgctggtgaggagctgcgttcctttggaggaggagaggtgctctgctttttagagtttccagtttttctgctgttttttccccatctttgtggttttatctacttttggtctttgatgatggtgatgtacagatgggtttttggtgtggatgtcctttgtgtttgttagttttccttctaacagacaggaccctcagctgcaggtctgttggagtacccggccgtgtgaggtgtcagtctgcccctgccgtgtggtgcctcccagttaggctgcttgggggtcaggggtcagggacccactttaggaggcagtctgcccattctcagatctccagctgcgtgctgggagaaccactactcttcttcaaagttgtcagacagggacatttaaggctgcagaggttactgctgtctttttttgtctgtgccctgcccccagaggtggagcctacagaggcaggcaggtctccttgagctgtggtgggctccacccagttcaggtttcctggctgctttgtttacctaagcaagcctgggcaatggtgggcacccctccccgagctttgctgccgccttgcagtttgatctcatattgctgtgctagtaatcagcaggactccatgcgcatgcacgtaggcccctccaagccacgtgcaggatataatctcctggtgcgccgttttttaagacggttggaaaagcgtagtattcgggtgggagtgacccgattttccaggtgccctctgtcacccctttctttgactaggaaagggaactccctgaccccttgcacttcccaagtgaggcaatgcctcgccctgcttcggctcgtgcacggtgcgtggacccactgacctgcgcccactgtctggcactccctagtgagatgaacccggtacctcagatggaaatgcagaaatcacccgtcttctgcgtcgcttacgctgggagctgtagactggagctgttcctttttggccatcttggctcctccccctgtgttttgattcaatatattactagcacagagcagagaaagcactcaatatatattgatttaagtaaaattaatgattggataaaatagcttcactgtcacactatacatgacactgacatatgtctatgtatatctctatgtcaggagacagaaatataacagtatttccacattctattcatagtagaaatgaaaggcttgaaaaacccaggtattttaattccaaattttgtttacttttagcatctatctcttcccagcctactctgttgataatttttactcagacctatacacataaaaatgctagcatatgcacatacacataaaacacacaaacacagtctgcattgtcatttataattttgaaataaattaaagattctagaagtaattataattttataatatacatgttatatagaatatgatattgacaaacatcttctcttgaaacaatgttatgcttattgggaaaattataccatggatgtttccagggacaacaatatagatgccatgactggtgacatttaaagaatttgggtaatttaaaaaaaataatttttcttattttaaaattaatattctagctaagacaggtagcctatgtccagccctggcaaaactctggagttcaggataaacagaaggttatgccattatctggtggattttgacagtacaaaatatcaatagcttaggtggaaaatttttgatgaattcatttggaataattttccaagatttttcaaactaagttgaaattacaaaatatggtttttaaaataaaatgtttatgaagaattcttatgtcctggtcatagaaacaagtgatacttatgaggcctaaaattagtggataatatgtggcatgcaaacatatgggtaaaggacttttggattagaggaataaatgttagatctggtagaactaattggtaaattatcaacttgttattttacaatatagtttaaataacccataatatctgtttaaaattggagtatatttctgcaataatttatctcatcttaacatacaacctaacccttatccgtcagcatggtgatataggtcacaaggtttgcaaaatcacacaaaaagttttaaaattaataactctggcatactatccttaattcattctgttaggggatgtaaatcattttatttgagaaaaaaataatgtctgttgataattttctggaggctaactcacatttttgcatgttaattctcagcaaggaagtttctccccaatttactaaaatttctagtgacattttttctagagtttaacaaaattcacatcaacaaatgtgtcacttcttttgacaaacttttatcctatttatctcattctttatcctaggagttactgtgacataaaataaaatgctaacagagcaagtaaaatatcagggatgaatgactagtaacattatacaaggtttgataagccgactcaaacttgaagaggtggcagctcaaataataactgactgggcagcagaaacaaaatgattacagtcttccaaagggcaatatctactttcagggagaaaatgtgctaaacaatcctgattctaccatattatacttgagagaaaataatattttatttatcattatatctccagggcttaggacagaggcaatgttcaaaaaataattttaaaaagctttattttgaaaagctaatagctaatttaatgctatcttaatgttacatttattttcctaagaataagacattaaagtacctgaaaattcaaatttttgtttcttctgaaacaaatttcactttttttttgtttgttttgttttttgagacggagtcttgctcttgtcgcccaggctggagtgtagtggcgtgacctcggctcactgcaacctctgcctcccatgttcaagctattctcctacctcagccccctgagtctgagtagctgggactacaggcacccgccaccacgcccggttaatttttgtacttttagtagagacagcgtttgaccatgttggccaggctaatctcaaactcctgacccgggagatccgcacgcctcggcctcccaaagtgctaggattacaggcacgagccactgtgcccagccacaaatttcacattttttaaagcatagagttatgatatgccccatatgcctagcctttgattatgtgctcctttaccccatttcctaacgatttcattattggaattgtcccctcaaccagattttaaatttcagagtagatacagcgttttattagactcttcttctccatgttgtttggccaggtggggtgcatgtaatttagtttagatacattaggaacttaaaatagcaatatattgtttgtattattttaataataatgtcaatctcaggacaactgtacaaaagataccatatcctttagtgtttactagtcacagtcagagtattatttggataacttcttcaaggttcagaaggatatagcctcacaaattaaaatccaaatgcatagaaaagaattttatgacatctatactttatccttaacaatgacaaaatgaagccgggtgtcgtggctcacatctataatcccagcactttgggaggccgaggcgggcggatcatctgaggtcaggagttccagaccagcctgatcaacatggtgaaaccccatctctactaaaaaaaaaaaacaaaacaacaaaaaaatagccagccgtggtggtgcacacctgtaatcccagctactcgggaggctgaggcaggagaatggtcataaataaatgtaaagaggttcaatatacctaaaaatcaagaaatacgaattccaactattgggatccactattatttcatgattaaactatcttggctaaaatattgactctgccactcactagccatgtacaagttatttaatatttctggccttcatttttcctttttttcttctttatattagataaatgataactataattcacaataaaaatggaaagaactttagttactcagagtaataatagcagctacctaataaaaatatttgtaaataaaataaaattgtgcttctaaattgtctaaatgaaggcctggtatgtactaatcactcaacaaatgttagctattaataatgataaatcattccacggctatgagattaacaataataataatagtttaaaaagtaaagcaaacacaaaagaatgttgactgaagaggaattttaacgtcctgcattgaggaaaacttcgcatttttaaagtagaaattgtcaaaatatgtataagcatttatattacagtattgtttatatctattaaaaattagaaacaacactatgttggtatatacatgttataaaatacaacacaatagttaaagtgaataaacaaataaattaatgggaagactcatgcatttatctctcctttcttatatgaaacttattgtaggataacaaagtattttataaaatgttaggtaggaaggagcacgtgaatcagaatatcactgttttgcaacctttaataaaataataaatgttggtcgtggctgcaaacatcacagatagggcaacattctgatgtaagtacacaacaccacctatgatatagtcttgccaaaaaacaaccctgaatttcactactagtttataggaaataaaggggaaaaaggaacattttgaagttagcaaactccagatctcgagaaactctaaaggcaaatgagtaggtatctctaacgaataaatagctagggaagaagagaaaaagaaagaaacagagacacagagagacagagattgcttttagttctagatttagcttaaaatgtatttaaaatgtatctttaattctaattagaaaaaagctttaaattttttgaagaaagacaatccaaaaatttttaacattgagtatttgatgaaaataaataaatattcttaattattttgtgaacaataatatttttatatgttttaaatcctattatttttacagttatatattcaaacatttcataattaaattatattctatttgtgattatctttataaccatatggggcggtgagtttttatatggatgaaacaagaatacttaagcattgaaaattattattcccccctccccccacgccaacacaaattccctccacccccttaaccctgccccaggcggagtttcatgcttgttgcccaggctggaatactatggtgccatctcggctcactgcaacctccacctcccaggttcaggcgattctcctgcattagcctcccaagtagctgcaattacatgtgtgcaccaccacacccagctaatttttgtatttttagtagagacagggtttcaccatgttggtcagactggtcttgaactcctgacctcatgtgatccacccacccagcctccaaaagtgctaggattgcaggcatgagccaccatgccaggaccacattttattattattcttcttcttattattatacattaagttctagggtacatgtgcacaatgtgcaggtttgttacatatgtatacatgtgccatgttggtgtgctgcatccattaactcgtcatttacattaggtatatctcctaatgctttccctcccctctcccctcaccccacaacaggccccggtgtgtgatgttccccttcctgtgtccaagtgttctcattgttcaattcccacctatgagtgagaacattcggtgtttggttttttgttcttgcgatagtttgctgagaatgatggtttccagctcatccatgtccctacaaaggacatgaactcatccttttttttggctgcatagtattccatggtgtatatgtgccacattttcttaatccagtctattgttgatggacatttgggttggtgccaagtctttgctactgtgaatagtgccgcaataaacatacgtgtgcatgtgtctttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacatcctctccagcacctgttgtttcctgactttttaatgattgtcattccaattggtgtgagatggtatctcattgtggttttgatttgcatttctctgatggccagtgatgataagcattttttcatgtgtctgttggctgcataaatgtcttcttttgagaagtgtctgttcatatccttcgcccactttttgatggggttgtttgtttttttcttgtaaatttgtttgagttcattgtagattctggatattagccctttgacagatgagtagattgcaaaaattttctcccattctgtaggttgcctgttcactctgatggtagtttcttttgctgtgtagaagctctttagttttaattagattccgtttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaagaaagggatccagtttcagctttctacatatggctagccagttttcccagcaccatttattaaatagggaatcctttccccattgcttgtttttctcaggtttgtcaaagatcagatggttgtagatgtgtggtattatttctgagggctctgctcctttccattggtctatatctctgttttggtaccagtaacatgccgttttggttgctgtagccttgtagtatagtttgaagtcaggtagcgtgatgcctcccgctttgttcttttggcttaggattgacttggcaaaggaattgaaaattattgaagctggagaagggtaaattataacattctatttttgaagacattttaaggttttcattaaaatctggatgcatatatatttagttaaaaaatgaaaatgccaactagaaaagcacacatatggaagcttagtttattaatatttttcatatataaatatacatgcatataggtatatgtaaatatataaatacacacacatccatgttggaggctattcataatatttttatcatattcaaatactggtattatttttcatcagtctaatatgactctggacacctatcagaaataaggaacattagctaatcaagcttgcctcaatatgttattatcctgacataataaaggtatcattatatcttggtaagttcaaatgtaaataattcaaagtgcaatcttgcttgccttctccttgctgatgtaacaaggatagtatagttatgttcactagaatgaaataaaatcggcatttcttctttatattagataaatgataactgtaattcacaataaaaattaaaagaactttagttacagattacatttatctgctaaaatatatctcaaacttagattgtaaaatgatcatttttcttgtttaagacccaagaaacatttcagaaattaattatggtattgtcatgcttcaagtgcatatgttcttaagacaacttacatgctttaccctgggagtctatgaacaaccacattttcttatctgtcagctaaatcagagacaccatctaccagatgactcataccagcaatttagaaaataaaatccacctcaaatttggtcttcaatttaaaatttcttgaaagtgtaatgttacctcatcaaaatattaaataacaactgaccacattattccatgtctgtacctctgttttctaggattttttaatttaataaaaaatttaaaaatgcaaaacacaaatgcaaactgggttacaaaataaaaataaaaaatgaaaaacacaaatgcaaactgggttcatcaataagagaggaaattaccactcggatgtatttcttaattttttattttgctttgtattgctatttttattcatgactaggaaaggctttaaagcctctccttcaggaaaaattgtttgcctaaaagtacagctctgtatggagatctgaattttattactaaatcatttgttattctttttattcatttgatattaatcttgattattgtatcataaaagctcactgagaataggaaattcatgttaattctaaagaaacatcattaatatatttataacaaaaatgttatgcatttagtggcctcaaacctgcatactaaaagtgacatttcttaatggaaagaaaaattccactgtcaccagcaacagtaaagagatatattgtatactgttaataataagaattcacagggccattagttgaaagactagagggatagaatacaatatcaatttgtagaaggaatgtttcacagcaagtcaattagaacagaaattatgtcacaaagcttgttttttaatagcatatagatattagcatgttttacatatgttttttaaactaggtaggaaatttagatttcccattaacatggacaacaatcctgtgaacgactgctcagcttatgtggtactccatagtctctgcccttttccttccctttccatcttgcctatctattggagaggaacacagccaagttccaattcatcactgctatacacagtttccatgcaatgctgccactggcaccaactccctccatctggccttagtctgagcatggtttcctctacaactgttgccagtctgttgccatagcagcagctaagaggactatgacaggatgggaaaagaataaagcacactccattttcatgcttcttgttgagattttgtaatggttccaaggtcccactaaaactatgatggaaaaaataaaaacagcttcaccaaagatacaataaacatccttttcaaagagaaataacagtatataaatgagaaacattgaagcctgcaaattgagaataaaggagcacacacacatggtcagaaggtgacccacggattacacgaatatcaaattatgaaaataataaaggataatttttaggtctttgttaatgaaagattagaaagacaagctataaacaaacatgttagatcagtgtttggaaattcttattaatgaaaaatctgcagtaattccttaaatagctacatcaatatttgaataaatataaaggtaagcattttctaggtagtttattataattccatgataaaaatcattacctatgtttctgacttaaagagacatataacattatatgtgtgcaggaaaatacatcttatctgaatttcaccaaaaacttattttaattctataaattctgaagattatcatatatatacacaaatattgtctacaaaaaggcaacttaccataaacaaaagcactgaaaattaaaggacaataaaaatcaatgaattctaatcttaagcttaaaagcctactgtgaaagcttttggcaaatagaaatattactaactcttaaggttcatgtgatgaatattgaattggaaatgtatgtgaaaagttcatcatatttttctccattctccaagtacgattacagaaaattcccaaaggccactgtatcttacttttgaaaccataaggagttagattacaccacctgttttacaatccaggctatcctcaatgttcacaattttcacctgtttgtaactgaaaaccaaaaggagttagattacaccacctgttttacaatccatgctaggctcaatgttcacaattttcacctgtttataattaaagctcatggtgagcttcagctcaccaacatttcctcaaatatttagtattatctctgcttctatactcaaacattaggcactgtcttttctgggaaaaaaatagggaaagaaaagacaaagggtatgtcctacttataatcatgccactgaaaagcttcaaaactcagggcactctcaatgaaaaaaactgacattttcaagcatctcatttcaagtcagacttttctatatagaatgtctgtgatgtaatatcaaccaataatataaagcttcctaataaaaaagattgttttaaatttatgatagatacatttgaaacagatgatgcaagtaggctatattgtattatttagtttgataaactaatagataaaaccacaaagttgtgcccaagggtttggcttccaggttgaaaccttgtgaaagccaaacaagctaagcctggtgaacaaatggttttcatcatcatttttattcgccataattcaatttatcctactattcagcctgcttgtaaaaaataccactattatagtcaagtctgcaaatatttactaagttcttaccctgcccaaagcacatgagtaaaataatgattttccttactttcaagtcctttaaacatgactgatacacaacatgcttccttctttgagcattacaaatgattactggtaaggttggtgtttaacatgtcagcattgtatcattttctgctaaatcgatcttgttcatttgtaactaggagtgcacctcatagcagagcggagagattgccacataatatctcagaggcgaaaataattcaagagattttgttgtgccagggagttagacacatttatgctctttgggttatgtagagctgtatgataaagtagatgatatgtctttataaacttacacatttaactatatatgctcacaggctgaggaggagagaaaaataaagggaaaaaaaagcatttgaatagtgcagaagacttcagtcaccaccacattctaagcctgcatgctgcaggttgagcatgaactgcactcatgaaagttcagattcttctcagtttctgtgttcctccaacagtaggagcatctcagtgggccatgtgtgattccagtgtttaaagataggacttcatttaaaatgctcccaaaattcaatccaattatgtcaactcattttcaactaggagagactgatatattctaatttgagaggagagacgggctacgttggagctattgacagatatagccagtatgtggctgttatgaatattttcaaggaattttttttcactataacaagatgcaatttagaatctaaagaatatcattgaaatacattttgttgtggaacaagtaattattcttcaggcctcacatggcctcgttcaaataccatccaggccatacagcaaagctgtgtttttgattccaaaaatcatcatggaaacttctgatcattaatctagatcccctgctacctgaataagtagaaggaattccccagatattagacactaaaattatcctctctcaaatggactatcatccatgtaaattaacaaaattgaattataccaaacacttcacatccgacatcattttggcaaataataataacacttgaatgaaaagacaacctgtcttcaagagcttatggtctatccaaaaaatggtatgacttgatatcagatggaaagtttgtaggaggttctccagaagcatatatgaaggagtgactaacaccatatacatacataagagaaaatttcccccaaaaggtaagtgttcagatgagtcttcctaaacaattatgagatttccatgcagataataagaagtgaagaacatttttttcagaaacatgaatgtgcgtatgacacaagaattgaattgagtgttcaggaacattctattatatgactagagtatcgactcaatagggctggggcttgttaacttgttcattttcaaattccctcctagctcctactatagagtccggctcacacagaatgcttaatcaatctttatttgattagaggtaagtgtctggaacacataatcatctgaagtgggtataccaaatatagtgagaattaggctggagtgtaatttgacaggaaatattaaatgaaaaatgattagaagagaaaattttactcctctctcgtttaagttttggcatcccagccctgttttgatgactaactgaagaatgaggacctgattctaccatgttgtcaaactgctctgtgttctgccatcatgtccacattccaggtgggcaaaagaagaaaggagtagaagaagggtatgtctcctccatttaagaacaaaaaaagttacttaatgatatctgttatatcccatcctcaatagctgtcacatctgactctagggaccttagaaatgttgagtttattgttggtgtccatatccagttaatatttagtggccctattaaagggaacaaaatacaaaataaacactgggggaaattagcaatctctttctcccattttaatggattttgaatttcatcatgtaggtaatatgatgtaagcagttacttaggttaatgataaatttttaactttataaaagttaataacacctccagtagcaatgagtatacccagtacctagatgatggtttctaatgccattctccatgagctctccatggccaaaaatgaaacaagttaagaaacaaaataaataatgtattattagaatataagccaaagtataaaataaatttccatgagtccattataatataaataaatgattgaatcaagagataaatggaataaaaatatcctgtgcagaagaattccaaataagttacgtaggtacactcccctaaggaagatggagtaaacttccaacccattaagtgtacgctgcatgtagtgacttccttccaagatacaatatggtaagtggagaaaaagataaacattatggtagataaatctgagaaacacaccctcagccagatgatgaaggttaacttcaatgatatgtaatattcagagaatgtacccttgatatgaatgtttaattagagaatggtatattacttctgtggcttttctcccaaagacttacaacccctttgtaacaatacaaaaatcagacaaacctaatttaatgacattttatataacagcttcttcaaactgtcaaggtcataaaaattaaggaaagtcagagaaaatgttagttaaaaggagcctaaggagacatgaggacttaatgtaatgtggtttttggttgggatcccagaagagaaagaggacgttagactaaaaaactaagcaatatgaataaaagtatgagcttcagttaaaaataatctatcagtattggttcgttagttcgtcagatgtatcagagtaagatgttaataaatagaagaaactatgcacagtatatgaaaactatatttacacatttttggcaaatataaaactattacaaattaaaagtttacttgaaaagttataatgctcaatgtaataagttctacaaaaggaagtagtatttagttcatggcccttaaagttaaggataagattattcatctttatataacttactaccatcctgtaaggctctgtgtgagcaactagccagcttttctagctggattccttctatcgtcactttctatttacaaaaccctattttaactctcataaatttgagaataaaagtatttcaatcacatttaattcattttacatattccactagtcaaaataattttttccaaaatgctatttgctaggaacactgtaatgtcttctgaaaacttagtgatcttgtcttctggaatatggtatggttaatgaagtctaaagtgctaaaaaataagttgaacagcacttatgtcagatgtaactcatctttttactttttttctagttgaggaattaactaatttcaggctcaaatattagaaagctggccccatagggctactttccagacctaactagttattaacagattagtatgtataaaaaatattttattggtaatcatctagtcaataatttaaatatagattacataatctacttttttctaagaaaataatttttaaaaaatcctgccccatgaatatttttatttatttatttgttgaattggcattctttaaaaaaatattactctagaggacaatgcccaggtcatggtgtggcactgaattccacagtagccacggttacattgttgaaaagattctacatgagcacactctgaatcatacagaggaattcagaagataagataaaatacaaaatgtgattagaaatactacccagttgtaccaacttaaagtaaagcaagcttgatttaccaaaatataaacaagtaaacctgatggaaatgaaaggcaaatatgaggtttttagatagagtgaagtaatatttaatagaaaaaaatctttatttatcaacgcccatttactaagttccaactcacgccagagcccgactttaaaaattaataaagtacatctccatattttaataatgtacagttctggtgaaatatggagacataaaaacacaacattataacataaagttgattatatttcgaagacacccatagggcgttaaggacacatatgcacaatacacatatggcaaaacccctagattttggcattaccagtaaacataaatacatcgagaaagtaactgaaatttaaattttgcaaaagaatagtgaatcaaatatattacctacgtctgttttagaaaagggaattatttatgataaaacaaaaggtaaaatcataatacatataactctgaagaagcctagaatgagagctcataggaaagttacatgatgttaaagaagaaggaggggtgcaggaaggtatgaaagaaatatgtaaaaaacacattttcctcatgataaattatagaatcaagataattcctacctacattaaggaaactccattcaaaggtataaaccatcaaagccagacaaagtagttatatagaccaggcctggactggcattggtccctggactgttaggaactgggttgcatggcctgtggtaagtggcaggtgagcaagcaccacctgagctctgcctcctgttagaacagcagtggcatgtgattctcacaggagcgttaaacctattgtgaactgcacttgcaaggaatctaggttgcacgttacccttatgagaatctaatgcttgattatctaaggtggaacagtttcatcctgaaaccattgccccacccctgactgtggaaaaattgttttccatgagaccagtccctggtgacaaaaaggttggggactgtggctatagccccattatctataaagcctcatagatttcagacccacattaaggtagatacatgaaatttagaaatttgcaagaatttccataatgataaacatttttaaaaggacataaactgtccaaatgtaaggggataccaagggacaagaagaaaacatcaagcactgatcaacctcttgttattttctttgctgataagttttcacctgctaatttttccctgaaagttataggatagaaactatacgtcaaagaaaggttaacagtgggaacatcctaagaccaatgggcagtcttagaatacattgaatgaaatttctcaaaatttcttctccttattttctgagtttaaaaaagccataacaatttatatatccatatatcctatgaattctgattgaaaacctaatgctattatttaacattattaggaaataatatccttatttttaaaagtctacctcaaacacattgcgctgtctttcctaatatttcattattgccacaatcatcccttatgtgaatcatgaaaataacctccaaagccgtctcttccaatatttctctgctctaatcccacaatctggctgtagccagacaatcttattaaaatactgactggatcatgtaattcaaaacctttaaggactactcttcaaataaaaattaagaccaaatttcttgccgagttcaaaacctggtacaaatagttccaattctatttttcaataattttacatttatttctacctcaatgtttaagcgttctttatccgaaaaccaaccttcccaaaatttgttcctgcttgttgatctgaccacactgaagtgatcttggcctcatcctgcctcagcttggaatttctactcatctctcagaatacacctacagaggaaaccttttcaataaagccatgaacagaatacacatttggcaaatgttcatgggattaatttgaaacctgtttagggtatttagtctacgaaactcatgacaaaaaacatccagactttacttgaatatttctgaactaatttactacttcatgaggcattcattgcaaatatttttttctttctgttgaattgaaatttgtcttctggaaatttcaatccttctatcctaaaaatcctgctttaatttgagtgtttttagatgtttttattaatttttattggtaatatgctttcttatttatttcttaattattatgataatttagagataagaactatacaactagatgtatgcctacaaaactttttcatgatatatagaccctatgtgcacagttttcattttaacatatcgaggacagaagaaaaatcacagctgatgttaaaatatgtgataactgctgctacacttctacatcagattctgagaagtccatcaagctgtaataggttttctttttttcttatagataaccaaattacttgcccaaagaagctctcattatcagaaggtatactataatacttaactacatagtatcaaactaggaaacctaaaaaacttagcgtttttacccaaaagcatcaataaagtcactgttgaaattgctgaactctcatttattcattcaacaattgcttactgaatatttgttgatgtcttagagaaacatgaacaaaatcatgtagcaataagtaccattcaattcaattcaaaatgtattacacttttattctatgcaaaccactgtcttaactaaagagataccaaatttatcttcatagttgttatcacataccaggaatgccaagtatataagttataacaggttggctcatgtacaaataaatagagtattcctgcaatgataccataagaaaatgaggctacaattctactaacgtcccacatagagagaatatagacacagttcacctgtccatccagctactttatacccaacctataaccacattatgaaacatcatatcttttcagattctaagaatgcctgctactggtttcatgacaaacatataaactttgaattgcaacttaaaaaaatgtcaaaattatcccacaggataaaataaaatataaacccatcaaaatgctgtattaaatctaccaccaaaaatgcctctttcttttcaggaaaaaatacaaaactgtgatccacagagaatgaccctttctgatatgtatacatgcatgtcaacttttaattcatgattctaaattgagaaacctcaaacagctatttttaatatcccagccctattcttattttgcatttatatccatcatatatctcaaccagtgttattgtttattgtatcattacacaaatacatagatcatttccatgtttgctcttttggaaggggtttcctcaatggagttgacttatcctccaaatttgacccattcttttaggcccagttcacatcttctctccttctagcccttacctccctgtttaaacattgaacacttttttctccttaaactactagagtacttgtattctggagtaaaacttttgaaatttgattaaatacagtgtaccatccatatccccagaagaacagtttatataaagtgatgtatattttaaaaagctaactttttaaagaaagaaataagaagtgatattttcttcttttgtttctctttttcttctagtcctttcagtagttctttggaatgcaaggataagatagacaatattcataaataaaacttcctccaattaaaatatgccataatttgaatttggcaaattagtttgtggtattagatatatttttgtaactctattggaaattattttcctggttttataaactgctctcaactttgtcaactccaggattaactgcatattgatccttagaatagtccaccatagaaaaatttgattaataagccaaagctaattgtgtctctgaatattttttattgtcttgaggattactgaagtctctcttatactttgtatttgatcagacttggtatcttattaaatattattagttcatactgtcttattacagccagagtccactatgcatttaaaattatgatgttcttcatatcatgtcccatatattatagatgttaacttattagttatctcattgaagtaaaaaaaattcttctgctaagtttctcaggataatattcaggagcagaagtctgcagactctagacacagttccttctttattgatttatgcataaagagaatcataggactttgtggaaaactgtgttaggaaaaaaattgtaagactgctttgagcctttattgacatattctgaaggctttgatttcataaatgctaacaagccataagtataagttgtgtgactttaatacagactcctggatattgatagttattaagaacctgcaccataattaaaccacgatagtcagaacagacaggaataatctctaatcagacacaatttctagtggggtaaaaatgggaatacattcatactactcccttatttttacttctttattaataaattgattctactttttggatgagtttgtttcatggcttcctttgatccccacgctatccccatcatacacacacatatgcatgtataaatattcatgcatacattcatattgtagaaaacaaaaagatattttcctacgtatacattatcacatagcctcaaatctgatcttctgtggcagagattgtattcccaatttccccttaaaaaaaaaaaaaaaaaaaaaaaacatgatttcactggggtcagaacattgccaagataaaaaagctgtatttcccacccatccttataaatagaaatgtccgtgtgatgtcagtcaaaatatcggctttgagcttccaaggaggttgactcaaatagtctataccctattaccattggttcttcatcttttcttctttttgaagaaaaaactacctgaattacagcaaagatcttgtaaaaataagaacaagaaccacaacctgaaaattgtggcaaagaaagctaaaaggacatgataatatccccaatgaaatgatgttgtccccataccagcttcttatggcctatctttgggcttctctttatttggaaaaaagcaaatcaaaaatcaatttttagccactgtaatataagttacttgctatatgtagtccactgcaattcctactaatacacctcctaaattttgtcagaaataagaatttcagataaatgaatgctaaaattgaagcaatcaattgtggttgatgacatttcacatttaactggctcacagctaaaaggtgcaaagtgtaagttaatttattgatttgcccagagtgatagactgaaacaactttatcttagaggatttaccgggaggttacatcacttcagattactgaaaccatagtctatgatgtacaacatttggcacatcaatcatttatttgcatcagagtagactctaaattgttgtgggcaaaatcttgactttgtttttgggcattccatggttccatatctaccaagcagtatgagaggcctctctttaaactcatgtctccatcagtctccccacattgttcaagatgtcagctcctgggcagaagcatggtggtgtggcagcctgatcacaggactggcaggatcatgctggctactaggaagaatctcctgatggcacagggatgactgggggtctgagtaagataagcagaaattggaataagataagcaggttatattgagagtgcaggaaacctaagatatgcacagcctgaggaggaggcccaacgacgtaaatactgtgaccctgatagaagagaccatttgatggacaatcccttcaggggctgaagagaatcaaaatggaatgtgaagaaagattaaaacaaatgaaaaattcatcctgggggtcatttttcatcagaaaacaacagaaagaatacagttagataatgaagttctttcagccagtaatttgttgaaaagagggaagggaatcttagcatatggggaccaaaaagtaaacctgaagaaattagaaaactctgtattactatccagaaaacaactgagtttcctaagctaagaaaaactttaaaaatgccttcatataagatctcagcagcccaaaggtactgatgtaaaaggtatttatatacatataaaatgtgcatatatatacataaatatataaaatttaaaacaaatatatataattttcacagagggccctaagaccattttggtagctgattgccagaacaaaaagagggccatcaaaatcaagttatgctagcataaattatggccatatatattaattataggaatcacaaccaattttattagaaggaatttaatgcttacatttgaacaacaacaacaacaaaaagtctggctactgggaaatgagaatctgagttttctcctcctaagtaatcaagataatgagaagatcacagaccactacaatgagaagttcaagaagatgatcaggtaacactgagagaagcttgtggatcctgaaaactgtgtttattgtttacattgataagtataggatatactctaaatcaaacacacaaacatacacacactgtcctttctagaggcctgctaattttttagtagataagtccgaaaagtaggccatagtagttctactttttacatgctgggatctgtgatattgaatttgtaatattttgagaaaaaaacaatgtgcagttttctcaaaatgacaagcagtgagtattgtgtttacttcccactaacatgttttccccctcagtcaacaaaaagaaatatatgtagggtgtgagattttatcacatcaatttttaaaaactatttattcaataatgtctttcattccaaatagcatgagattttgagtctcattattcatagaatctcattattcattgaaacctgtcttggaaaatctaagagggaccaaaaggaaaattttattttctgtcttttacaaacttgctgtattcattcattttaaaatgtatttttttttttaccattttagctcttatttgttaaacataaaataaacttaaccaggtagttaaaaatatttataggtgatttttacctaataattaggttggctttctataaaaacatgtgtttacccataagagttgacaacagttatctgcattcttagtacctgtaagacttgaattcattgccacaaaatactgatcaaaatcttagtggataaaaataatatttatgtataacatttatgaataaagatatgggcattaatcactatattatcaaaagtataagcagttcacatatgtgtgcttaggttggtccattctgtcacagtacctcatctatattgttttgcttagcctgctcccattggagtaatctttattgaacattatttgggcattactgcattggtcatatgagaatgtggcacaaaaagtcttaggaaactcatttttaattatctttaggagcatattgaaagcattgttcattgcatgacatgcttatctcttcatagggattaattggaaattaatatttgcatctgctccagtctcagtctttggaatatgtgtatatcacctagtaattggtttgtatttaacttatggacactgatttatgcaacttgtcttatttagccttcccattgtctgttacatagcacagaactgtatttgttatccacctagtgccagtacattgcaaattataatatttcatgtattaatcttattttcatgttcactttccctgaccctattatcttttgaatttctttacatattaattttaatattattctatgatgcttattttattaactatccaaagtttctcttttgtaaacaaggcagtatatagcagcatcttaaaaataaacattcatctatgcattcatttggtaagtatatattgaggacttacattatggcagagcctgtataaagtgctggttttacaatggagaataagcagcttcaaggaacttcttttagagatgaaaagacatactactcaggcaagtcattataatataatataagtgttatcacatgtacaatgtccagtagtagcataaaggataaacaagtctcttttagaagacagatgctgtatcagtcatggccctgccaagaaaagcacgtcatatgcaaaccagctactttcctaagaggtttttttttttgtttttttggctttttaaaaaattattttaaagggcctgggaaagatttagtaagagatgacatagatccttgaggcttgtaccatctgggagcccttgaacacttggacctgaagagacgaaaagagaggttcaggaatccaaagaagataaatatatagagagagcaccctaaaggagagtgaaaccaaccctctttgcaaagagggagccaagaaaacaaaggctctgaactcccttgcaaccttctcttcttctagcttctggcgcctcccattggccaaacttaacatgaagccacagagaaagtgtattagtttccaagggctatggtaccacagactagatagatttgaacaacagaaatttattgtatcacagttctggaggctagtagtctgaaatcaaggtatcagcaaggttggtttcttgtgaggtttgtgaggaaaaatctgttccatgcctttctcctacattctggtagcctcagaaattgcttggcttgtagatggcattatgtcttttcatatcatcttcccttctttcatctgtgtctttgtgtccaaatcaaatgcttttattaggataccagtcatgctggattagaacccatgccaatgacctcattttaacctgattacctctgttatgaccctatttccaaatagggtcgcatgctgaagtactaggattgagtacttcaccatatcttttgcagggaggggataaaattaacccataacagcaaggagttccagtaatgtggtctaaatattaaataacgttataatataacttattatcagcaaagatacagctccacagttttcactaatcattaatcagctatgttattaaataagggaattattatgtttggtagaataattttacagaacattagggtaaagacttccaatttaactaaaactcagaaggttttaagaatattctagagtcttacttgttatagatgagattgatttagtcagtttaaatcgttcttaaattttaaaacactataaactaaatgactttgcaattttattcaactgtatgtttctgtttcttacctaatagtcatgtatcttacctaataacctatagttagaaaccttgattttattccacttctttaaaatatagaaatttactttcttaacagtatttctaattttattcccctaagttgttaaaaaaagtcatgtatccagaattacttttgctgttattaccgtcagcttcattttaagctatacacttaaacttactgtgtaaataattaaatgtatgtggtcattttcataggttatagaaatgatcattaaaacctttgttcaaaatcaccatgtgaaaaactagtgtcagatttactgatttgaattaaattatgcattgagtttcaaacctgtgcaaaatgaaagcacagtatggccctcagcatcaatctcaacacacaaacattcatcagtactatacccctacaattacttagaaggaaatgtaatttgaagcaaaaattaatcttacttaaattgcctgcagttttacccaaaagatactctgacttagtagaaatccttaaaatgtaagtctcttttctttttttttttttgttttgttttgttttgcaatctgaaaaatagcttttattttgcactaataaaaccatcaaaaaatatcttttggaaacgacaactctgctttgaattgacaacatagaccaggggctggtcaaccacagcttctctatcacatccatcctgctgcttgttttcctaaatagttgaaacacgctcatgtcatttatttacatattgtccaagtctgctttcacatctttttttttccttttttaaattttattattactatactttaagttttagggtacatgtgcacaatgtgcaggttagttacatatgtatacatgtgccatgctagtgtgctgcacccatcaactcgtcatttagcattaggtatatctcctaaggccatccctccccactccccccaccccacaacagtccccagagtgtgatgttccccttcctgtgtccatgtgttctcattgttcaattcccacctatgagtgagaacatgtggtgtttggttttttgtccttgtgatagtttactgagaatgatgatttccaatttcatccatgttcctacaaaggacatgaactcatcatttcttatggctgcgtagtattccatagtgtatatgtgccacattttcttaatccagtatatcattgttggacatttgggttggttcccagtctttgctattgtgaatagtgccacaataaacatacgtgtgcatgtgtctttatagcagcatgatttatagtcctttgggtatatactcagtaatgggatggctgggtcaaatggtatttctagttctagatccctgaggaatcgccacactgacttccacaatggttgaactagtttacagtcccaccaacagtgtaaaagtgttcctatttctccacatactctccagcacctgttgtttcctgactttttaaatgattgccattctaactggtgtgagatggtatctcattgtggttttgatttgcatttctctgatggccagtgatggtgagcattttttcatgtgttttttggctgcataaatgtcttcttttgagaggtgtctgttcatgtccttcgcccactttttgatgggtttgtttgcttttttcttgtaaatttctttgagttcattgtagatcctggatattagccctttgtcagatgaataggttgcgaaaattttctcccattttgtaggttgcctgttcactctgatagtagtttcttttgctgtgcagaagctctttagtttaattagatcccatttgtcaattttggcttttgttgccattgcttttggggttttggacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctatacatggctagccagttttcccagcaccatttattaaatagggaatcctttcgccatttcttgtttttctcaggtttgtcaaagatcagatagttgtagatacgtggcgttatttctgagggctctgttctgttccattgatctatatctctgttttgctaccagtactatgctgttttggttactgtagccttgtagtatagtttgaagtcaggtagcgtgatgcctcccgctttgttcttttggcttaggattgacttggcgatgagggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatgaaatgttcttccatttgtatcctcttttatttcattgagcagtggtttgtagttctccttgaagaggtccttcatgtcccttgtaagttggattcctaggtattttattctctttgaagcaattgtgaatgggcgttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacagtcatgtcatctgcaaacagggacaatttgacttcctcttttcctaattgaataccctttatttccttctcctgtccaattgccctggccagaacttccaacactatgttgaataggagtggtgagagagggcatctctgtcttgtggtagttttcaaagggaatgcttccagtttttgcccattcagtatgatattggctgtgggtttgtcataaatagctcttattattttgagatacgtcccatcaatacctaatttattgagagtttttagcatgaagggctgttgaattttgtcaaaggccttttctgcctctattgagataatcgtggtttttgtctttggttctgtttatatgctggattacatttattgatttgcgtacattgaaccagccttacatcccagggatgaagcccagttgatcatcttttcattagcaaattgagaaaaaaattatttaagacaatgaacacttagtatcctaattttaataaaggtaagatttttcctaacttaaaaagcaaacatacaaagtattatagtttctttgtaagatattagacttgtaaaagaaaattatctttgtctgcaatgaatatacaaagaaaaactgggtaacattttattttgcctttaatttagacatggtttaatatcgacatcaaataagtatgataaaatgaatataaatataattattttatatactaattaatatattccgtctgtacaaatccaattgcttctttaaattctattttaaataagaacaaaatagggagtaataaataaataaaaagcaaattaaatgtttaaaattatgattaccccaaactaagttcaagtaaacattattgctccattctgcaaatgagaaataggaggatgagagagaaagtaattgatttgccccagtctacagaattagtcacctacatacagtagaatttaagtccactgctacactgctctgcctcagtgctcactataatatttagtttaggtcttcttagggactgcatgtttatgtgcctgaaattcatgtgttggggccctaacacccaatacaatagcattaggtggtgagtgccttgagaagtaattaggtcaaggtgatagagccctcataatgggattagtgtccttataagaaaagaaggagagctaaccctttctagccccttctctttccaccaggtgagaatacagtgagaagttggcagtcggcaaaccaaaagaggcccctcaccagaacctcaccatgttggtaccctgatcttagacttccaccctccacaactgcaaaaaataaatgtgtgttatttataagccacccactgtgtggtaatttgttagagcggcccagattgactaagacatgtcggctaactcagtgaatcaaaaaatttactataaaatagcagattctaattcccagtttttgtcaaccatgtttcccactgttgaggtcatttgagtttctcctttgagtttctatactagtgcttaccttacataggaaggataagggagactcctttatccttcctaaactaaactccctgggagacaacagtgagtggccactgtttacttcacactggttccagtttcagccactggccttcggccttcatgcacttttcatcctgataacctgtctagtgcctcttaggacctgcactctctacctttctcttatctgtcccaatcccactacttcctctattcaaaactagtttcctgtcccttctgtgcctactgacccagccaaagagtgttctgaggataactacttgttctgaaccttgggtttggagaaatccttttttctagagatatcacttattttggtttttccattgctcctatcttgcagatacacagtgcaactactaagctagatttccttctcctggggcctagagctggggatttcatgtcaacctctcctgtactgccaatccacttgagctctctttctcagatacttatcctcatattgtaatccttgctttaggttctggtctgttctgagccaagctaccatgctcagccacagaagctgatagcatgttatcagcttaattacccctgccacacagaggtatgctccatcttatttcctccaatttgcaaagaaggaaagggaagccaattaaaatgtctatgaactaacttgggtttcagtcgtctatcagaaatctttcctttccttccttctctgcccatcattctcattctctctctcttttctccctctttctctctctctctctctctgtctctctcacacacactgacattcacatcctttcctacacagactgagatagatactattcttttgagcccagaaacttccttcacattttaaatgtctcttctcatctatctctctgaatagaatgcgaggggactgaaggcagaaagaacatgttatattaatttttttatatcttcatttgcatggcgtatagtacagagtcaataaatgtttagtggtttaaatttctgaaggtgacatggccagtaatggtggagataggatctaaacagaagcttataccatgttatcatcagcttaatcacccctgccacacagaggtatgctccatcttatttcctccaatttgcaaagaaggaaagggaagccaattaaaaagtctatgaactaacttgggtttcagttgtctatcagaaatctttcctttccttccttctctgcccatcattctcattctctctctcttttctctctctttctctctctctctctgtctctctcccatcattctcattctctctctcttttctctctctttctctctctctctgtctctctctcacacactgacattcacatcctttcctacacagactgagatagatactcttcttttgagcccagaaacttccttcacattttaaacgtctcttttctcatctatccctctgaatagaatgcgaggggactgaaggcagacagaacatgttgtattaatttttttatattttcatttgcatggcatatagtacagagtcaataaatgtttagtggtttaaatttctgaaggtgacatggtcagtaatgatggagatgggatctaaaccaaactgtgtctgattctaaatttagggttttttttttttttaaacccaaaaatactctatagtcctaggggaaaaataaatattaaattaaaaataaaatcaataagtttgctttagttccatttatttatttaccaatagaaggagggttactctggtgtcttaatcttgtaagtaaatttagggtaagcaatgaaaatctttattctcagagtattctcaaacttattagactaaaagatgaactttttaagcaatctgatataataatatattctggaagaatacttttccttcaaatatctgtctgacctaacttccctaaatcctactattactgatgtgtacttataaattaaggttctctgttctgagattcatctattaatattcttgtgaataatatcactaatagcttatatttcatatatttagtgttttagagttatatagcaagtatttcaccctagggctgactagtagcctgtatgcaccattactatagaccaaatagttttcattgttgagttttactggttgataacatattttgattaatatcgcttctgacaaagaatttttcattttgatttttggttatttgaaaaagcttaagaggagggaaaagcagacctcattataccagttttatcaatatggaattcagatctcaaggagatgaagtaaccttccaaagcagcatattaactatgctgcttaataaatcttaaaaatatataagcaaaaatctccaaaaagagaaaacagaaagatatccccaaaaattgtccctttccaaattttgccttaacccccacactatcttcaaaatctatgaactctgacaagataattcttccaaaatgtctttgcttgtgattttgagtctcaatcataagaaaaatatagaccatgtcattaaaattgaaagtatatgttctaaaggcaaatctaattggcaaaataattaaagatcacaggcatgattaggaaagtaaagacaagtagaatttagtgaagttgcccttagctttatggaattcaaaagtttaatagagacaaatgtggcaagaaatatcctactcttatgatgaattaaaacacagtaaagactggcatctacttttgagctttaaaataaaaagcaggtattttcctccttcattccagtggcattaatgctttttaaagttctcaagatcctttttcattcagcataaagaagaaaaagaagttcactgttatctattaacatattgtttttatctggttcaatgcatccaagaacacctttcctaaacatgtctttgttttactacacactaactaaaaataaagcagaatacactgtctccctccctcatgccaccactttattctttcaatatttatgagctaattagtccctaattaggtaaataataaataatgacggcaaatcagagcccaggtaaagcccaattttcatgatttcattaaacaattaagaagtagaaactagcatgagttcttggtggaggtttattctaatagtgattctgtctgatgtattttatctgaaaagcaggctcctgctcacctaaaatatgtcaaagtaataaggaaatattgtgtaatctgcagggaaggcgttagaaattaatgatgactctggaaaaatctagaaatcaggagtgtgtagaaaccaagtcattttgatcaaatccaaatggtgtctttggcggaataccaaattaaaatagacaaaatgaaaagtacccacttgaatttaaaaacagatgaacataaatattttctcaaaagttaaggtcttaaggaaatctagtattccccacagctgtcaatcacttttgatgtttcattatgaagatttactttttgcaattttacagcaccatcaattgcaaataatcaattataaatctctttgttttcaaaactgggtttatctttaatattttctacaaatttgccaaattatcccaaaccaaaggtgataaattatagatgtgacagttttacagtattgtgtggttattttagattcctcataataaagatatgtaacatgcttctggattttcctgtttttcacatatttaatttcttcttatctgtatttctatgtctaatctgttaaacataatagagacgaattaagacaaaattctgcaaacaaagcaagactgacctagaagtcagagtatttgggttgagttttgactccagtgattacggaatctgtaaccaggtaaggcttttgcttctcagctctttttttcagagcagtgaggcaaatcaggtgccactcctaaatcatgggcttaactcatgtttgaaaacactttataaatcatacagcactgaacacactaaaacaaaaataaacagaagcctgccttaagtgacattgtacaacagcaacacaacattagctttcagtaaacctgagcaaatttaaattttttaatatgtcactttgtggcttggggaaatgattgtgtttttatatatatatatatacatatatagtttttttttttaaaataaagggtgcttttttgagtggcaaaactattggctattacacaattagtaaggactatacattaggcactttatgatgtttcatagttacagaatcctaatatgaattctaagaacaaatattttggggtaaaattttagccaatgaacctcttaggttcttggcttccaagataattatgatctaaagaatactcttcatgctcatactaaggacctttcaaaataacaaagtttaactttaattaatttccattttccaaaaagtgaataaactaagcacttcctgtgtgctaacaaatttaaattttgcactgactctgtgtggtaggttctattattaacataaccatttgacaggtaacataaatgatagaatggacaaatttccatatctttcccaaggtcacacagctaataacaagtcaacaacaggagttacccagacatcctggatatagctgggaaaagaagcaaggatagacaaaaagactaatggtggtggtggtagacaggtttttctaaaaatggaattttggatataaatgccaagaaatatggggtgtagtttctggatgtaaaattaaagaaatgctaacacacatacacacacacacacacacacacacacaatcatcacatgaaaaaaacagcaataatggtcatgcttacaattgtatcattacttctactccaaattcagttgtttcacatgaataatctatggcaacagtgaaactgaataatccctgataaatttttcttcttattgactcttccctttgaactggcactgttattgctacttcttaaatgtttctctaatttgttctgttcttttctcatatctccttctaccattccttaattgcttaattaattgcttttgtttggggccttgaaatagccttcccactgaaataggggactctgctcacttcagactcctctgttgctattgccattattgagtctttgtaatgccttcaaggttatctttgtccataaatctgatcctggtactctactagtcccgtgtttttaaagaacaccctctgttgtcctcagaatacaattcagtagccattgtgttgtgtaagtatcccctacttcccttcccctttaatttatcttgccctttcttcatcatatggaccctctgtcagccacacttgccagtacctcaagcatacaattctctgtcattctgatttttttgcctgctagaataatttttgtcttgtagtttactttgtaggctctgacactttttttttcaaatatgttccaacatgacatctctgaggcttggcacggtggctcacacctgtaatccaagcactttgggaggccaaggtgggcggattgcctgagcacaggaactcgaggctagcctgagcaacacagtgaaaccctgtctctactaaaatgcaaaagaacagccaggcgaggcagtgtgcacttgtggtcccagctacgcaggaggctgaggcaggagaattgcttgaacccgggaggcagaggttgcagagagccgagatcgcaccactgcactccagcctgggcgacagagcaagactccgtctcaaaataaaaataaaccaaccaaacaaaagacatttctgagatgcttttcctcatcataattaatctttctctcccctatgtttccataacactttgttcatatgatttttagcacttgcctcatattaatgatttgttaaatacaatttacttgactagactgtaggctcttcaaaggcgaggaccacaaatcttattattcttaacaaaacagaggctaaaacaattgtggtcatgctctatagcatagaaatgtgaagctacaatactttattgcttttatgtttgagcagacaaaaatgtttcaagataatattgatcattctagcagccttctatgtgggcatttttgttagtttactataactttagaaaagaatgtgatttccaacctttaagctattaaaaatttgttattgtaaaatatagccaattataacataagaatcatttacagtcaattttttaactaaattgagagaaattataattatggagcatggctttaattaagtgtgttcattctatctatcatctcttcttggaatgaggcaaaatctacccttaaattaaaacaaataatcagagttttatatatgtttatttatatcacaacatatggtactaaggcacttctaaactgagtattaagagattatcctacagtacttgttgtccttgagccaaagacagtggtcagaatctctgtattattttcatttgaaccagtgtacagtattctgagttttttatagaaaggatatttttattatgcaccatttaatttatttaggcagtgcttaacccgcacttttccttgcaaatggaactttgtgaagaaaaatttgtgtaattcattgagatacaaaacattccaaggaataggttctcttttctcttgtaaactgcccttattcaaagtggctgtgagacaaaggaggtggcatgaactggctctagagaacatgtcactgacagagacaaatgagtcttaatgagttcaggggaattctgacagctaagatttcgagctctgaggaaagaactactgcatggaggacacaattctgaatcatgccaggttcagagtaagctttgcagaaatcagcacaattgatgtgtatggtgtgtttgtttttctgaaaagctttttacttttgtagaaaacattgcacatttgtaaaatgaggaccaattagaaaagtaaaaattcttacttgttcactataactcaaaaatataatcaatccacaaaaaaaaactcataaaagcaaaatcatctaactaaaatcttagactccaagtcagttcctttctctctcctctgagtttaggcttattccagggagctgcctaataaggccggttcatggcacctgctttgtgtcaccgccactttgaataaatgtcatttccagtttctgtaactatagtgatatgatgatgcccagctcttcctttgtcaaggattctgatgactgtctcatatgtactgactagcctttccaaggtaggtgatacccctttagttaatatatgcattaatttactccaacattctgtaagaaatagaaagtgtttttattatgccaaaatcctatgtgcccactgaatggcccatagctataccatatggagggcacagcaagaattggagaaaggctctcccttcaggctaaaaaatataggaaaaaaagtgttcccataaagagcagaggctgagctggagttcagttttttctcacctctcaggaaagggctttttatgtgttttgtaaactacacaattcctagtggtgacattgtcccaagaagacaaagagacctgacaatagggtcattagtggagtgcagcagggcacagttctgtgggctcgaagccatctgctaagtgggcagtggaggggagaagagagaacaaggattggcataatgttggcacccagctttaagatgtattatctaaaagtttttgagatttataagaaaatcctgttctactgagcatagatttctcatttcagccacctattgattactacctaatatccatattgtgcactgcaagatgttgagccgggtatggtggctcatgcctgtaatcccagaactttgggaggtcaaggtgggtggatcacctgaggtcaggagtttgagaccagcctagccaacacagtgaaacacccgtctctacaaaaaatacaaaaagtagccgggcatggtggcaggcgcctatagtcccagctactcggaggctgaggcacgagaatcacttgaatcacggaggcagaggttgcaatgagccaagatcccgccattgcattccatgcattccagcctgggcaacagagtgagactgcatctcaaaaaaaaaaaaaaaaaaaaaaaaaaaaaaaaaaaaaaaaattaatacaggggtttgacagaggtttgctgtgagaccatttctgcctgaaaatttagagcaatcctaaagggctcctgaagtgtataatgtcataactattaataatatgtacaatatgtcaaagaccaattgttaagcaatggcctgataaaagtttatggaggaagataacggagacagacttatgaatgtagcttaacagcctatacgagattctaagccaaaaaaaaaataaacattaggctcatcttgtatcaatttgttaagcgaaactggttggcataagtgattttgataatagaagagctaacctgctaaccttatattttgaattcatttgctaaatagccaaggtgaattaattacaagcatatagtttcttttcagagcagagggagaaaaaaggtattaatccaaatggaacatttcttccaacctataaaattaaaaatgtgaaaaaccaatttaagaataacaacatactttaacaggcacatacattaatcacatgcccgacttgaaagctattgaaacagtaagacttggcaattctatccacccaaaataaaacatcagcattcttctcagagttacaatttatatgctgtgaaattaaatcacgcactataaaaccaaaaacaatagcaatatgcctttattttaaaaaatgcaaatcataggatctttaaataaagtaaaaaaataaatcagtgctatttagaccctcttacattgaaatataaaactagggactatcttataacacaaacataagaaatatgtttggccctaatttatataatggaagagaacgtcttaatatattatttgatgatatcttctcaaatgagaaatataatagagaagcaggctgggcatggtggctcacacctgtaatcccagcactttgggaggccaaggtgggcggatcacttgaagtcaggagttcgagaccagcatagccaacatggtgaaaccccgtctttacaaaaaatacaaaaattagctgggtgtggtggtgggtacctgtaatcccagctacttgggtggctgaggcaggagaatcgcttgaacctgggaggtggaggttgcagtgagttgagattgtgccactgccctccagcctagggaacagagccagacaccatttcaaaaaaaacacagaatgaaaggaacaaaaaagaagacaggaatataataaatataatagagaagcaaatataactcaataagtctcagtgttcattgttctgcatcaaataaatatttttaataccaaggaattttccatcatcttttcagtgataaagttaaacaatatagtctgcaatatgaaaatatacatacagattatatgcattatatacactgattatttttaatcctttctggtaatccgattccttcagactcttaagtcttcaatgtcttgtaacaagggtctcttaatgaaaaaatctctcagtttttgtctaactaaaaatttcttattcacttttaccagttaaggataatttctatggatacagaattctggttgacagtgttttggttgttgttttttagttttgctccccatccctttaactttaaagatattattatattgtttcttgtgaaaactccactttcatttgtattctcctctcactctatgtaatttcatcattttctccttcattttagatttcagcagtttgactatgatgtgtctatatatggtttggttttcttcctttgcatttattatttttggtgtttactgtatttttggatctgtaaattgatgtcttctgggaagttttcatctaattttcctttaaaacattttttctgccccaattcctctctcatcttattctagaattccaattacattatgttagaccacttgcattgtttgtgagtccatgctcattattcttccatttttttcttctctttcacatgagaaaagttccatcttcaactcaactgactttatttcctgtcaccgccaatcttcttttaaacccacacagtgttttccttttttcatttcagttactgcatttttcagcattagaattttcatttcattcttttcatggcttatatttctttgttgagattaaattctgtgtgtattcattatattcctttttcccattaagtccttgaaaatgtcacttctctaacattcttgtgtgctaatagaaacattttaattatgtcattgtcacattctatccaactgcttgttttcttgagtataggttaattttcctgtttcttcatgtagctactaatttttaattgaataataaatagtaataataaattgaaagaaaatctggattttgttataattctctgaaaatacattttatttcaagaggtggtcaatttcgctaaactagaactccaagctcagcatcccataaggttggcagcaggtaaagtcgccaatcagttattacagttgctaacagctgctttcccctgtttccctgcaattgcatgcacaatttctcaaccagcatgcataatttctaggtcagatgaagttttagggagattttgtactaaaatttgggtgttccatcccttctgaggatccctccttctcaaaggatttgcctttaaatttgtggctctttttccagttctaaggtatgccctctgacagcccaggctggtaatgctgcagctttctgttctcaagactgtaatagggtactgccttaggcataaaaaacaacatcacaaggtgcagtttctgtcttttccagtaaatcttatctctgactaacctcaactgccctcaatttttaaaaaaaatatttctttcagtttatatgatagttatctgctaaagttttaccaagtaaaatcttcattattaaatattttacattgctatttaagctattttctggaaaatcctggtacacagctgattatgcatttttttttgtttttttttaacaatacctctgtttgaaaacatttgccaaacatgttagatattgattctcctgcaaaaaggttggtgttttactgttgtttgtttcactaatttaaagcaactctaagtctttttttttttttttttttttttttttttttttgagacagagtttcgctcttttgcccaggctggagtgaagtggcgagatctcagctcactgcaaactctgcccccgggttcaagcaattcttctgcctcaacctcccgagtagctggagttacaggcacccgccaccatgcctggctaatttttgtatctaggtcttttattcactctgttaccttcctatcttcttctcttcttacttgagtatttgatctggtccttccctttttcccaatcactctttgtgctgttagccatttgactacaactatgtaaagaacctacagagaatcacctaggaaactgagaatgtcaattttaaaagatagtactgactttgtagtagactccaaggtcaatggatctttgacagaaagtaccgtcctttggctgtgatatgaaaggagaattagtattattgatttaacagtcctagtagagattatactctccttctgtgcaataacagttaaaaaaaaaaaaacaaatctgcatagttaatctgtgttaagaaaggggtgcaaaatcattattaatgccactaactgatttctaaagtattcctaattctaggtgagctttcaaaatccaaatgaaactaagaagtgatcttctaattccaattcctatcatatacaatttagaaatattaaattcatacttttagtagtaaattaagcaatgggtttaaggttggaaatagagatcctctaattgctgtgatgcaaagatctcaacttttaagtattacatttaaaataaaattaaaatatcctctctatccaatcatcataataataagaagcatgtattgtataacagctaaatagaaagtaatatctaagatggtctctacgtacattactatttattctacaattccttgaggtaaatacttgtcataattttgcttattaggaaatgcaatttcgtgaatctaaatcatttgcccaaggttacatagtaagtaagtgatggaactaggatatgatataactatatatcccatgctctttctaaatgcctgataaaaaggcttggtctgagtttatttacttcatttgcaatagtcaatgaatgtttttaaaagagctgtaagattaaaaatacccaaattgtataaagaggtcagatgatacatccaaattataaaatcaatgtacattatcgaattgacataccaatagaaaacacacacacacaaatttaaaaaaaagatttcttgtagcaagtgaagagccaaagaaaaatcatgtttattaaattgcactcaaaaacaattttaaagtattccctggtcctggagtgatttgctccaattgctagtttccaggtttcaggtactgtgaaataagattcctaagtcacatgttaattttgtaccagtgggctctctttcctttctcaatgaaacaatcgatatttttccccatccttgtcttcctaaagaaccagatttggaaagaaaaatcaactgcttaagatttaaagcgtaggttcaatactttctatttgtaacttagcagcagtcacacaaatctcaaattctactaaattgattctaagcatgaatatctgcatctgtcaaatgcggatgataatatctacttcttagacttattttatgtattaaatcatacagcttctgccacacagtatattttcataaagcttagttgctttcttttctccttccttatttccatatggtctattgttatttacaaaactttttattttaaaactttaaaatgagattatatataatagaaaatattattaaagtagaaataaaatattattaaatattttaaataaggccgggtgtggtggctcacgcctgtaatcccagcactttgggaggccgaggtgggcggatcacgaggtcaggagattgagaccatcttggctaacacggtgaaaccccgtctctactacaaaaaacacaaaaaattagcctggcgtggtggcgggcacctgtaatcccagccactcgggaggctgaggtaggagaatggcgtgaacccgggagacggagcttgcagtgagctgagatcgtgccactgcactccagcctgggtgacagagcgagactctgtctcaaaagaaaagaaagaaaacaatattttaaaaaatattattttaaatattttaataaaatatttaatattattattttaaatatataaaaataaatgtacaattccactatttgagttgaatataatcattttcatacacacatatgcacacatatacatacatacatatttttgcataattctaggcaaactaaatgtataatttttttacttgcataaacagcataaggaaatcccattgttttaaattgtgagatatatatatatatatatatatatatatatatatatatataaaatgtttatcattgtcaggataggccttagtttacttaatcaatctccaattttagggtatttttgttattttcaattttacataatgataataaatgctgtaaaaaacatctttgcaaatagtgctatttatctcttttgttgttcattcagatagaatttaaatattgaattaaagcagtatacaaattttaatgctcgagtttcaactgcttactgactttttcagagacttatgccaacaaatataactacaaaaaatgtatgagtgattttttccatgtaagtactccagctttgacagctcttatctcataatcttctgcaaaaatgaataaaaaaatactgtcttactattttactgatttttttttttttttgagagagagagagtctcactctgtcatccagactggagtgcagtggcatgatcatggttcattgcagcctcaacctccccaggctcaggtgattctcccagctcagcctcccaagtagttgggaccacaggcacacaacaccatgcctggctaatttttacatttttctgtagagacagggttttgccgtgttgcccaggctggtcttgaacttctgtactcaagggatctacctgccttggccacctaaggtgctggcattataggcaggagccaccatgcctagcagattttttacaattgaatttctataatttaccctgtgtttgttatttccatgtatttcataatatgtaaatagcacatttcctttattgtttgcatttttctaatggcattttatttacttttttctaattgagctgttcaaactctacatatcataattttaacaatctgataataatagccaatgtgttctccttgatgaaaataagtcactgtgtatttacctttaaattctagtaggcattttcaatcgcatgttcttaaaatttacaaagaaaaaaagtatgtctataacatgaggtgagagtatgtattctatttgtctttcttctatataatggaatacaactgaaatccaaagggaccgacttatcctgatgaaacacacaaaacttatttagtgctcaccacaaacttattttagccatgcagaaaaaagaaaaaaaatattaatctaagaggagaagacctaaactattgccctattacaaactgaaaaagaatttgtgggctgtactccacgtacaatggtacaaaatgtttatagaaattaatgtatagaaactaatgatggcagtgtcacgttgtatttataattttcccttaagtgctttcctaattctgaaaaaaaatgcagcaaattattgatgatcaagttgtacattatcaccagatctccagagctctgttctctagttatcctgaacatgacttgccatgcgctgcatagtgttaccctgccttcttgtacactcctagaacacctagccccgtccctgtttaaacctacctggcctcaaatctgtttaattatcccttccttaaagatgccttctatgatccttttgtacttggttaagttaaattgctgtgttctttcattgaatcttgaacttgtaaccattgcacttatcacactttatcatttattttttgtctgtcattcccagtaggaagagaattaagcaatggtttaaaacatgtaaaatactgaacagaattacaaaatctgtaacacataatgtgcatttaactttgagatcttcaaatattttcttttacaaaacttaaaaaacagaacactgtggcttactgatgtatcttttcttcttctttgggaaggggataaatagtaattaaatcctaaagataatgggtaaaagaaaaagtatagagaattcatgaaatgcaaattcaaatacagaataaaaacaaataaccacaagttaattagcttaaacataatgaataactttaaatctttcccttgatcagctgtgactttgaaacaagaaataagctactgagttgccacattataacgtaaacatatttgtggacagaaaaatataaaacactgagcaatatatgtttaaacctacattaaccataacatagattaattaattaattaatatatttttctataattccactcaagtgaaagagccagataactggaattaaaatacgaattaaatgtttagtcaaataatgttgaaaaaataacatgtcattaaattcaggttaaattcagtcaaattctttcacacatttttccttcctaaccagtcatataaaggctgaaactacacacaagcaatgtcaaaataaccaattactgtgcaataaaatatagttttattctatagtattcataatgctccaaactcatttttgcaatttcccaataagttgattaatgctttttctttgtattttggacaagggtaaatatttctgatcacatcctggtatttgactctgctgtatgtcagaattttttttctggtgcatattttttcttcttacatatctgttaacatagttttagcactatttttagccaaggaaaagaaaagttaaaaaaaaaaagattttcagattagcagttctctgggaacattgctgtgctttctaaggtgttactttgatgaatactacagtggtgacagcgagcagaccagcaaaagtgttgctgaaggacaaatgccctctaataaacatagctaagaactactacacacaacaggcgtgaaattcacccacgaggactgacttgtcctgtgtactttccagtgacaggatttctactgtttaggttaggtttgtgtttccaacagagcttagctgaaatcacagattttgataaaattgggagaagctattacactgaaatatttaacatcacttaaaagaaaatgctatagtcagtgtatgttcaagcaattggagacttgttccatatgggacagattgaagctgtttttagaatatgtttcattgaatataaacacacaatagaaagatacagaggtatgcaaccttatgcctttgtgttataattctaaagtatgacaacatttttaaccaaagccagctatgattacattttgaatagaagatggtccccaaagttgccaactgacatcttactctccctctctgagaagtaatatgcatttaattttatgttctttttatacccataaggcatggacaaacattttaagtttatatgtgtattcataatgattgttgcttcaatgaatttggtaaattaacaagaaagcatttcaaaatgaaaatgacaatcaaaactaatatgtaccaagaaccaaagatttactttcagaattaggaaaattaattacgatctatctataacatagaaggagataaaaaaaataaaaaaataaaacctccccagaaaatattgggaaaaagccattggaattttgttttcttccaaactatgatatactatgacttgctttagaaatgacatctcatctgtcattccaattctgttacaagattttatcttcttgctaggatatacaccattgaaaatataatcttataccttgaaacccataaacatttaaaaataactatataaagaaattaatgagtaaacaaataaatgaataaatttgctgtttttgcttacttccaatccagctctaaataatcctccagatgtatggcaatcaattaaaatttcctaatcctggtaagctgaatatcaaggaagtacagcttccatacaatgtgtattaaatcactgaggtaatagaaatgctggcaccatttttaaaagcctatgtaaaaatctaaacacaggaacatgtaaaagtccttctatgctcatactgcttatttcctttccagccagggcttaagttattttctgtgacatagttagagatactgcatattatgcaaatactcttgcctaaataattcttagatattatttttatttcacgaatatgatcaatatataaagcagatagagaagagtcatggtgggaaggtgagttgtaaagagattaagagaagatgggtacaaaaaaaggggcagattaaatatgtatggctacattttctgacttataatttcaacttccattattccatgattttgaaattgtttaaaacaaagggcatcaaatacttatctgcttccaagagtctggagtaccttagcattctgaggaataaaatgtattggtactatccatgtaccatagaaagaatgcctttttagaatatacttattttgctaaataaaaaataatgtatgtacagattattaaatataaagtagtacaaagttcagaatgaattagttttcattatccttaagaaataaaaacctagtaaatcacagagaaatttctagaatcttgttaaatcaataggttagttttctatgtaaagatgagtttctagaattttaggttttctacttgttcgtatttagaaaatcaccagttacctcctatttgacaaagcaaatggcatcttctgaatttttttttaattatactttaagttctagggtacatgtgcacaatgtgcaggtttgtcacatatgtatacatgtgccatgttggtgtgctgcacccgttaaattgtcatttacatttacattaggtatacctcctaatgctgtccctcccccctccccccatcccacaacaggccccagtgtgtgatattccccacctagtgtccaagtgttctcactgttcaattcccacctatgagtgagaacatgtggtgtttggttttctgtccttgcgatagtttgctcagaatgatggtttccagctcatccatgtccctacaaaggacatgaactcatcctttttcatgactgcatagtattccatggtatgtatgtgtcacattttcttaatccagtctatcactgatggacatttggactggttccaagtctttgctattgtgaatagtgccgcaataaacatatgtgtgcatgtgtctttatagtagcatgatttataatcctttgggtatataccagtaatgggatggctgggtcaaatggtatttctagttctagatccctgaggaatcgccacactgacttccacaatggttgaactagtttacagtcccaccaacagtgtaaaagtgttcctatttctccacatactctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttttgagaagtgtctgttcatatcctttgcccactttttgatggggttgtttgatttttttcttataaatttgtttaagttctttgtagattctggatattagctctttgtcagatgggtagattgtaaaaattttctcccattaggcaggttgcctgttcattctgatgttagtttcttttgctgtgcagaagctctttagtttaattagatcccatttgtcaattttggcttttgttgccattgcttttggggttttagtcatgaagtccttgcccatgcctatgtcctgaatggtattgcctaggttttcttctagggtttttatggttttaggtctaacatgtaaatctttaatccatcttgaattaatttttgtgtaaggtgtaaggaagggatccagtttcagctttctacatatggctagccagttttcccagcaccatttattaaatagggaatcttttccccatttcttgtttttgtcaggtttgtcaaagatcagaggtaccttctgaatttttaactcttcacaatatgtgggacactgttgactatcacctccttcttgagacactcttcccctttcactctgctagtaaaatatcattggacttcctactgtaatatagaccccattttctctgacacctcagatgtgttttagcttcattcagaataaatatgtatatactttaatgctccgtgtaatcttcatttaagcattacatacatactctctgcttcaatgatggtttatttacccaatttaactcattacaatgtaaatgatttgtaaatctgtatctacatttgtaacttcacctgtagcctacaatgttacattataattatttgatagacattttctcctcaagatttccagtatcttcttaaagctcaacaagtctacaaataaatgcataacaattcttcatgtccaaacctattcctcttcttttcttctgttttcttaatgtttcccacattaaatttagactccaattggcctactgatacataataaaaggaattttcctcaatactttctttgcaatttattttatatatcacttttttttcatttctacttcaaatcagcaagttttaaaaatttgccttgatgtttaaatgttgcaaatgctttataatcagcttctatatttacacttaccacagtgtaatatccaaattctggaccatttagaaattctacaatgacacctaaagtgactttccggacacagctcctaaaacttatctgtctttctttgcttcaaagaaattaagactgatgattccctaagtgatttttcatttcccatcttagttctattacttcgtttctttataatttcacttttattaattcaaataaaatttcctccataatattttacatctctgtctctctctcctttcctgtattcttgggggattttgctttattaatttataacgcacctatcctatatggcttcaatgttgtttataatagaatcataatctctcagaccagaagacaccttaaatatcgttattccaactatactatgctatttaaaatgatcttgtaacatggcagttcaattcttcagaaacaagttgttttcacgagtagaatactttacttattagaaaagtattacttatattgaaccaaaatcctctacagattttcaaatgtatgttttcagtccgcatcgtcttagtttccctctcttctatgtctctcagtcttcatttctgacttgaactatttcattaaccttttaaccggtctctatgattctctacattagtacaattttaagaatgcacattaatcatgcaaatgattttactaaaatattcttatgacaaaatctttaataggttctttattgccaactgagtaaaatctaaattgttaatcttttaatagatccttcatgatatgtctccaactatattgacagaatatacacgacacattgactatatgaaagaagtaaagaaaaggaggctaactcatacatttctggattgagcaatgaaagacaaggagctactagaataataaaacacattggaagggataatttgtgaaggtgaatttctgatttttgctctattcaatatgacttagcaatttatattaaagtagtaaagtaagtattgacagaaaatactagcggagagagtatccatttactactagcggagtatgcgtttaatactagcggagagagtctgcaagatcaaattagcagtcaccctactcatttcaggctgagctttaatgtagaatttgctgctcacctatcctcttcatatgagttattccttatctatatttaacagtttacgttctgagcccaagtgcagaacaaatatcaatgtatattaaaatgtatctcatttgatttaacaagtcattattttgtactgcaattttttaggttctgatactgtgtgtcaagccatttttttaatacatcagagatatgtgtcatctgtgaatttgataagcaaatattcaatgtcttcatgtaataaacatataaaatgctataatggataggtcagagaaaagagacattccactagaaattgcctttcagactgatattaatccttttacgcagagattatattgatatgttaatccaatatttactagtaaatacactattaatcacctattcgtatctgtcttgccacaagatgatttttcaaatcactatttgtgttctagatataatacatcatatcttttcctttggttgaccagaataaaacattatcagagatataacaggattattttaatattacatgctcaagtagtaaaatatcataagcctctactaatttcctttattcagatatttaataattgtgttttaataattaactctagaattgcctaggttttattaacaatctactgatacacatttcttatcctgccaattaacttataaacttaaaaaaaacacatactttctgtattactttacttttttttcaccaagactacaatcaatgccctaaatatagagtaagaattcaatgaatatactttatgtaaatgagttttctaagcctagatttaacacaagaaataaatgatgatcatctggattaagagatgatataagagtttcaactttgtgtgaataaagagaaaagtcaatgaacctcttatttatcaacagcccttcatgctaaaaactctcaataaattaggtactcacgggacatatctcgaaataataagagctatctatgacaaacccacagccaatatcatactgaacgggcaaaaaactggaagcattccctttgaaaactggcacaagacagggatgccctctctcaccactcctattcaacatagtgttggaagttctggccagggctatcaggcaagagaaggaaataaagggtattcaactaggaaaagaggaagtcaaattgtccctgtttgcagatgccatgattgtgtacatagaaaaccccattgtctcagctcaaaatctccttaagctgataggtaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaatctactttaaagttcatatggaaccaaaaaagagtctgcattgccatgtcaatcctaagccaaaagaacaaagctggaggcatcacgctacctgacttcaaactatactacaaggctacagtaaccaaaacagcatggtactggtaccaaaacagagatatagaccaatggaacataacagagccctcagaaataatgccacacatctacaaacatctgatctttgacaaacctgacaaaaacaagaaatggggaaaagattccctatttaataaatggtgctgggaaaactggctagccatatgtagaaagctgaaactggatcccttccatacaccttatacaaaaattaatccaagatggattaaagactcaaatgttagacctaaaaccataaaaaccctagaagaaaacctgtgcaataccattcaggacataggcatgggcaagtacttcatgtctaaaacaccaaaagtaatggcaacaaaagccaaaattgacaaatgggatctaattaaactcaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaagcaaacaaccccatcaaaaagtgggcgaaggatacgaacagacacttctcaaaagaagacatttatgcagccaacagacacatgaaaaaatgctcatcatcactggccatcagagaaatgcaaatcgaaaccacagtgagataccatctcacaccagttagaatggcgatcattaaaaagtcaggaaacaacaggtgctggagagtatgtggagaaataggaacacttttacactgttggtgggactgtaaactagttcaaccattgtggaagtcagtgtggcgattcctcagggatctagaactagaaataccatttgacccagccatcccattactggtatatacccaaaggattataaatcatgctactataaagacacatgcacacgtatgtttattgcggcactattcacaatagcaaagacttggaactaacccaaatgtccaacaatgatagactggattaagaaaatgtggcacatatacaccatggaatactatgcagccataaaaaatgatgagttcatgtcctttgtagggacatggatgacctggaaaccatcattctcagcaaactatcgcaaggacaagaaaccaaacaccacatgttctcattcataggtgggaattgaacaatgagaacacgtggacacaggaaggggaacatcacacaccggtgcctattgtggggttggggcacgggggagggatagcattaggagatatacctaatgtaaatgacgagttaatgggtgcagcataccaacatggcacatgtatacatatgtaacaaacctgcacacagtgcacatgtaccctaaaacttaaagtataatttttaaaaaaaggtaatggatgagtttttcattttaatagatgatttctaaagttttcattgtgaaacacatatatttggacttacctaaatgttagcttaaacttgaaaatgtgaccatcatcttcaaaaagcatatttaatccattgtggtagcaacaataaaaattcacaaatctcccatctgcacttgcttagaagagaagtataaaactcatttgtatattaaagttttctttaatgtagtttctaggaaaccattcataaaatcacagctgcagctaatttccatttctatggattttgcatttgttagaaatagagaaaaccgatcatactatttttgaaagccatgcacagaaagccaaattacataatcttaagcatacagatcttaataattcacaaaatgacaactcattatccctattcttaaggaaaactctgatgcatattagcattttataataatccattatatctatctacttcgctggcctaaattttgggaagtcacttcatattcagtgatacgcatgtctgattgtgagaattttctgcccaatttcctggctaggtattacaatgaagaattggtcagtaagcactaatagacagcaaactaatgacgaaaaaagtgaaaaatatattatgctcttatctattgcacatctaatgtcatatcaagcacatgaacaaatgaaaacaaaagcagacttcaataaaatctcccaacctttttttttttagttacatgtagaaatatatccaagagtttaagtttctagacaaaaatgaatgatatcccaagatactaataaaactctcaatgtcaacaaggacatgatatatttgagcaatcatggagaattagaaaatgatagaagattaaagatggataaaagttttctttattttcaaaaaagaaggtaaaatactgcctcacaaagggcattgtttattcagattataatcaatatcataatacgaaatttcattgctaaaggaaactttcatattatattctacttagcagtaatacctgtttccaacaattatctttctggtgttttatctgtacaattttgtgattgtggaggattactccgaacaactctataaaggatttataacaaaaacaatcttgaatataatgaagaaaattttccatcaattaactactgttcaattacgtataaggtataaaaactgtctggctatttttaaaactaatttaacctattatttgtaattagccaaaatggtaatagattaagatgcacaatgccattggttttataaaagaatatatccaagccacaggataaattgaaaatatatacacagtgaccattaattgtccactcttagaaatttttgccacaattttaattacacctcaggattatcttatattctttgagagaaattcatgaaggagatagtggttaacacaagcagattcatcctcaaattttgcatctgagcttgagctaagggaaaagctggtctataaataacatctttggcgaaatctgtcacatatctccagaaactgcaaaggcttcattaaatctgacttctccattaacttcagcagcagtacattccctctttaatgtacttcccatttctcaaactgtgaatttataatgaaatgattgtttacatagtataccttaaaaaacaggcagccatgaactcgcataatatggtagtcaacaaatttaacagtattttatttcaagtagactttaaagttttcctttgcagtgcagcaatataatgcaactgtggaacaaaaaacttatcatgtccacatattattttagtattatttatttagtatttccatctataagtatcatcaagagaaagtcctgaagtctgctccttcattaaacaggacagacttctatggtaaagctatcatcattgcatttgattttggactggaaatgtaacatctgaaagagctttttgcttttaaagagttaacagcttcagtaagcataattggaaaagtctagaaacatggtatatattttactcatccactcaaaaatagcatttagcttacagaagtgaaatctcaggagggtcattacaaatttttgtaagcttatcattaaaattcgtaactaagagttgtgttgaagacaagcaaattttggttcaatataaggataaatggactctacatggcataatgtatatgataaaaggaagacactgggaatacgaaatcttttaacagtagatggagacacaaataggagatcagataaaataagaataacattaatcacaatcaaagtgaagttcagaaaattgcacctcaaaatatgccattttgatatgctgattacttcaaactcagagcacctgggaaaagcacaagcatgaaggggctttccctgaactctgcttatttacctaaagaagtcacatcctctgcctcctctgaaggaaagaaatgtaattgtcctaaatcacctgcccagaaatctcatcaatcaggaaagattaactcctatcacaggaacggtgactggggtggacgtccatccagacagatgttgtcacaggctgtcacatattcttctgaggccccattcatctttctcaaaaatcatttaccgtcccctagattggctacatcctctcttgcttttcccctaagaaaagggtatatgtaagcttctagatctcactgaggctgtgagtaatcattttttggtcatatgatgcccctggacacactataaatgcgtatactgtttttcttgttactctgcctgctgtcagtttaccttatagactcaaatttatcactcagatgataaagtcttccttcccttacaaaataatataaagttgtcccttggtatccatcccccacccatagggtattggttccaacatctcccatagacaccaaaatccacagatgctcatcactgacataaaatggcatagtatttgcatataacctatgcacagttcctcataaaatatgacatagtatttgcatataacctatgtgcatctgcccatataccttaaatcatctccaggtgacttataatacctaataccacctaaatgctatgtaaagagttgttatactacatttttacttgttttttaatcctttcatgctgttttttattgattttttcaaatatttttcattctcagttgttgaaatccagaaatacaggacccatgaatgggagggccaactgtacctggaagtcacatatgccccttactctaagtatggcaaaagtgaaagattctattagtcatattctcccaccatctgttacagatctgtgtttcttacacattaaattattactaaatcccaacatccaagttagctatggaattcctggcctttcctcactacagcactggctcatttcagattttaaccttttctccttcactgatagttcattgcagagtccagataggccaaaatgaagttctaaattttgaatgagtcaataagcagttattgtttattatcactgacagataggcccattgaaataatgattaggtatcttcataaaattgtgactacccatgcattaagtactcataatgggtaattagaagtcacagacattctcaggttaggaggaaggttgaattagaaggctactaagttcccttataatccaaatattctgtttttcatgaccctgataaaatgtaatctatcaagctattattaaataaatgtattaccatcttgcccacagtatttacacttaatgaaaaaataaatgtaatccctcctaaatggaacctaaatccatttaggttcaggcttgatctgagagaaaaggcctcaacctagggttattataattgctctcttcactacagaaacaatgtctgatagatctgaaaacctggttgaaacaactaacaaaagctattccacattacttagctaggccccctacagcctaatccaacctgtggggattcaggataatacttaaggcaagcaggagaaaatcaacaaaaccagtcatatcgggcaaggagttatttaattgcccatgaataatcagtgtatgtgaaattttgctaagggcaatttgaccttaaaatgtggttatctgatctgaaaaactttctaactttcttctgtattaaagaagaaggggtgaaatacatacaggagcatctcaccccttctttgacaattaagctttctctgagattcatggaggctcagaaactatggagctcaggcataaaatgtaaataagagatttccttttaatgaaacacattttactgctgttttgatatggctgctccaaaatccccctagggcaacacacccaaagcaaaatattctaggaaattattgctagagcaatcagacaagaaataaataaggggcatccagattggaaaggaagaagtcaaattattcttatttgtagattatatgattttatatttggagaaacctaaagactccaccaaaaaactagcagaactgataatttcagtatagatgcagaatacaaaatcaacatacaaaaatcagtagcatttctatatgccaacagtgaacaatatgaaaaagaaataaaaaaagtaatcccatttacacttgctacaaataaaatacaatacttaggaacaaatttaaccaaagaagtgaaaaaatctctataatataaactataaaacactaatgaaagaaattgaagaggacaccaaaaaataaaaatatattctatggtcatggattgaaagcatcaatattattaaaatgtccacactacccaaagcaatctacagaatcaatgcaatctttaccaaaataccaatgacattcttcaaagagctagaaaaaaattctaaaatttatatgaaggcacacacatacacagagacactagccaaaactatcctgagcaaaaagaacaaaactggaggagtcatattacctgacttcaaattatactacaaagctatggtaagcaaaaacagcatggtactagcataaaagcagagacatagaaaaatacaacagaataaacatacacacagagacactagccaaaaccatcctgagcaaaaagaacaaaactggaggagtcatattacctgacttcaaattatactacaaagctatggtaagcaaaaaaagcatggtactagcataaaagcagagacatagaaaaatacaacagaataaagaaccccaaaataaatccacatgcctacagtgaactcattttcaacaaaagtgccaagacgatacactaaggaaaagacagtctcttcaataaatggtgctgggaaaattggatatccatatgccaaagaatgaaactagatccctatttctcaccatatacaaaagtcaaatcaaaatggattaaacccttaaatctaagacctcaaactataaaaccactaaaagaaaacattaaggaaactccccaggacattggactgggaaaagattttttgagtaataccccataagcacaagcaaccagagcataaatggacaaatgagatcacatcaagttaaacagcttttgaacagcaaaggaaacaatcaacaaagtaaaaaagacaacccgcaaaatgggagaatctatccttcacctgtttattaatacattaccaaggaactctagatgtcggcataaaaagtgagaacctatgataacatcccatcttttctcctactaaaattaccttgataaggccattgttctctgcctataacttgaagtccttttctaattccttcatgttattagtcatatttcaccatgactatacataaactcctttatacccttgagcttctctttatagcccaaaatctcttgaatgacattgtactactataacattcatccttacattcctagattccttcttccattttctccattcctatttaataatgtttcaagctcagaagatgcaaagatgaatgttttagtctcctcaccccaagaagcacatttgccttaattgcctcttactgctttcaaaggttcattctcaaactctctaatgcactgttcccccaaactgattctttcccttatattctttcccctctatgtttcttctcccatcaattcttattcttattgtttctcatataattctgtgtgaatagcgaacactattctcctagtgcagttccctccctgaattgccaacagaaagatggagttcatcttttggagatcctattgacacctgaaatatcacacgtttaaagcttgactaatctctcaagctttccttctacctacacatgactttggactttcataaaatttcgatttccgttctcttgtcacttcaatatcccctgataataatctgtctcacttctcttttgaaagacttacaaccttcaaatatcacaggaaaattcagtgtcatttttgtttcaaccacaattaatgcagaaatatcaaatcttcccaattcctcccaaagctctctgctgttcacatttggaatttgaaaactttttttttaattgtctttgttcttattttgctttttctttcttattctgttttcttcaatgcaatacacattgatctggaaacctaaaattctcaacggttctcgtcactgagccatgtacatttttagtgggaaacaactgcagcttttacattttcagttgtcaactgcttttgtagtgctgctgacttcttgttctacattactgggcagacaattcagaataaaaagttttatttcatcacatatttcttccaaattgcttgaaatgctttatcattgctcctaagtaaagaatacagaaataccctcattttatggtgcatggctttattgcacttggcagatactgtttttgtttttaaataaattgaggcttttgcaaccctgcatcaaccaagtctactggtcccacttttaaaacagcatgtgctccttcatggctttgtgtcactttttggtaattcttgcaatatttcaaactttttctttgttactatatctgttatagtgatctgtgatcagtgatctttgatgttactaatgtaatttctttgaggtgccatgaactgcactcatataagacagcaaacttaatagttaaatgttgtgtgtgctctgactgctgcaccaactggccattgtttcatttctctccctctgattggacctccccgttccctgagacacaacaatattgaaattaggtcaattaattactccacaatggactctaggtgtccaagtgaaaggcagagtcacatatctctcatgtgaatcaaaagctagaaatgattgagcttagtgaggaaggcatattgaaagcaaaaacagaccaaaagctgggcctcttatgccaaacactgagccaagttgtgaatgcaaaggaaaaatccttgaaggatatcaaaaactctattccagtgaacacagaattaatttaaaaaaaaaaaagagagagagagagagagaaacagtcatatttctgatatggagaaagtttgagtgttctggatagaatcaaactaaccatgatgttccctgagccaaatcctaacccagagtgaggtgctaactctctttaattctgtgaagcctgacagaggtgaggatgctgcagaagaaaagtctgacgttagcagaggttggtttgtgaggtttaaggaaagaggctgtttccataacataaaagtgtaagataaagcagcagatgttgatgtagaaactgcagcaagttatccaaaagatctagctaagataattgatgaaggtggctacactaaaaaatagattttcaatgtaaatgaaagaggcttaaattgaaatattggaaaaatatgccattttgaactttgataggtagagagaaatcaatgtctggctttaaatcttcaaaggacaggcttactctctttttaggagcttatgcaactggtgaacctaaatttaagcaaatgctcattgctcattcctaaaatcaaagggcccttaaaaattatgctcaatctactctgcctgtgctctacaagtggaatttaaaaataggcctggatgacagcacatctgtgtctatagtatttatttatttatttagatacaggatcttgctctgtcacccaggctagagtgtggtggcattatcatagcttataagatcactgcagtcatcccatcttggcctcccaagtagttaggattataggtacataccaccacatccagctatttttttttttttttttttttttttagggatgggatcttgctagattgctcaggctggtctcaaactcctggcctcaaatggtcctcccaccttggtctccaaaactcctgggattacaggtatgagccaccacacccagcctacacccagcctacagcaagcctatggtttgctgcatattttaagcccaccgttgagaccgactgttcagaaaaaaaagattccctaacacggctcactgctcactgacaatacatctagtcgcccaagagctctgatggatatgtacaaggaaattaatgctgttttcatgactgatatcaaggcatccattctgcagcccatgcttcaaagagtattttcaactttcaagtctcattatttaagaaatatatttcctaagtctatagctgccatagatagtgattcctctgctggatctgggcaaaataaattttaaaccttctggaaagaattcaccatccaagatgtcattaagaacatctgtgattcatgggatgtcaaaatatcaacattacacaagtctggaagaagtattccaactttcatggatgactgtgaggggttcaagactttagtggaggaagtaactacacatgtggtagaaatagcaagagaactagaattagaaatggagcctgaagatgtaactgaattgctgcaatatcatgatgcaacttgagagcagagagtcatttcttaagatggaatctactcatagtgaagatgctgtgaacattgttgaaatgagaacatgaagattttgaatatttcataaacttagttgcaaaagcagcagcactggcagtgtttgagaatactgacttcaattttgagagaaattccagtgtgggtaaaatgtatcaaataacattatgtgcttcagagaaatattttatgaaaaaaagtcaatcaatgtgggaaacctcattgttgtcttattttaagaaattgccacagccattccaaccttcggtaaacactgccctgataagccagttgccatcaatattgaggcggaacttagaccagcaaaaagatcaggacttgctaaaagtttaaatgatgcttagcacttttaccaataaagaattttttaattagggtaattacattgtttttagacaatattagcacatagtttatagtatagtgtacacgtaacttttttatataccaaactgatacaaattggttttatagaaaaccaaaactattgggtcacttgctttattgctatatttgctttattgcagtggtctggaaccaaacctgcaatatctccagggtatacgtatataatgtttgtatgcattcttgttatttgataatatgttaattccttagtcatatactgaaattttatgtatttttaaaaatttatatctatatagaaccagaggaaagtgattaagcaaaaagataacttccattttaacatcatttataaaaattaccacaagcctacaatttctaaacggtcatatttcatagctcatcattatgtagataattataaataggcatttcataagtagattaaccattaaatctttgttaaaaatgggacaattttgaaaatttaaaggagaccctaaatattttaaaaatatataatttttgaaatagtgatacattgaccaaaaagttggtttcattgtattaacaaaattaaaaattatcctgtccacattattttcaaaaacacaattatatttaacaaataaaaacaatgtgtttatattcataaaaaactaagtataacaaaaattatttgtatatattcacacacttaaatcaactgctctatgagtctaatgctgtttatctagtaataatctgaagacttaacacagtcatattgcttttagtatttttcatattttctttaaagattcattttctggttcgtaaatacgacactgcttaaaccttccattggcttttctctatagcgtggaagttttttaactgaggaaataaaacctctttacaaatgctaaggtatctgctaaactaatatcaaattctaaacttttcatattcaggatgtgcaattcaaacatttttgcagattctgtctttgtttctacttagagtgcctttctttaacaaattttttttaaagagaaaacatgctgaaatgtcatgccttcttaatttcatcccaatcagatttatatttttaaaaaactttacttaaatataggaaagttattcattcaaatcaagatagtccaaagcttttaagctatggtaatttaatatgtttagttgatacttaattttataggaaatctttatgttttcctctttgcacacttttttaaaaaataatttctattcattgaatcctcctgagtgtaattttttggcatattatttattgaataatttgattaaaatttccaattcatcttaaacaaatgcaatcaatttagagtacttctaataccaaaaaagttcaataccattatggcacacttaagttgacttctaaagtcattcttcaaaggctaaaatattttgtaaatcagacttttagtgggtagcaaaaagagaaaatgtgtattactaagataaaatacctaattttatatttaacattgcatagaaaagaatttgactggcctttgtccctggctcctgagaaaaaagaaaaaaaaaaaacccaggtaagacgagtctctttgttatttatgagccccttgaattacgcttgagtttatgctaaggagatatctcaggatgggggctggtcactgaaatgatcaataatgtgattagaaaattggggctttgagttagcctgacttccagggataggacagggttacagattgagttcaatcacatgtccggtgattaatcatacttacttaacaaaatcctaactctggacatggaaacttccctggatggtgaacacatcaatgtgctgtgagggtgatgcactctaattccatgaggggagggcttggaagctttgtgtttaagactttgcatttggctggtcctggtttttattctttataataaaactgtaatcataagtatagtgctctcttcagctctgtgaatcattcagtgaagtatccaactggagggcggtcatgggaaactaccacatttttagtcagttgaacagaagtacaggtggcctggtgactcccaaatttgtggctggcatttgaagtgataacagttttcttggtggccctgtccttaaacctgtggagtttgacactaactctggaaggttaacaacagaatggtatgtctgtctacacattttgtggtttcataatgctttatgtgtatacctgtcataccttcccaatttaccaaagtgtgttttcctaacatctttctcttgatatccaacagcagaatgatatcagagaaaaaaccctagaaaaatctcttgatttaaaatttaggtaaattctagctgggtgcagtggctcattcctgtaatcctaacactttggaaagctgaaacaggaggatcacttgagcccagcaatttgagaccagcttggccaacacagtgagaccccatgtctacaaaacaaacaaacaaacaaaaaacccttaggtaaattttatacacaaataggcacacacagaaagacacatatacaaacaccaatatgaagctattaatgaatatctgggtaaaaataacaggcacaaaggtaattccttgagatgaatcctgtgatttagaatattaagaatgtgagaattgtcaaagtggaagtgataaaaagactaaaaccagaattgccactttttctttctacacgtcactcagaaaaaaaattgcttaacaaatgtacgcaaaaccctcttgaatagatgatacttcatgtaaattgaatggtttcctaacaccaagactgacactttgttctcagaatggacgaataataaaaggcaacattaatttgaattaagcaaaatacataggatatgtgatggaccatttaaaactagaacttgaagaaaggacatatttagcataaacctgaattggagaattctgtactgaaacatagttttgtttgtagaaacaaattcatataaacaaattgtaaacattttgaagtttttttctgaaacagtcccttaataaacctaaggtaaatttaacatttatcatacctggatttatctttcttttttatagtgaatatatgtagtgaatttaaaatatatagtgaaggccgggtgcggtggctcacgcctgtaatcccagcactttgggaggccgaggtgggtggatcacctgaggtcaggagttcaagaccagcctggccaacatggtgaaaacccgtctccactaaaattacaaaaaaatcagccaggtgtggtggcgggtgcctgtaatcccagctactcgggagggtgaggcaggagaatcacttgaacttggaagcgggggttgcagtgagccaagatcatgccactgcactccagcctggaggacaaaagtgagactccatctcaaaaaaataaataaataaaataaaataaaaaatatatatagtggaatccctataacatttcatttatgaattgaacaatatgttgaaagtgatataagatttacaagtataagacttacaatagaattcctacactgagaggaaacagtgttaagtattctcatatcaggaaattaagataatataaattatttctgaaacaattctaacaacacttcacatcattgataaaatgttgaaaatgttaaatttattcaacctctttttagtgaatttacagcaattatttaatgaatagtcatcatatacaacactttttataaggtgccttacaaacattttgtctaattcacccaataaccctgcattttgatcatttacagctgaaaaatctgagtcccaaaaatatataagtccacttcctatttttgaagagctttcttctccaatttctatctatgtcagtttcattttgatttgatactagttcttccaactatgcccataggttagagcaacattgtagctgtgaacttacaactgaggtgacatatgacacctgagcaaaactagtagcctaattattaccatctacatcctcagacccaatcataaatgtcgtaaaattcttcttgacaaaatgtaatttgttaagtaatgaaaacttaaaacactgagttaatctcacttcattctgctccacaaaggaaatttaaatgattaatcccatcctgatacctcaaaaactttgtctcccactaagtaaaaataatgtgaacaaggaaattaaatgtgggtgaacctttaggaagcttttttttttttttgagacggagtcttgctctgtcacccaggttggagtgcagtggcgccatctcggctcactgcaagctccacctcctgtgttcacgccattctcctgcctcagcctcccgagtagctgggactaccacgcctgactaatttagtagaaacggggtttcactgtgttaaccaggatggtctcgatctcctgacctcgtgatctgcccgcctcggcctcccaaagtaggaagcttttacctacaactcctatcctcctaaaagtgtcatgcccacacagaaaagtcaatgtatgtttccatggctgttttaagggtagactattaaagcaacaattttgctctaactatgtaatcctttatgccagtctcattttataagagcaaatactcctattatcttcatttctataaagaattatattttacagacaatctgatattaacataagctttccataattgtcagtagtaaggaacatgagatgataaaaaggaataatcgcaaataaagaaggagtagctggcagcctgaattacgtctgttattaatctgtctcagaagggaagaaaagaaatgacagcagaaaaaaagcataaagggattcgttgggcacactggagctacacatttgtgtttgttaacaacttccttttttcctctgccctgtaaactcaaaatacctttataaaatagcccaaaataattatcttgtcagaagaatctttgtgtttttgtcaaattaaattaaactgaaattcatcatgggaagaagatatcagagaaaaagcaatgaaaaggtaaattaaaattgaactgtcagatttaagggctggtccaatggaaatgaccaataaactcatgagtaatgataaacagggtagatatttttcctttgatctcactaaatctacaccctattcccaaatgttcttttaagggaatgatattaaattaactatagatttttctatctgcagaaaccagtgggagcaatgaatggaggaagtgtcatcattaagctgccattattcctagtgcatagcaggctcaactcaccctgtagccttgtgtggccttaaaatcctccaacacacactaatagttttccctatagaatatatttgcatgtataatcatgcctgttccaccattaaacaatattttaatggaaaaggctgtgcccttgggtagttataacttgtaagcacaggagtcaactttattgtgatattataaaagagtggtaaaaataattaagcagtcatgcctggcacggtggcttgcacctgtaatcccagcattttgggaggctgaggaaggacaattgcttaagcccaggagtttgagaccagcctgggcaacatagagagacctcacctctacaaaaaaatcaaaaaaatagctgggtgtggtgtcacacgggaggctgaggtgggaggatggtttgttccctggaggttgaagctgcagtgacccatgatcacaccactgcacccagcaagggcaacagaatgagaccctgtctcaaaacaacaacaacaacaataataataataattaagtattctatttgttaatatcattctcatggtttagagattaacttaattgaatatgacacagttttgagagaaaattactttgaagagtatcctcattttggcaacaaaataaaattgaaatgtgttctcagagtaacttgagatggtggtataatgatttgtgtataaacaacaaaatctgaatactgctaattagtcatggttctcttaaattgagtagttctatcacaggtcaatatcattctctctccaacagatgacagaatttattttatcattctaacaatgtaattactgaatttttctcatctctcctaatctgagattctattagcactgcccagtataataccaccttaattatatgcatatttgatttccatttttaaactctataactggttgtctcttttttaggttgaggtaggtctaattaacttaatttaggaaaggtattttatttaaaataatatcactttcttgtcattactctcccacatttgtaatctaaaagtatcaaatactcatttttcattacacaatatttttattactagatagtttactatttcagtatttgagattatagtatttttcatttaggtcacaattatatttccataaattttaagttagaatattaaattttgcatcatttaatgcctcatatcaaagggcagctgcagctttatacatcaaaatccagattatcaagagagtttatatgctgggaaacacacaaagcaatgatcacaaatggaaattgatagtaatttttttcaaagagaaaataaaagaggaaagaaaaataacaataaaatgagaggaaaatggagacagactaaataaaagactcccttgactacaggtcctcatacgtaagtgaaatgatcctgcacaatggttttctggaagattagcccttctgcactctgggacgggttcctccctatgaggaaaatgcccaagcaagaactctcatatggtttcttgtgcaacgaataggagctttataaaagcagaaaactttgaacaaggacaagtcagtattaggtgagccatacacatgaagtaaaagtgtcagtctgttcccctcactattactttctctctgatacaggttataggttaagaaaatacacaggcattccttccagaggaattgagttgctgcaagtttgtccacttcaagttcatgaaatgttttataacttaatattgttgtcaatacataggggaatttcacttaattggttttaaaattatggataatatacaaaagaagtaagacaattaagatgaactaagaatggaattaagatatatcaattgaatggaaatttattcatctgccagcatcacagatttttctttcatttttttttttgtctttctacctccttttcttcttcaaaaattatttgacacctaccgtgtgccagaaattgttcttggctctgctaacacaacaataaacaaagaatgtcccttttccatgtaaaggaatggggtgactggtaggaaacaagcaactttcttacagggtgaaaatgcagtgaggaatatccataaaaaaggaaggagctgcaggagtacagagctgaaagtgaatagcactgagctgcttacagagctaaatgttgacatgcagaactaaatcttaaagattaacacaggttaactaaacccagatggtgaaaaggagagggcattttaggctacacacacacacacacacacacacacacacacacacacacacacacagagttatatacagttcaaaaacatggtggcatgaaaaacatagcttttagattgaatttcaaaaagtgccctttggaaaatattgaccaaaaatagtcctcatctaacacagtgcttgccaactaaatgagggtaaaattaagttctaactctgacccttcacttgaatggccattttaactgtccctggaaagtttttaaaacacacctggattttggattcagcctccttaacatgattcttaaaggatgtgccttttgcttgtaaaatgcataacacctctatcttactttcatatgtgaagtacacacacacacacacacacacacacacacacacatatacacacactgctatctatggtaattaaagttttcactaagaacttgctcaaaattatagtgttagtaaagacataaaacaggtattagcttcacatataacaggtctttccactctactcacgtgcagccaggatttttgttttgtttttgtattggctattttcactattttagtcatcagtaacatttgtaatcatatatttaaaaaataatattaagagtattttctctttcttgagcaaatgttacgatcatcagattaaaaaatccacaaattacccttagctcaaagttttatccttaaaaatatttaataatttgtagactctctaccttaataaggaagactgtctcattaatacaattaatcttctttagatgattcagaaaagctacaagaccttggttaaattttctgatcacatcaatttttaggaatgtaaagtgcaaaatttgaaaaaaaaagcataataaattggaatgaaatagaactggtcccagaataacgctctgtgccttagtttcttcatcatttaatgggcatactaacagtgtttaactcagttattgtgaaaattaaattatttaatatgtgtaaagtagaagatttcccagcacagagtagaatttcattaaatgttaatgactgttattattattagttttaaaaatcaatcattttttattctgttatccattaaattggtaagcaaaaaaaaattaacactcgttatattttaaagtgtgctttaaaatcttagaagtgtcatgacaatggaagaattgtttacttattcaaaccactaggttctttttttaagtagctttattttaaaattatgtacgtaagggctcggaaaacaatacatcaaaatatggtatcttggcaaactaagtattttaaactgaaggaaactgataaaatcacagaagttgaaaggtctctgatctttttccaccctttctctcctgaactaaggctcagaaaccgaaattccccttacccctttctctctgaagcaggtcataaagcctagacaggttactctctgacagtctccttcccactcccctggagatccttttatgactggtgtcctgccctacacccagagggaagaaatgtcacatacagacacaggaaataatctgaacagacagaccttgctaagttacctccagctaatgacctttagatcatatccttttgtcctccaatcatacttctacatgattgtccattaaaatatactattttccctgggtctctggttcttcatttctgtaggtttcaatgtcatatgaaactttatatgctttgtttttctcttattaatcttttcttgtgataaaggaattgtccatgaaccttgttgtagataaggaaaaattattacttttcctcctctaaatgtaatattaaaggttttacccatgtagaaagatttatattttaaaaattcttttgagaaattcagaaataagacagttacatatggctgaaagtttgtttgatatttgaaacctcaagacttctgtgagtttactctttggaactttagggtgtaacatttcaccatgtttagagttctatttaattaattaatttaatttaatctcaattactgttttggttattaatattacaaaagaaataaaaactgctcactatatagttctcaactaatacaagatttatttaatattcccagtctttatctgtttttacaaaattcaaacatccatttttttaacattcaggatataactttatatctaaagtcttaatatagtttaaagtttaaaattagtaagtacaattttaattaatctatatttttacaagtagattatgtgggcatcattattatcatcatcatcatcatcatccttatcctcatcatcatcatcctatgatttggtgccaagaatataacataacttctcatgctagtatattttaacatacaggaaatgacttagatatttaacttgatgggataacctagcttaagcacaaatcttccagacagatttgactaaaagctaccaaatgactgaagtaaaaaatttgtaggtatttgccagattatctaaaattaatgtcatgaaatgttagtgtacactgaagaattcctattgctatttttaattaccaaagctatattttctttttaattatgtcaccgtgaacatcttttatcgatatttaatttaatctgatattctctttcttccttcttctcttcctttgttcctctctcgctttctttttctatttcccctacttctaaggtatttttattgcatctttaaattctcatgtagattcttctgatgactctgcttatgtttcttttattacacatttttctagagtagatatcatctggaacatggaatctactgacacatttcttttttcaccttatcatctccatgtttattaggcaggccaattgattattaacagtcttttggcaataatcttttcaccaccatactaccttaccagctgggagagaaacttcagcaaagcaataattaagacactgataagacaagctattttgttgctttcctggtttacacagaggacgcagaatcgggagctaaatatctttaatactcaatatctaaaacattactcagatcatttgacttttatacctacattgtatccaacctaatttttaaactggatagttgatctagtctaaaaacaaaatctaaaaaagtaaacaaaacacacctaacattgttagtgccttacttttaaaaagattaaaactttcagtaatatggataagtagataaatagagtactaattccttattattaccctcattctagaattagatgtttctgacacaaatatacaaagaaatttcacatgtaaaaacctgctgcggaatttaaaattcttttgtgacaatttgctcctgtgacaagtatatttttctattctatcatgctcatatttcatactattaaaataaatacttatgaggattatggacaatattgctcacttgataatttaatacctgatatgattgtactgttgaaaaaattgtacaagggacaattcatgctgtttcccatttttgacttcttccatgtctacattggtttaattaaatatgcttagtttctaaaactctttttggttcctctagcaggcataatagattgtcccattatggtcccttcctctttccttcctaatgacatacagatgatgacttcattggtgtgtccactagtacccatgtgattcacgtaaatccagattagtaaacaaacccagtaatcccattccccctgacaattattggtgtaaaattgggtatgtagggttaagtttcatggttttttcttggagatgttttctgactcttaaaaagagaatcagagaacacgctgtttttctcttttcttttggatattttattatctggacacgcaaactggagttgctataccatattgtgacttggggcaagatagatgaaacgccaaaatagacaagctaagaatggtggggatgaaagatgtcatcaaagaacctggatgcttcatgggaattttgagttatgatattaattagctccatgcctgttctactcaggatatttactacagatttttacaaatgtctttattttaaagccaatatgaggacagacgcggtgtctcatgcctgtaatcccagcactttgggaggccagggcagatggatcacctgaagtcagtagtttgagacgagcctgactaacatggtgaaaccccgtctctactaaatacaaaaaattagccaggcatggtggcacatgcctgtaatcccacctatttgggaggctgaggcaggagaattgcctgaacctgggaggcagaggttgcagtgagctgagatcatgccattgcactccagcctgggcaacacgagtgaaattccatctcaaaaataataataaaaaatattttaaaagtcactatgagttatgaccattgatattttgtttataaatgcatttgaaagcatcccatgtcctttctctttagacattgtggtgttagatccaatcataatagagagcctgatggtttctaagcagtgatttatcttccactcttctctccattcatttgtacacattatatctattgttatcctcctttcagcctccactgtggaaattgctttgataacttattaatgccaaaggataaataaaaaatatatacccttcaagaagcattttcattctaaaggattttaaatcagaccttaaccctgaggaatgaaatatctaataaagtaaattacagaaattgcatcagactcatgagaagcacttctcattgtcctttcatgttctccttatttggtatctttatgcttagtccattacttaaccataaaacttcattctttcaggaatgctcaaagtactttaaagagaattaacctggatatagtgcaatctgctcagggctaataatattaaggattcacacacttggaaaatatctataaatgattttttaaaaagataaaaagaagtgtggctgtgtttttgtatatgtggacatacaactgttgcattttagcctggtctatagccaagattgagagtgatataatcatattacttttctaaattggggaaatatgtttcttctcttttaatggtaaaatggtcttaccatacataaaagattggtgatacagaatttcaggaactaatgattgactctgtattcattaatttgtttaacaaaattgtgagcacgtactggcaccaatttagctattgaggatacagcactgaacacaagcccttcccttaatggagggactttgtagtgttgtgaatagggaaaaagagataaaaaataagttcaatatattaaatgtcattgtgatttgtgatatggagaaaagatgcataaaatgtagaataggaagtgtgtgggtagggaggaacatttcattttttttaaggtcgtcaggaaaggatctattgaaacataacatttgagcaaacacctgcattagcatttgttttgcttagctgcgcaaaatgtttttggcatacagaaattcatgcttggaaggttgatgatagaaacttacttgttttaagaaatttctatgtacataatagaatattatctatgcatataaatgtctctattcaaatttcttcaaaggacctcagcttaaacacatttaaaattaaactcatcattttcttcgaaatctattactcttttctgctcttcttccccaaacaacttagtaagaacataggcaccactgcagttcaaaaatctgaacatcattatgaaagtcctcttctaattcaatacccaggctgactaaggtattgtctcattagggaaactgcattttctgctaccaaaatcccattgctaatagtgtctagtgcaaatacagctgtgaattcacttcatttatttattttcctgaggagggttttccaataacctccccccaccccgaaaattgttaaaaaaacactgtaacactatccttttcttacttttttgtacatttactttataaatgttgtcctttggtcagtgaaccaaaaccaacagaagaggacaaaatggtcttatgtgctattaccatgaataatgtcttccagaaatagacttgaaaattgctcccctaatgccatcccattcactatatacttaaaaaaaatctatgagggttgaaaatattgagatgattgatttaagatacctattattactgactgctgacatttggccttgggaaattacattcgcagtagtatttttaaaatgattaagagaggtttctgaaaaaaagtatttacattataagatgtatttttagaatttgtttcttaaaaaccattatataagctttctgaacaaaaaaagatatttattttatgagaaaaatacactgaatttgcccttataaattataatttgtaaaaattaataaatgtaagataagtagattcccaatagcatatacaaaataaaacttgcttacaactgatcataaaatgtaatgtgcccattgaatatggtaaaagggaagtatatgaatcataaaattttatttttcctatcctatccacaataccatgatgctatatagctattaaatttggaacagttttcaggaatatcttggtttattgggcttaatgatattgtgcttctcagataaagtaatttttacaaatttaagatttttgcaactctgcatcaaccaagtctattggtgccatttttacaatagtatgtgctcacatgacactttcaggtgtcacattttggtaatattcataatatttcaaactttttcattattattatatctgttatggtgatctgtgatcagtgatctttgatgtttctaatgtaactgctttggggtgccatgaaccatgccatgtaagatgacaaacttcatcaataagtgtgtgttctgactgctccctcagtcagctcagctgtttctccatctctctcccttccttaaggactccttattccctgagacacaacaatattgtaattagtccaattaatgactccacaatggcctctaagtgttcaagtgaaagagtcacacatctctcacgttaaatcaaaagttagaaatgattgagcttagtgacaaaggcatgttgaaggccaaaacagaccaaaatctacgtttcttatgccaaacagttagccaagttgtgaatgcaaaggaaaagttcttgaaggaaattaaaaaggctacttcagtgaacacaggagtgataagaaagagaaacagccttgctgttgatgtggagaaagtttgagtggtctggatagaagatcaaatcacccacagcattccctaagccaagtcctaatccagaccaaggcagttactccgttcaattcagtgaaggctgagagaaatgaggaagctacagaagaaaagtttgcagccagcagagtttggttcttaagatctaaggaaagaagtaatgtccagaacagaaaagtgcaaggtgatgcagcaactggtaaggtagaagcttcagcaagttattcaggtatagctaagataattcatgaaggtgaacgaaggtggctacactaaacaacatattttcaatgtagaccaaacatccttctattggaggaaaatgccatctaggaatttaatagctaaagatgaaaaatcaatgcctgtttaaatcttcaaagaacagtctgactctctttttaggagctaatgtagctggtgactttaagttgaagccaatgttcattgactatcctgaaaattctaaggtccttattctcagcaaactatcgcaaggacaaaaaaccaaacaccacatgttctcactcataattgggaactgaacaatgaaacacatggacacaggaaggggaacatcacacaccagggactgttgtggtgggggcggggagggatagcattaggagatgtacctaatgctaaatgacgagttaatgggtgcagcacaccaacatggcacatgtatgcatatgtaacaaacctgcacgttgcgcacatgtaccctaaaacttaaagtataataaaaaaaaggaaataagctcaatctactctgcctgtgctctataaataaaataacaaagcttggatgtcagcacatttgtttacaacatagtttaccaaatactttaagcccactcttgagacctactgctcagaaaaaaagatttctttcaaaatatcactgctcattgacaatgcaccaagtcactcacataagagctctgatgaagatgtacaaggagattaatttaatgctgttttcatgactgctaacacagcatccattctgcagcccatgcttcaaagagtattttcaactttcaagtgttatgatttaagaaatatatttttatatatttatgaagtatagctgccatagatggtgattcctctgataaatctgggcaaaataaattgtaaacctaggattcaccatcctagatgtcattaagaacactgttgattgatgggaggaggtcaaaatataaacattaaaagaaatttggaagaagttgattctaaccaccatggatgaccttgccggattcaagaattcaatggaagaagtaactgcagatgtgttggaaataataaaagaactagaattagaagtggcgcctcaagaagtgactacattgctgcaatctcatgacaaaagttgaatgaatgagaagttgcttatagataagtgaagtggtttcttgagatggaatctacacctgataaagatgctatgaatattgttgaactggcaacaaaagatttggactattacataaacttatttaatgaagcagaagcagaggcagtgtttaagaagactgacttcatttagaagttctaccatgtgtaaaatgccatgaaatagcatcataagctacagatacatttttctgaaggaagagtaaattgatgtggccaacttccttgttgtcctattctaacaaattgccacagtcaccccaacttacagcaaccacccttctggtcagacagcagtcatcaacatcaaagcaagacctcccaccagcaaaaagtatcactagttgaaggctcagatgatcttgttagcatactttagcaataaagcattttttaattaaagtatgtatattttgtagagatactgctattgcacacttaacagactacagtatagtgtaaacataacatttatatgcactgataaaccaaaatatttgcgtgactctctttatggtgatattaactttattctggtgttctggaaccaaaccagcagtattttggagataggcctttttgaaccaattcatcccaatttctccatcagcccacctttcaaatttgtgaatcatcctgaacctaatcttttattttccccttccccaggaggtatgctaaggcttttaaccctctatgcaaacttaaagcattctttttataaatgtttttgatgtctctgtaccaaatgaatgacctacattcaccaagtttatattctctacctgaatgtatatctttattttggaagggttggagttagctatttgctaacaattactctcactacaaaggcatttaatcaataaatattattaacctgctagtacaatcagaatattgttggagctgaataaaattattcttgttttcaaggttattacaatttaataggtggaaaaaacacatggaaataatattaatagcatcatgaattacatatgcatcaattgctagaaattagaacaagacgaaaatcttctgattagaatgatccagaaagcttaatagagggctgacatcagtgctgggtgttggtggtagggtatgattttaatatgtcaaaatggggaattagctgtgctatgtcatattgtatttgtctaaatgtacataaaactagtttcacaaattatcatgtattcaatttgaaaagcatcttgtaacttaaaacatattttcataggaatgtaagaaatataaaattataggcctagcataaatttgtgattatttatgtattaaatagttcccaattttacaaaacatttggcctccagtccttaaataataatccattgcaggataaatatatcattaaaaaatctaggtagcataaagttctagttattttaacaactatataaagaaatatatgcaaattataaaatgagctttataagaacttttctgacattataaaacttatcacatgaagtagcttttcttatacttgaggttttatttccttaaatgtacttagaaatacgaagcaatgcatctgttctttgaactgaatttgaagaaaaaaattaagaaaatgatattgttgcctaagttgatattaatattagtaattttcaaaatcgcattaaccagagagtagggtggttggaagtagtgtcactattcttttgtatgccatctgtaattcatggtttttgaacacatgcttagaactcacagtagtgatgagacttacaaacctagcttactatgattgatgacagcagagttaagcaaaattaaacaactgagaggaaggatatttttgtcacagggatggtaagaaaaggtttagttgttgccattgctaatgtttactctagttctctttttagatgacccaccacagtgtcctgagaagccaaaatgggataattggggtctaatggaaggccaacttagtaagacaaaggtctatctaaagggtctcaaatgagggtattagggatgtcaacaccaggctggaaacatattccaagcagtgattaggcggtctcttcttggaagtgaatatgaactggcattagattcaggcttgacagtgaaatatgtggagccttctgactcaacatgcagcacatattgtttattttctgttgctatggagaaaaaaaaaatgcacctagtcaactcctctccagtgtgttcaaaactatatgccagtgtttccaggaagcattagataagagtgggaggtggtgaggcaaacatctacagtgtcacactgtctttaagccaattttagagattgcatgactcctgaatcatcatagctcaacagtacggagcattcactttgtcagtgctatattctaagtgctttacatttactaacccacttagttctcataacactttataaaataaataatattaatattcccattttacagatgaaaaaaaatgaaggcatagagcaattaacaaacagccgaagttacacagttaaaatgtaatatgactaaaattcaaatcaggcacttttgctctagaaagaagagcaaagggaagtaatatatttttagtattctcagacttgaggaaatatatgcaaaaataatataataaattaaaagcaatacctgttatatgtctactatactggctttcactcacctggatgggattaatcagtatctacaattaattttgtgcaaatgtcatcgttatctcatgacattttcaaatttcctaaaacaacctctcatatcaaaagtaatgtttttaaaccaaactttattatttgtattaacatataagtatctgtttataaaatcaagtataataattaaatatacacagaactattgaataaagaacaaatgtaaggcacgaagctacagatttttaaacttaaatcctaaaaatttagtcaaattctcaaagtttacaaatgacaaacggaaaggtaatcttattggtagtcagataaactcttaatagctgactcagatcagtattgtttcctttataccaagctgtaggtacaaagtcttatttttcctacagtcatcatcaagttccagattgtaaactgcctcataaattgaacctcaccaacacagctcaagaccaatctccatgccttgtctcttgagacacacagtaaatgaacctcttctccttttccctttggtcatattttcgtctcctgcaagtatctaccatggtctcgcaaagatcctaatacttaaaaaacaaagagtgaaattatcaaggagagaatatagtagtagtgagagcttacaaaaattaaaaagagccaaacaaaaaagtgaataagtgctgatttataattgggtttttaattgttaacatttcaatctaaggtttagatattagatacagaaatatttatacattttcatagtttggaggaagggaaggtatagcacatcaagctgaataataaattaaaagtaataagtaatctctgaaatacacatctatataaaaagagagaaaaagaaaagatgatggtctttgtcttttgtttctgttttttaagcagtgcaacaatggaatagattatgtgagaatttctcttcctggtaaaagactgatttataggagatgataaacctctaaatgttgacatgttaactcctttcggatggtcaaagtgtcaaaatatgcctgccatttagatgcaatatccttccaccacattcctctggaatattaattgaaagatatatactggagtcgcctattcaaagccacagtcccgctgagaccttcaaggattcagcctattcagaaggctgaatatattgccctgaaaggttcctatgtcctactccctggacctaggaaaatattagattacatggcaaaaggaaattaaggttgtggaggtaattacggttgaaaatcaacaggccttaaaatagggagattaccttggattgtccataagggcccattgtagtcacaaaggaccttaaatgtgaacaaggaaggcagaagaggagaatcagaagagctgtgactagaattaaatcagagtgattcaaagtgaggagaatttaaatttctcctgggggtcacaagccaaggaatgtggtggcctctagtacctggaaaaggcaatgaaacaactcccccactgcagattacagaaaaaaatgcagcctacctacatcttgatttaactcagtgagaaccatatcagacttctgatctacagagctataagatttgttgtttttttgttttgttttgtttattatacttttaagttttagggtacatgtgcacaacctgcaggtttgttacatgtgtatacatgtgccatgtaggtgtgctgcacccattaactcgtcatttaatattaggtatatctcataatgctatttctctcccctccgcccaccccacaacaggccctggtgtgttatgttcctcttcctgtggccatgtgttctcattgttcaattcccacctatgagtgagaacatgcggtgtttggttttttgtcctcgcgatagtttgctgagaatgatggcttccagcttcatccatgtccctacaaaggacatgaactcatcctttttatggctgcatagtattccatggtgtgtatgtgccacattttcttaatccagtctatcattgttggacatttgagttggttccaagtctttgctattgtgaatagtgccacagtgaacatacgtgtgcatgtgtctttatagcagcatgttttataaccctttgggtatctacccagtaatgggatggctgggtcaaatggtatttctagttctagatccttgagcaatcgccacactgacttccacaatggttgaactagtttacagtcccaccaacagtgtaaaagtgttcctatttctccacatcatctccagcacctgttgtttcctgactttttaatgattgccattctaactggtgtgagatggtatctcattgtggttttgatttgcatttctctgatgaccagtgatgatgagcatttgttcatgtgtctttcggctgagaagtgtctgtttgtatccttcacccactttttgatggggttgtttgtttttttcttgtaaatttctttgagttctttgtagattctggatattagccctttgtcagatgagtagattgtaaaatttttctcccattctgtaggttgcctgttcactctgatggcagtttcttttgctgtgcagaagctctttagtttaattagatcccatttgtcaattttggctttggttgctattgcttttggtgttttaaacatgaagtccttgcccatgcctatgtcctgaatggtattgcctaggttttcttctagggtttttatggtattaggtctaacatttaagtctttaatccatcttgaattaatttttgtataaggtgtaaggaagggatccagttacagctttctgcatatgactatccagttttcccagcaccatttattaaatagggaatcctttccccattgcttgtttttgtcaagtttgtcaaagatcagatagttgtagatatgcagtgttatttctgagggctctgttctgttccattggtctatatttctgctttggtaccagcaccatgctgttttcgttactgtagccttgtagtacagtttgaagtcaggtagtgtgatgcctccagctttgttcatttggcttaggattgacttggcaatgcgggctcttttttggttccatatgaactttaaagtaggtttttccaattctgtgaagaaagtcattggtagcttgctggggatggcattgaatctataaattaccttgggcagtatggccattttcacggtattgattcttcctacccatgagcatggaatgttcttccatttgtttgtatcctcttttatttccttgagcagtggtttgtagttctccttgaagaggtccttcactcccttataagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcctatcaccttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtggcagttttcaaagggaatacttccagtttttgcccatttagtatgatattggctgtgggtttgtcatagatagctcttattattttgagatacgtcccatcaatacctaatttattgagagtttttagcatgaagggttgttgaatttgtcaaaggccttttctgcatctattgagataatcgtgtggtttttgtctttggttctgtttatatactggattacatttattgatttgtgtatgttgaaccagctttgcatcccagggatgaagcccacttgattatggtggataagctttttgatgtgctgttggattcagtttgccagtattttattgaggattttggcttcgatgttcatcaaggatattggtctaaaattctcttttttttttttgttgtgtctctgccagggtttggtatcaggatgatgttggcctcataaaatgagttagggaggattccctctttgtctattgattggaatagtttcagaaggaatggtaccagctcctccttgtacctctggtagaatttggctgtgaatccatctggtcctggactttatttggttggtaagctattaattattgcctgaatttcagagcctgtttttggtctattcagagattcaacttcttactggtttagtcttgggagggtgtacgtgtcgaggaatttatccatttcttctagattttctagtttatttgcatagaggtgtttatagtattctctgatggtagtttgtatttctgtgggatcagcggtgacatcccctttatcattttttattgcatctatttgattcttctctcttttcttctttattagtcttgctagcagtccatcagttttgttgatcttttcaaaaaaccagcttctggattgattgagtttttgaagggttttttgtgtctctattttcttcagttctgctatgatcttagttatttattgccttctactagcttttgaacgtgcttgctcttgcttctctagttcttttaattgtgatgttagggtgtcaattttggatctttcctgctttctcttgtgggcatttagtgctataaatttccctctacacactgctctgaatgtgtcccagagattctggtgtgttgtgtctttgttctcgttggtttcaaagaacatctttatttctgacttcatttcattatgtacccagcagtcattcaggaacaggttgttcagtttccatgtagttggcagttttgagtgagtttcttaatcctgagttctagtttgattgcaaaatctgtggtctgagaaacagtttgttataatttctgttcttttacatttgttgaggagtgctttacttccaactatgtggtcaattttggaataggtgtggtgtggtgctaaaaagaatgtatattctgttgatttggggtggagagttctgtagatgtctattaggtccgcttgctgcagagctgagttcaattcctggatatccttgttaactttctgtctcgttgatctgtttaatgttgacagtggggtgttaaagtctcccattattattgtgtgggagtctaagtctctttgtgggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcacagactaggattgcaacccctgcctttttttgttttccattggcttggtagatcttcctccatccttttattttgagcctacaagtttctctgcacgtgagatgggtttcctgaatacagcacactgatgggtcttgactctttatccaatttgccagtctgtgtcttttaattggagcgtttagcccatttacatttaaggttaatattgttatgtgtgaatttgatcctgtcattataatgttagctggttattttgctccttagttgatgcagtttcttcctagcctcgatggtctttacaatttggcatgtttttgcagtggctgatactggttgttcctttccatgtttagtgcttccttctggagctcttttagggcaggcctggtggtgacaaaatctctcagcatttgcttgtctgtaaaggattttatttctccttcacttatgaagcttagtttggctggatatgaaattctgggttgaaaattcttttctttaagaagtttgaatattggcccccactctcttctggcttatagagtttctgccaagagatcagctgttagtctgatgggcttccctttgtgggtaacccgacatttctctctggctgcccttaacatttttccttcatttcaactttggtgaatccgacaattatgtgtcttggagttgctcttctcgagcagtatcactggggcattctctgtgtttcctgaatttgaatgttggcctgccttgctatgttgcggaagttctcctgataatatcctgcagagtgttttccaacttggttgcattctccccgtcactttcaggtacaccaatcagatgtagatttggccttttcacatagtcccatatttcttggaggctttgttcatttctttttattcttttttctctaaacttctcttctcacttcatttcattcatttgatcttccatcactgatactctttcttccagttcatcaaatcggctactgaggcttgtgcattggtcatgtagttctcgtgccatggttttcagctccatcaggtcctttaaggacttctctgcattgattattctagttagccattcgtctaattttttttcaaggtttttaacttctttgccaagggttcgaacttcctcctttagctcagagtagtttgatcgtctgaagccttctctcaacttatcaaagtcattctccgtccagctttgttctgttgctggtgaggagctgcgttcctttggaggaggagaggcactctgatttttagagtttctagcttttctgctctgttttttccccatcttcatggttttatctacctgtggtctttcatgatggtgatgtacagatggggttttggtgtggatgtcctttctatttgttagttttccttctaacagtcgggaccctcagctgcaggtctgctggagtttgctggaggtccactccagaccctgtttgcctgggtatcagcagtggaggctgcagaacagcggatattggtgaacagcaaatgttgctgcctgatcgttcctctggaagttttgtctcagaggagtacccagccgtgtgaggtgtcagtctgcccctactggtgggtgcctcccagttaggctactcgggggtcagggacccacttgaggaggcaggctgtctgttctcagatcttcagctgcatgctgggagaaccactactctcttcgaagctgtcagacagggacatttaagtctgcagaggtttctgctgcctttttttggctatgctctgcccccagaggtggagtctacagaggcaggcaggcttccttgagccgcagctgggctccacccagttcgagcttcctggccactttgtttacctactcaagcctcggcaatggcgggcacccatcccccaacctcgctgccgccttgcagtttgatctcagactgctgtgctaacagtgagtgaggctctgtggtgtaggaccctctgagccaagcacgggataaaatctcctggtgtgccatttgctaagaccattggaaaagcacagtattagggtggaagtgacctgattttccaggtgccatctgttacccctttctgtgactaggaaagggaattccctgaccccttgcgcttcccgggtgaggcgatgcctcaccctacttcaggtcacactcggtgcactgcacccactgtcctgcacccactgtctgacactccccagtaagatgaacccggtacctcagttggaaatgcagaaatcactcatcttctgtgtcgctcaggctgggagctgtagagtgcagctgttcctatttggccatcttggctcctccctcctattgttgttttaagccaccaaatttgtggcaatctgttgcagcagcaatagaaaatgaatatacaagcctagaatcatcatttagtctcttagagccattatttagtctcttagcaccagagactaaattaataaatattcgtgattccccaagtttatgtggttttgctgtatgtaatagactatcttaataaaccttttgaaatactcctatgttttaaaaatcaattccagagtcaaaaaatatgcacctcaattctgtgggccatcactaaccaaggttggctataatcattccattatatctttaagactacataaccaagttattttcaaacctgtcagatcaatgcttctaaaaaagtcaggaaacaacaggtgctggagaggatgtggagaacaaggaacacttttacactgttggtgggaccgtaaactagttcaaccactgtggaagacagtgtggcaattcctcaaggatctagaactagaaataccatttgatccagccatcccattactgggtatatacccaaaggattataaatcatgctgccataaagacacatgcacacatatgtttattgtggcactgttcacaacagcaaagacttggaaccaacccaaatgcccatcaatgattgattggattaagaaaatgtggaacatatacaccatggaatactatgcagccacaaaaaaggatgagttcttgtcctttgtagggacatggatgaagctggaaaccatcattctcagcaaactatcgcaaggacaaaaaaccaaacactgcatgttctcactcacaggtgggaattgaacaatgagatcacttggacacaggaagaggaacatcacacactggggcctcttgtggggtagggggaggggggagggatagcattaggagatatacctaatgtaaatgacgagtgaatgggtgcagcacaccaacatggcacatgtatacatatgtaacaaacctgcacgttgtgtacatgtaccctagaacttaaagtataataaaaaaagaaagaaatattaacaccatgtttattaattaaaattaaagacccagaacatatgtcattaactgaatacttgtgcctactaaatttcatacattgaaatttaatccccagtgaaacagaatttggaggtgggacctttaggatgtaattagttcatgaggtttgagctttcccaagtaggattaatgcccttattaatgaggtcacagagagctctctttctccttctctttcttttatatgagaatgcagataaaagatggcagtctacaacccagaaaagggccctcatcagaacctgaccatgagggcaccctgatctcagacatcaaatcttcagaattgtgagagatacatttctgtcgtttatgtgccaccaaagtaccagcattacttttctttataccaagttgttacagtatcttgaactaagacaatataaaacctacctatacacataaattcaaaaaatatataatcccctatagataagataaatagcagggaagtcaagataatataataatgtacatttatattccggcaagactacactagaagacacaatgaattaataagtttgtccccataggtagaatcacagtgagtacttcagactgaaacagttatgttgcattggccactcgaatactgagaatggagtggatattgtgtaatttcgaacaacacttgtttaaattccaaacaaaatgttatagaatctcatcatttgtgcagcaattcctttacttcaaaatgctgtgtatgccaaatcctaggtaatctttacttgtgcagcactgcctaagttgcaggatagctagaattcctgaccccctcctctaaatgccgacaccctactcacctcctgccccaccaggcattatgataattttaaaagacccagaaatccctttacaaactctttatcttttaactactactaactcattcttcaagttaggagtcaccccctccaggaggacttcaccgactactcaccaggctagatgaggcctttcatacctgtcagcacccagaaacctctgcttttctctattactgctaacagtaacgaataagaatgtcatataagcaatgatgaacattaccctgaaagtttaccacttgctgggcatgctgagctctcctgtgaattatctcatttatctcacgcctgataaaaatagtttggttataacagttagacaaggcagtagcttgaaagacagtttatgtgcagaaagaagagattatgattttgttttgttttattttattttaaggtagaggaaatcaagcttgtgtgtatgtaaagacaagacaacagtggttctgagagagagctttatgttacagaaatgagaataaattcccagaaaagataaaagagagagggtaaccttaaaccaaaagaagattccctctctagtgtaacagcagcaattggagatagactgtaagaatcagcctcagaagctgttttcagcataatacactgtgtgagtaggtgtgattgaaagagaaggagcaatgggtgtcagtaaaagagaatatgattaaaaaatcagttgtggggtttgcagcagtagggaagaaataatgtgatataggggctagaaaactggctgtaaaaggaggattccaggtttgaagtcttacatagagaaaaagatcaggtttagtgagtcaagtttagagttgtatgagatggctgaagccattagtgcaggtgtagcttttgggatgacaagtaaaggtcatagcccatgtgtggagaattgactctgttaaggtctttgttatgaaagaggtacaggaaattagggcttttgcatgttggttgattatgaacaaaattatgaccaatgatcataaatagaatgaataggagatggcagaacacaaattttaaactccaaaagagtaaagtttgccttgtcctatatgtgctttctagagagttctataattccatgtgaatggcaatacatgtttttaatggccaatagtaatatttcaatagatgctagcatttcatttaataatttttatttatctgatggtcacaggaatcaataattagaagagaacattgcttaatagttaattaagttcctttaataatgtgacagttagacaagttgtctaaaggtgacatctccctgatctataaattttcaggctcatgggaacattgggcacatcttttgatacactgcagcttccttatccttgacactacctagtctatttagaaaatgtcaatcagtcatcaaggcaagatatcaattggatgactatgataattactccacttatacatatttttcctttcaattttcaggtatagatgcaaaaatttattgtactggtgtattttttcagactctacaattctaaatctcagggtagtgtctgtagtttcagttatattctaaatgaattgtttatttaatgctagttaatttccaaccacttttatcacatctctggttaaaagttcattccataaaatacattagctaaatttcctttcatattaggtagaataatacatcaggaaaacagtccaaaaatgtttcatagaatttttaaagactaatttaggttcatagcaatattgagcagaaaatacagagatttcccatctacccactgccctcacacacacatagcttcctccaacatcaacatcctatgctgcagtggaatgtttgtgaggttatcaattgtttatttcatagattgtggctttggtatagttacagttgatgaatctacattgacactttgttattacccaaagtccatggtttacattaggggtcactcttgtaccttctatgggtttggacaagtgtataatgacccctttagtattatacagagtagtttcctgccctaataatcatctaggctctgcctattcatccctccctcccacaaacctgtggaaaccactgatctttttactgtctccatagtttcacctttccagaatgtcatatagttggaatcacaaggtatgtagccttttcagattggcttctttcactaagtaatatgcatttactcttcctccatacatattcatggctcgatagctagttacattgtattggttggtttgtttgtttttcacagataaggtcttgctctgtcacccaggctggagtgcagtggcacaatcatagctcactgcagccccaaacgcctgggctcaaacaatcctcccacctcagtctctcgagcaactgggactacaggcatgtgccaccatgactggctaattttttttttttttaattagtagagatggggctagcttcaagcaatcctcccaccttggcctctgaaagcactgagattgcaggcatgattcactgtgtttggcctagtttctttttagtgctgaataatatttcattgtctggatcaatcagtttatttatccattcacctactgaaggacattctatttccttctaagttttggcagttatgaatatagctgttataaacatttgtgtgcagatttttgcactaatgtaagtttttaattcttttgggtaaataccaagggataggattgctggatcctttggtaagaatgtttagttttttaaggaactacttgttgtcttccaaagtggctgtgccattttgcattcctaccagcaatgaatgagagttcctgttgctctgcatcctcttcagtatctgatgttgtcagtgttctagatttttagtcattctcatagatgtatagtggtatctcactgctgttttagtttgcatttccctgaggacttatgacatgaagcatctttttcatatgcttatttgctctctgtacatctttttggtgaagtgtttgttaaggtctttggcccatttttaaaatcagattaaagcaaagacattcttattgttgagtactttgtacattattcttgatatattttggataacaggcctctatcagatgtatcttttgatgcatttctttcagtctctggcttgtcttctcattctcttattctcttgacattgtctttcacagagcagaagttttaaattttaatgaagcccaggttatcaattgtttatttcatagactgtgcctttggtgtggcatctaaagagtatcactgaatccaagattatctaggttttctcctatgttttcttctaggagttttatagttttgtattttacatttagctccgtgatccactttgagttaattttcatgaagagtgtaaaatctgtgtctagatagattatttttttttttgccacatggatgtccatttgttccagcaccatttgttgaaaagattatttttttctccattgtgttacctatactccattgtcaaaaattacttgactctatgtaggtctatttctgggctctgtattctaccagattgatctatttctctcttctttggccactaccatactatattaattattttagctttatagtaagttttgaagtcaggtagtgttagtcctctaatcaattgttttaagtattggaaatcttaaagtatgcggagttcataatgaaaataaaccaagaataaaggaatctttaagtgtatgtgtaaatgattaaagatatttggagaatgagactaaccatggaacactaatagggagctcattatttgattggcttttgatattagcataatattttatttttcatgggaactatattagagaaagaaaacaaataatagatgatactaattagctattgattttcaattaatctatgtattatcatatttatacatttctaggccttttctgaatcttatttcattatatcatatgttctaaatgaaaaatattaggtttgcttaagaatctttcttttccttgaatgaatttgtttcttggactgtttttgagctccttgaactgcaatcagtacttatgaacttatgtaaagaaatgttgttagttttaacatcactgtacgaatccaaaccatcaattatttgaatagtttagagggatatgtatttacataaacatattcacagaataaggccttataaaccaccctaggtaatgtcttttttaacataggtacaagaaccaaaccattgaagatttagaagcaatgaaaagttatcttattgtttgcctagataacttcacttaggaaatgtgagaaaatactggttacttcatttttaaaaataacatgaaccacgttgttttcattttggaaattttatgaaaatacaatagccagtaatgtgcccaaatatttttattttaaaatattgtttaataaaatatctacttgtttatttttccaaaaggataactaatttggaaattacaaatcccttcctctctaaatcatttgggtcaccaaacaaaaatgtttttcctatattctgtacataccttttcttattttcagaataatgactttgttagtccttacagttgcacgcgcgcatgcacgcacgcgcacacacacacacacacacacagacacacacaaacacgcacactagcagagaaatccagagacaaaggtagaggtatattctctctctctctctctctctctctctctccctctctctctctctctctcacacacacacacacacacacacacacacaccccacatgtaagatgcaggacacagtgtgctacatttatattaggaaactacaaattgtaacctcttatccctgatggtaggccatatttagcaagacagtgaagctggtaaatttctataacacctgggcagagttccaatgggaatatccacatgtttaagagacagacaaggaacctcatttaaccttgttactgccaatatgaacaagcagagaagcaaaaacaatgtgttctggacttttaaatggctacagcggggtagctattttcattattattattattattattattgaattttatttatttatttatttaaagacagagtcttgctcttttgcccaggctggagtgcagtggcacaatctcagctcactgcaacttccacctccccggttcaagcaattctcctgcctcagtctcctgagtagctggaattacaggtgcatgccaccacatctggctattgttttgtatttttagtagagatagagtttcaccatgttggtcaggctagtcccaaactcctgacttcaaatgatccacctgcttcagcctcccaaagtgctgggattacaggcatcagccaccatgcccagtctattcctgaattttaaatttagagtactgctgttcttctctgggcctaggtcagacactttgagagctacattaagacttgcagacctcttaagggacccttaaaagcctttcagtggcaatttactaaatggtttcccttagcggaatgaaagtttcatgtctccccaagtgcctcagcctctcagggctcagagggaaaaaagtgttctttctgtttgatgatgatagtaccattattttccattgctttttcagatgccaatattacatcaaggtatcatgatgtaatgattctactttcatttcagataaattagtgcctctagtatcctctctctgagatgaaggaagaggtaatagtcttgctgaatcaatcacagataatagaaatgctagtgaaattacccactgaggctttcccaacctctctactgaatgaaaagagccctgaaaagcagtccttgctcaaaatgttcaaaatgttaccacacttttctggatcctagctttctcaaatgaaaagtaaaatcattgaactgaatgactgctatggaaaattctaaccaaagcattccctgatttttaggttattgaatatcacagtcagcaatgtcacgagggaaagggaatcttccagattatcacaaataaaaaaattcattaaaaatagatacatttttcattcttagattttctatttctcaaaaccacaattctagtacaatatccagatttttaccataattgcataaggagatgtctccttaagtaacccacatctgacattaaccaaattcatcactttcttcatccctaagtaacctccccctactaccttctgttatttagattatggtgacagtacagaagttctatcagtgtaggtataaagaatgaaattaattagtcatgacaaggaaagttacttggaaattctggcctgtggagtgtttgagttaaaacatctaagagtaatctgaaattggagctcagggcagatgtggtggtgaaatacttgtgggaacctctgtcatggaaagttatggatgtggaatgactttatccaggaaaagaaagacaaatggtaaaacaggtaatatagcaaaaaggcaggatatttttttccaagtaatagagaacaatagaaattgaaatgcagatatatacagtgtataaacttctaaaagctaaaagcctgaagccctctaacatctaagctgtcaagaccagtcatgcacaagaagaaattcaatcctcagggctgtgtttcccagctgggttacctcacttggattctggccaagttggtagctctgaagacaatcaaaatatatgcaaattaagaatttgatgctcaaacaccctgtttatttatttaaagacagagccttgctctgttgcccaggctgaagtgtagtggcacaatctcagctcactgcaacttccacctcctgggttcaagcaattctcctgcctcagcctcctgagtagctggaattacaggtgcatgccaccacatcaggctatattgaagctgtggagcttcaattgttttgtctcattttgctaaaatatgttttatttcttggtgattccatatttaaatttcagtaagtcattctatagtctaaagatatatttaaggtataatttagttaaatgaatagagactttgaaatcctgtggtccagcatactatgctggctcttccccttaaggagctatatgactttataatttttatttgactctatatgaaacaattaaaaaaaaaccaaacaaccaaatgtcattctgtgtctcagtatcttgtggatgatatagctattccctgaattatgatggttcaacatatgactttttttttttactttataacgagtttatcagagtgttaactgtactttggacctatgatttttttttttatttgacggagtctcgctctgtcacccaggctggagtgcagtggcacgatctaggctcactgaaaactcctcctcctgggttcacgacattctcccgcccccgcctcagcctcccgagtagctgggactacaggggaccacaaccacacccggctaatttttttttgtatttttagtagagacagggtttcaccatgttagctaggatggtctctatctcctgaccttgtgatccacccgccttggcctcccaaagtgctgggattacaggcatgagccaccacgcccagcccggacttatgatatttttgacttgcaataggtttatcaggacataacctaactgtaagttgagaagcttctgtaatggtatttgcctcattgagattattgaggcaattaaaaaaggcagtgcatgaacagggacttgcacatagtagataattaaaaaaatagttattctaaattgctctatcacagtaaatacacatagtgacaatgactttcacaaagactgaaatctataatttatttaatctgacttcccattcaagagaaattcagctgatcaaataggaatgtcaatgaataacagtttgtgtacataatcatgcacagggagaaaggcatgaaacacacaggggcaagcagcaaaactccagctgttattgtattggaacagggaattagaacatggattgtctaggtgaagctataatttctccctgtcaaattgccacttagttagagtttttaaactaggatccctaggtgaggttgaagttgtccatgaatcatgaaattatgtgcaaagttctgtgttaagctatgcacattttgtcatggcaaacagtccataatttacatcagaattacatactaaaggaacagttgctgactgaataaactaaattagaatagctctagaacttttgtattatccaaaataaaattagaagaatatcttaagtgaaaaggcaaggaactagagaaagaataggtgtttaatatttccctcaaaataaacagtacatttatctgcttcattatttgtttaccttaaaagataacgttacctcttacaaagaggagctgctaccattccttctgaaactattccactcagtagaaaaagagggaatactccctaactcatttaatgaggccagcatcatcctgataccaaagcctagcagagacacaacaaaaaaagagaattttttagaccaatatccctgatcaacattgatgcaaaaatcctcaataaaatactggcaaacagaatcctgcagcacatcaaaaagcttatccaccacgatcaagtcaacttcatccctgggatgcaaagctggttcaacttacgcaaatcaataaacgtaatccatcacgtaaacagatccaaagacaaaaaacacatgattatctcaatagatgcagaaaaggcctttgacaaaattcaacagcccttcatgctaaaaactctcaataaactaggtattgatagaacatatctcaaattaataagagctatttatgacaaacccacagccaatatcatactaaatgggcaaaaactgaaagcattccctttgaaaactggcacaagacaaggatgccctctctcaccactcctgttcaacacagtgttggaagttctggccagggcaatcaggcaagagaaggaaagaaaggggattcaattaggaaaacaggaagtcaaattgtccctgtttgcagatgacatgaccgtatatttagaaaactccgtcatctcagcccaaaacctccttaggctgataagcaacttcagcgaagtctcaggacacaaaatcagtgtgcaaaaacacaagcattactatacagcaataacagacagacagccaaatcatgagtgaacacccattcacaactgctacaaagagaataaaatacctaggaatctaacttacaagggctgtgaaggacctcttcaaggagaactacaaaccactgctcaacaaaataaaagaggacacaaacaaatggaagaacattccatgctcatggataggcagaatcaacatcgtgaaaatggccatactgcccaagataatttctagattcaatgccatccccatcaagctaccaatgactttgttcacagaattggaaaaaaactactttaaagctcatatggaaccaaaaaagagcctgcattgccaagacaatcctaagaaaaaagaacaaagctggaggcatgacgatacccgacttcaaactatactacaaggctacagcaaccaaaacaacatggtactggtaccaaaatagatatatagaccaatggaacacaacagaggcctcagaaataagaccacgcatctacaatcatctgatcttcaacaaacctgagaaaaacaagcaatggggaaaggattccctatttaataaatggtgctgggaaaactggctagccatatgtagaaagctgaaactggaccccttccttacaccttatataaaaattaattcaagatggattaaagacttaaatgttagacctaaaaccataaaaaacccttaaagaaaacctaggtagtaccattcaggacatacgcatgggcaaagacttcattactaaaacaccaaaagcaatggcgacaaaagccaaaatagacaaatgggatctaattaaactgaagagcttctgcacggcaaaagagattaccatcacagtgaacaggcaacctacagaatggaagaaaatttttgcaatctgcctgtctgacaaagtgctaatatccagaatctacaaagaactcaaacaaatttacaagaaaaaaccaaccccaccaaaaagtgggcaaaagatatgaacagacacttctcaaaagaagacatttatgtagccaacagacacctgaacaaatgctcatcatcactggtcatcagagaaatgcaaatcaaaaccacaatgagataccatctcacactagttagaatggcgatcattaaaaagtcaggaaacaacagatgctggagaggatgtggagaaataggaatgcttttacactgttggtgggagtataaattagttcaaccattgtggagcacagtgtggcggttcctcaaggatctagaactagaaataccatttgacccggtgatccctttattgggtacatacccaaaggattataaatcactataaagacacatgcacatgtatgtttattgcgggactattcacaatagcaaagacttggaaccaacacaaatagccatcaatgctagactggagtaagaaaatgtggcatgtgtacaccatggaatactatgcagccataaaaaaggatgagttgatgtcctttgcagggacatggatgaagctggaaaccatcattctcagcaaactatcacaaggatggaaagccaaacaccacatgttctcactcatgggtgggaattgaacaataagaacacttggacacatggcggggaacatcacacagcaaggcatgtcagggggtgggggctgggggagggatagcattaggagaaatacctaatgaaaatgacgagttgatgggtgcagcaaacccatgtaacaaacctgcacattgtgcacatgtaccctagaacttaaagtataatttaaaaagataaagtcacctctttcagataaaaactgctgaggctaccacttaaaaaaacaaaagataatcactgtaagtttgggctttaaaacagttaaaagttctgtcagtatctgatacttcttagttagaaaaataatagtcgagttgctttttactattgttgtgaaaaaaagttgtgtgatatttagactcgtgatgtttgccatggataagtggctgtgttatcaattaagttgtctctgcaggatgaccacacattgcacactagagtagcattttctgttttttttttccatctttttttatcctatgctatttcactgaaataaatgtgaaactgaattcactgcagttcttaacatggaagtttcttctttctcatcaagaccacacagagacaacaagcttagaaggaaaagtaaaacattaccatttgcctaggcctgttcataactcagcacctattggtttcagcaggctaaagactaaaagcactatcaagctagcaaggaaaaatcactgtaatgtgtttagatgtgtggtcttgtcattttttcctgacttgctctataaaagtaattatagttttaggcataatctcccaattttaggcttgcttccattctctctctctctctcttacacacacacacgcacacacacatgcactttatctctcaataacctcatcaaaacagcaacaaggcagaaagagacaggtgagttctgagtaaaatatttgattaattgaccccaaaatatttttcctactttctctctttttaccagaaatcatatataccctggatcaaaatatgttaatcactcatattctcttaaaatcctaatatgttcccagtatttaataatggaaacattgtagagtcattggaattttcatatgtgataaaatttttagttgctgtaagaacttcagaacctgtgaaaatattcttttgcatgtaaaattatactaccagtatactagccattagtagatccctccaaaaattctcaggccagctcatccgcaaggagagatcttaacaacatctcacttcaaagctatcacactggaaacagttggaggagacaaaaatgcacttcactggcaattcctgatctgagaaatggccaattcatagagatgttgaacaaacccctttctgtcatgaggtctgtgaccaatttaagaaaaaggcatacatacacaagatgaatgtcaaataagtattccagccagtgactgttattggggactcctaacttctatatgggttagagaagttaggaagcacttcctgcaaaaatagtatttaaacatggttttgcagaaaggctaaactttaaatagcaaaaactgttgtctgtgaagaaaaacagtcagaagttgggtgggaagaatccaaaaagtgaagctcaatcactttacttctctcctataggattgaaatataaaggatatgggagattgagtaaaagtttggaagaatatatattttttttcctatttatgttttctagtctctagccaactatcagaaaaagctgaaaatggaaaatgcttctgcaaattagaggacaggtgaagactcaaattgggtagtccaccttggagagtaggtgggcacatctggattttgttgtgtgtctatgtcatttgacttgtcttaatgagtaggtgtttcttttatggtttggaacaaaaaaaatctaatgaagtgttttgtcacacagtaatttcaacatccttttccaataatgaatagattctactgaggctcagatgctagaagacaatcccaaatcatcagcaagcagcccatgtgaaagctccggttatacaactaggaaggaaagttttactgtggattctgccattgacctttggggcctgtgtttctcacctgtaaaatcagaagctaggagatgacagctaaaatctaggaaatcaaatcataatttttgttacaaacatgtataaactttaaataaatcagattggagtaagggcctaagatgtgttcctgtgaggaaagcacatgatcttttgtacacggactttttgatatttgttttggctgcccagagtcctttagaaacgctgtctgagctccagttattcatgattagttgtattcaggcattctaactactgcactatttttgtttgtttaaaagggctaaagaaagcatttatacgttctgacaatgcatctatattttccaaatattaagtgagaaagaatggaaagtgtgcccttatgggctggattgtgtcctcccaaaattcatatgttgaagtcctaatctcctaatatggttgggctgtatccccacccaaatctcatcttgaattttagctcccataatccccagtgttgtgggagagaccaggtggagataattgaatcatgggggtggtttcccccaagcctgttcttgtgatagtgtgttagatctcacaagatctgatggttttataaggggcttcccgcttcactgggcattcattctctctcttgccaccctgtgaagaggtgccttctgccgtgattgtaagtttcctgagtcctcccaagccatgcaaaactatgagcaattaaaccaccttcctttataacttacccagtctcaggtatttcttcctagcggcatgagaatggactaatgcttccccagtacatcagaatgtacctgtatgtggagataaggtctttgaagaagtaactaaattaaaatgaaattgttaccataggccctaatccaatatgaccagtatacttataagaagaggtcatttggacacacaaagagacgtcatggatgtgcacacagaggaaagaccatgtgaggacacagcgagaaggcttccataagccaagggaagaggcttcaaaagagacaaaactggccgacatctttatcttgaacttttagcctccaaaacagtgagaatataaattcctgtcgtttaagacactcagtctgtggtattttcttgtagcctagtaaactaatacatgtgcctttctcatcttccatttatctaaaatagttgagaatattgctgcttcttattgggtacttctatgattgctgaccaagaaaaagtgacagaatgtgtctttatttttcctgtgattaagatagaacacttatttataactttgcaatccactcttcagattcaagtgcttgagaggcaccttctccaagtgtttgttaaaactccagcgaatacacatgtacacagttttgatatagtggcaaaaaatttaggttcttttgtgatcagatttcacttctattcttaataatcagtgaaagtagacgtgtgcttaagctcattatttctagtgatcagaagcaatctgaacccacataatatcaacaaaagtaaactaatccaatcaaatatctgtccaattccacagggaaaaacagttacagtggttatacagtaaagtatgaaattttaaaaacatggttgaatatctttcaactaattatttcttatagttcgatataagtggcatattgttccctacttttcatccctttaggagtttaggaaggcaggaaaacacaacctataatattgtaggtgataacccaagtgtaccctgttataatatctgatgcagtctgaatccatttgctgttttagtattgccaagcataccttttccaaccaattttcttccattctcagacatcccttcaagtatatactttaagatatatatggatcgtagatgttctaatggctagaacaattgccagtatgtttccatcacttctctgaataaatcacattaaaaagtcataaaatgctgctatctagtgataaatagaagcaagacaatttgcctgcagtgtttgttaaaagattatgtaatctggcatctaatttttacagatgaatattggatgaaagtggatgatggcatatcttgcagggagcttttttaatttaatatttattttatgctctttctacagaatatttaaaatggactctaaacatagcattgaatggttgaatttgttatagggaaaatcagatacaaggcttcctgtatccaattcatagctgcaattcttgcctacaaaatctttactgccagaaaaaccattaaaacagtaatcaattgtggagtgtcatgcccaacagaatagcataacacaaaatgaaactttgccagttattgaaaacatgccccaatatagatttttaaaatatgactaattgtatgataaaatttccatattagttactgtttgaagctacaatgttaagcattcttagagaaacagaatggctcctggttttccttttgatcagtatgacaaaatacggtgtttattattgaataggtttatttccattttcaaaaatagcttttgaatagcttcttcacattcaaagaaaagtagatcatgagtagataatataacacaaaaacttagccaatcaaaccttacaagaaatgagccctaaaatgatgtttcacaaaattattcaaatgaattcaaaactcaagtggaagtgatttttgaaatatactttccagacagaattgacagaatgacaagtagaaataacccagctgccaataattttctaagtggtcagaccaaacacttccttgatctttacaacaactctgtgagatagataagacttttgtttttgttttatagatgtggctacccagagaagataagcaaattaccagtgtctaaagtgataccgccagcaagtggcagtgccaagattacagcaaaagcagtctgcagtctgggtggcgcttacacactcttaatgattctgcttgtaatgccattattcaactttccagttaggaacatgaaagaaagtctgtgcttttgacacactaaaaaggtcttactaataaataatggtattgttagaaattagggagccagccatacaggtgacaaagcgtctatgaactactgttctgtggtctgctgataaatgattattcaaaatgtattaataatacagggagataaattacatgtcataggctcacagaagctaaatatatcaacctttttaaaaaaatgattcacttgagctaatgaatgctttagctgtaagaactggcaacaaaatgtaaatagacaactttctcagataagacatgtacagataattgaaagagcagtaacaacaaaattaaagacacaactttaaaatatgataaaataggtacaaaatgactttcatacttaattcacaaatgtaagcaaagaggaatatggctttatagttataaagttacccaaagaccgcatctaaacagtgatttactttagttaaaatttatcagataatactattttgctggtggggagcaggcagagtaataagaggagttacccacatctcagcaaatatgcaaatctttattttgctttgctatattttcaggtatattacctgctattaacattgcagattttatacactgaaggcttattaaaagccattgaaaatgaagtataaagtcttcctgtttgagcatataacctaaatcaaacaggcaataaaagcaagccaaatatttgattactagtatatttttgagaccagtgtttgaagtgtgtagatgcttaaaattaaatgggtacctttatttgtgaatctaacctactatctaacaacttaatatgtaattttaatcatatctcttcaaaattaaaaacattcatgtctttaactctagaattgtttttctagaacttattctccaaaaagaattgtaaaattaattagttatgcaggagaataattttgtagcattgtttctaatagcaatgaattagagtcaatctaaatgccaataagttaaataatcatttattatgttgtgtagaaacacaataaatttctgcaccattacttaaaatattaaggtagttctcagactaatggtaagatgtccataatatattcttaactgaagaaaactagtgtcagagtaatgtggacagcattatcaaaattaaaaaaaaattgtgcagattttataaagtttttgtacattgtacatgagtacatagccaaagagactggaagaatgtagataaatcaattaacagttgttatctggtgaatgaaactattggagtcagtcctcatctgaatgaggactttcatttttctcttagcataattatatttacaattttaaagagtagatgtatcactctggtaatattgtttaaaaatgattacaaattaaagaaaattaactcacctgtgaagattaaaaaataagtttgaaaagacattttgtgagagaaattaatacatctaaagaaagagctaaattaacatttctgacttgtgtgtgaataatgaaacttataagcaaaattaaaattcaaaggtaagcatacttgatgggaaatattagcttcacatcctttaattttttaacacaaactttcacctcaaactttgtcaaatattccccaggcagggttggaaatgttaagtcagccaactctttcagtttatggttccaccatcaagaacaccatgactcttatactacttaagcaaccattgccagaaaatttctctcacttttataccttaaaacattttcctttgcattaaacctagtgaaaaatagaaaaagaacaaacgatttttgttttagacagtataacaaagtgagtgtatacagaaactccacctggtacagaacagattgtgtgtggggtaggggtgcatatatatgtatatcatgtctaagctgatgtaaaacaaaaaaagaaaaaataattaaaaataggaaaaaaagagaatatgatttcacaatggtaaacttaggggctggcatttatcctgaggaaatatgctaagctctaggggcttagaatatttttgaaaggagtatttatccttagtgaaaaagctggagttgggggaagcacagggctttcaagcaggtggaaagttggatcaaagaaccctcaatatctcaaagtacaggacaaaagtcacaactccagcacataaaccggattaaaacccatcccacaaaagcacaccatctatctaggcctggctttggaaagaaagactcaatcccgaaaggtaaaaaaatgaaaataaataaacaaacaaacaaataaaccccactaaagtacaataagttttaagagctctcataatagaaataacaaaacagtcatcacgaatgaatctaaatatgcatgtaaagttaaggaggataaactaaatattcagataatagatttaaaactaaggaatgataaaaatgctatatatgaaacttctataatgtattaaagtggtatgtagagaaagacaatctttaaggctcacattagaaaaaatatgagaaattaataaactaagcatctgatttgagatgttagaaaaggaacagaagagtaagttcaaagaaagttaaaaaaatatgattaggagtaggtattaaaattaccatatgaaataagccatgaacactgttatgccttcaaatttgaaacttaggtaaagacatattttggaaaataatatacatcattaaacatgactaaagtagaaataacacgatttaaataacaatttgaaaactgaattattaaaaaattttcaaaaatatcaaatgaaaaatgggacattatcaaggaagaaaggcatttaatttaaaaataccttttttaagagaatagaacaagaagggtagtctattttatgtggttcttatagtcttgattccaaaaccagaagaggtcattttgataaaagaaatctcaaatttttgcaaatatactaaaaataatagcacaccaaaatggttaataaaagaagcataagacatcaagaccaagttggatttattccaggaatgtaaaatacaagtttgtctcaacactagaaatttccttatttaattagtttaagacattttagattaaaactaaatgatattgggatatagacaaatagatcacaatatcattatatatatatatatatctatagatagatccagatatatctagatatatctagagagagagagtcatcttgataaatacagaaagggtattcaatacaaacagctgatggatggtgaaagctcttagaaaactaagaatagaatcagggaaatgcaacttactgcctttaataaaaattattggcaaaagcaacagggataatattgatgggataatatttaaagcattgtctttaaaatgagaaacaagaaagaatacctgctgtcaccttctctactcaacattatacctgagatcctagcctgtgcaacagacattaaaataaataataatactggtcataaagaaacaaaactctaattagccacagatctgattatatataatgggagcccaaaagaatataaaaacacattattagaattaataagggaatttagtaatgttgctggatttaaaaccaattaacaaaaatcaactgcatttctacatacaagcaacaaatatttagaagtgaaagttaaaataagatactatttaaaataagaacttcagtattaaatattttggaatatatctaacaaaatgtgcaaactgtatttagaaaattgtaaaattttattcaaaaatgataataagtaatacctaaatcaatagaacacataccatgttcataactaagaaaattcaatattgtaaagacatcaatttttccctaatgtatcaataaattcattacaattttaatcaaagttccaaatgggtaggatgggtgtatgtgtgtgtgtgtgtgtgtgtgtgtgtgtgtgtgtatgtgtgatgtctgtgtgaactgatgaagaactacttctttatatggtgatgaaaatagctaacatagttctaaatgagaggaattgagcaggaaaatttgccttcttagctttaaatgcttaatataaggctacagtaattaagttagtttggtgttagcacacttacaaagatcagtggaagaaaagataaagtcataaaattaagatatgcatttaagaaatgtttacacagtatatgaaaatcaattttgatggaaaatgacataacccatcatgaaaggtatattttaaattaaaaattcttcaaaatctttatgattcagggtagaaaatacatttttaaaagcacatattaataatggaaaatattaataaactgactactatcaaattaaaaacttcagtatatcaaaagacaaaattaaataagtacaaagaaaaaagtacaaatgcaagctgcaaactagttgaagatatttccaaactgtataaatgtgtcttataagtgactcctatgaatcagtagaagaaaaaaatggcaaaagacatttaagaaatttaaatgactcacaacctgaaaacatgctttaccttctttgtaatcagggaaatgcaaattcaaaccaaaacctgatactatttcaagtcagagtggcaaaaatgaaaagaagacagtattatgtgtttgagaggacatgaggcaacagtaactctctctcctctgctgatgggagaatactgtatcgatttcttggaaagcaatttggcatcattttgtaaagctgaaactgcccatatcttgtaacttgcaattctactcttaggtatactccctagagaaaaatcttagaaatgtacacaagaagacatgtaaaataaagtttgcacaacaacgacagcaaaatctggggtaatataaatgcccatcaacaataagatagataatttaacaattacagctctgttgtaaaataaaatatttcaataaaaacaaacagcaactctccaactgttgcattttttccctttgtcatgctggattatggggaatattaatgctcaaaatactgtcgatatggttgctgtctcacaatagtaggataaattgaacaatgtgtataagtctctgggcatatcttaatattctctattagattctatagtaattttgaccataaaaccttaaaaagaatccaactataatagctacaacatcatttctaccttgactggtgtgaatgtattatataaaccatgatggagtctctgtgccatactatatattcacgccaagaaatgcacaggtaaatgaggcagcccttgccctccaagatttttcagtttaaaggtgaagacagacttgtaaacaaaatttaaggaagttatcacagtgttataacatgcaggagaagcaaagaggaagaaccaactaaccctgcctgaggggatgagtgaaatttcacaggaggtgtgaccaacctgatgaaatggcatggctcttttgaggaatgttgagtaattgtgtgaagctgatataaaagaccttggcattagatgtcagcaaaaattgatgccaggataaattgaggtcagatcaagaagcgtcttgtgtatgatgctaataggtcatgattgcatcccgcagaagatagtaactcatgaacacagtttaaataaggaactgagaggataaggtttgtgttatagaagagcttagcagtaatatagagggtatacttaaaagaggtgtgatttttatatataaatgtcctttccagaatttaatccctctttaacttgaacccttttttctgtggattatatattctagcagaaaatagccatgagaatgtaagaaacattcaacaaaggacattgaagtaaatacctccctatagaactatctgtgaaaatataaagtcatatgtctgcataacaataaatacaactgtggatacagaaagaatagagtctaaaatcgaaaaataaaacttcatgctgaaattaatactgttgtctgaaatgaagactgaaagtatttcagttttatatatttcaagaatatacatttatatattgcgatatgtgtgtacatttatatctttataaaatatagaatatcatatataatctctatatattttaaatacattgaaatataaagtatatatgtatatatgattaatatatatattcaaatgccagacatcttatggtgaaatatttttcttaattattagatttaatgatataatttttattacttaagatattaatctgtacttttgtatcccataattagcttaacagcttagtggagaacgaagaaaatactagatggataaagaaaacttaaaatattctttaaattgcacacttactatgttttgtaatagtcaaattacttctgcataaataaaaggcatgtccataaaacaattactatgaaatttagaatagttggaaaattccttaagactctttttatctagaacaatctaaaagagaagtatgtctgttcaaaaactctggctttattttggatttgtttaataataataaaaaacaacttgtaaaagacaattaagaaattcaatgaatattttgaattgtgacctatgtttgtccactgaaatttaagtcctactattaaattcttttctttttttttttttgacagagactcactctgtcaccaaggctgcagagcactggcatgatcttgggtcactgcagcctcaacctcccgggttcaagacatcctcctgactcagccccccaagtagctgggacaacagggacgcatcaccacacctgcctaactttttgtattttttgtagagatgagatttttcttttttttttatctttttcttttttttttttttttttttgagacggagtctagctctgttgtccaggctggagtgcagtgacacaatcttggctcattgcaatctccacctcccgggttcaagcaattcttctgcctcatcctcctgagtagctgggattacaggcgcccaccaccatgtttggctaatgtttgtattttttgtggagacagagatttgctatgttgctcaggctggtcttgaactcctgagctcaagtgacttgctcgcttcagtctcccaaagttctgggattacatgcatgagccacggtgcctggcccctaccattacattcttaataacataataaatatttattagttttatcacaacctgacatttaaataagagccatgaagtcttataatgcatatattgtaccactacagtagcatgctatagagaagatattcaaatatgattctttcttttaaaaattcagttaactgttttgtaggctaggaagactatctttgctaaaattattctattttagcataaaacatgcaacaacttggacagtcaattttaagaaaattatcatggaaaaagtaactacattggagacaaatcttaatatagagcagagaattttaacctttgggagaagttacacctctttgggaagctgaaaaaaaaatatagatctgaagtgcatcttataaatatgtatgttgcccaaaaacacaaatatttacaaacaagttttcagagtttatgaaatatttgaatcctattccaagtttaaaacctttgacatacagagtaacaaacccatcacactcacaagggtgataactgatctcccagtagtcaatatgttatttctgcagtcttgatttaattttctggagtttctatgttatttctggagtcttgatttaattttctcaattctacttacccaagaagtgtttctattttcaagtactagatcaagtcctaattcctccagaaaatcatctttgattttaagtgtcttccaaactttaatggcaattattatctgtatcattcatttatctttcaacctataaaaattattctaagtttccgacttcataggcactaagtctcttggaggcaaggtttgtgtattacaacaatttccatttccagtgcctagcataaaggaaagcacatttataatgacagccaacacatactgattaatattgaaatcattttattattttaaaaggtaactacatacttttttatgcaatcccaaatattatgaagtgataccattaaatattggtttcctgaggcccaagtgttcgtaatttggattccattgacttgtatcagatcatgttattttgtttccttatacttcttttggtttgtatgcatttactcaaccttcctgctacactgatgaaccctgaaagtgaagagtacatgtctcaaagccaaaggataccagctgatgtcactgaaaagtatagtagccattcttctttattatagatcactttgccccattctgttttcaaaaagctaaatggaaatgacctcacaaggagaggtacttagctctcccaattattgtattccagagaaacaaagtgtgtgttccagagaaacaaagggaaactaaatatcggaagatgcatatttatattttaagctatcctcaactggcagctatccctatgatgattttcaaatagttaattatttacaatacaaacgttggaggaaggaattcttttttttattattatactttaagttttagggtacatgtgcacattgtgcaggttagttacatatgtatacatgtgccatgctggtgcactgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggtattttgttcttgtgatagtttactgagaatgatgttttccaatttcatccatgtccctacaaaggacatgaactcatcattttttatggctgcatagtattccatggtgtatatgtgccacatcagagaaatgcaaatcaaaaccacaatgagataccatctcacaccacttagaatggcaatcattaaaaagtctggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggaaggaattctttaatgtaattttatttttattaaaaattcttcagtaaaattagaaaaaaaaacttgccatatcaatagtcatcaccaaattagtatgttttatactctgtggtagaaatagtctcaattatgattcagggtattgcagataatccgcagtcttatgagcactccaaattcaagtgtagggagaaatggttactgtaataaaataagtccagtaatcatttttaaaacatagctatttagccttaggtttattcttgttatgtatagcaggtccggaaaaatgatgtaccaatggctccccaaatactgtttttcctgtatggctaaggcagttagtaacaatggacatctgttgttcatgtgatactcatccatgacaatcaagaatcctttagtaacccagactgctattttccaaaagttcctccctcaatatcttatcttgcggatcagaagtctatattttcatttgtatcctggaagatgatgaattcccccatttattaattcctgttatacataactatttatccgtctgtctcctaatttcctaggaaaacataaatccgtcatattaatgaaatcagtgataaacttcagttaaaaagtagaaatacacttgtaatatccatgtctgaatacaaactagagttctctgtattttgtaatgctggtggcaggtcatgatattcattcacaaaagctgccaaaggagacacaaaaagaaagcgaaaacttgaaataggtcacttcttcacgttgacaatggttgtggtttaaagttacctcaggcttttttgctattgataaatctttcaaatatattcatctctcacttatttagggactgattatccaatttgtgaactatccctgtggcttctcctcttttctctaatgatttctcctctgcctatttccttaaatcgttttaatactaaatgagctgcatgaaaacagaaaagaagctaaagcagcaaaatttgatacatataaacagtactgcaaaagaatttcatttgtgctcatatgtttttgaattttcaattttctgttaccccacttccatatttcacactccagattatgtcaccccacccaactcccaataatttgaaattcaaatttggaaattcatctattggttcatttagttggaaactgcatattcacaggtggagagtggaatatatttcaaaaccacagagaaaaaaaaaaaaacgtaattcaacttcgttaatttgtttttaattttccaaagctggaaattgtctctatatctcaattgatgagtttctgagctaaaaacaaaacaaaacaaaacaaaacatcatttcctgtaaccagatttcactgctttcattctaagcaagatgatataaataacaatgagtagtcaagtatttattcacataaaacaatcacatttacattaattgtttaacagaaatctttgcaaattaagcactctgacctgataattctaggcatctcaatatagtgaatcatgatcttttgggaatagagagtgagagaaaaagtgacctcagagaagtaaagtataaacattcattttacgcagatggctataggttttgctctggacatttaatatcttattccaaatataaaccaaagccagaaacaatactgggatatgttttatgcctcaattgcagaaaggcttattgaaaacacactgaaacttcatagagatgctagtgtgggtacagaatgtagtgtttaattgcaagactacagaataaaacagttgattgaaagcattctcagtggatcattctagcctcttctcacaattctcgcctgaagccccttgataaaatttgttataagcttaaggaataaagctatattaatgattttctgaatatatctaatttaaaaagtacagctgtttctcaaaatcatgaaactaactttaaagccaaatacacgtggtttgaggttaattactattttcaattatctatgtcttggctcttctctgatcagaagaaagatgaaggaagagtattatggcctgatctcatttccgtcctcaagaaattctgattacaaacgaatcttctatggtgatgacttgcaaaatagcttgaaatgcaacagttattcaactcaaaacaccaaaattatttttccaaaatgacttcagcaaatcatgaactaaaataaaagaacgtctataaagacatttttaaaagcactatgctaaataattttacatacccaggaagtatgcaaatgaaaatgactaaaagaggtatttggtatataacaatgtttttcttgaaaaaaaaaaaaaagatggcattttttttcctccaaaggcttttatggccaagtattggaagactggcagttcatacacattttacatttaacaggaaagaataaactgggaataacttctcagataaatcttcacaatgcaatgccaaactgtgggcataacgtgataatacatggagcacttataatctatgagatcacccaactttcaggaaacgaataatggaaaagtagaaaaacttatcagatgctcaatttgaagtttgagaaaagttaagggtattttaagggctgagagtgcgcctaaaatagtaaaaaattaaaataacaacaatagtcacaaggacaataaacactaatatcatgtactgatttggctcctgtatgttaagaactataattaaatagtttattctatttaatcttctatgagtaagatattattatttttactttacagaaaataagattttctcagcgtttaaagaacactttcaaagtgatatattcagtaatgttggaagttggccacaaaatttaagtcttttgcattgataaaaccataatctttgttttacattacattgaagatccaggaaaagaagaaagagaagttaatgaaaaaatatcctttggctcttccattaaataaaaaacaaacttggttgattgaaatatatgtgtgatacatccaaataggaaaagaaaataggaaaaatagctccatttttccttcgattttttaatcaaaataaagtaactatattaccataaacatacaaccatgcttccaaacacaatcaaaaacctagaaatgttgcttactctacttatcccgcaaatgtgtcctaaatacctcagcatttattgtagtcttaaagatgcctgtgacaaaggcaagtctgtggaaatgttgttatcatttataatggcaaacttttagtaggagctagaggtgggagcagtgatttcaaaaatacttggcaagccctaaatcaaattttgaaaaacagaaaaacatatatatttatacttactaacggctgccatataagttaagagaacacaagctataaagtcagaccaaaccagctttcaattgcttgcacatgttttatagaaatgttagaaatgtgtgaccttggacaagttaataatgtctgtcaacctctgcattagttagggtgatgctaggagttcaacaactaaacactagtatctcaggtttttaaaacacaagttaatcatgttcatttaaagtccaacggatgtacctcatggacaactgtctcttctccaagtagaaattccaggactcaagttccttccatctgtggttccactgtcttccacgagtggtgaccatgggttaagtcagagaatggaaaggagaatggaagagaaagtgtggtgaagttttatgggccaggcatagaaataaagcatgctatttccattcatattccattggcatgaacttggccctgccacttcatttcccactttttaggtagagtgaacaaaatggtatggtgaactctagaggaacctcttaacaatttctgccacagccttaatttccttttgtaaaattgagagaaaatctaatttgtagtgttttgtgaaggttacttgagaaaatgcagatgacaaatttaggagaaatgttttcatattgtaaatatttactaaggagtaaccattattagttgttttactagttctcatcaacatcttcctagcagcaagcattaccaatttctaggaatataaattaatttaaaaaaagacattccaatgagactatagcttttccctccccaacccaacctgttccagagtctactcattcatttgctacaaagtatattgtagacttactatctgtcagaaactgttctctctggtgaaataacaaagcgtaagctctgatgcattttctcaggagctcattatactagaagaggcagaacacagatgggaaattcagatataatagtttaggaatgatgaaaaagataaagtagctaatgcacttagtagatttcttgccatgttataagcaatcaataatactaatagtgacataagtgcaggaagccattgttgcactgaaaatctactaaacaagcttacaaaatgaagtcagggaaggaatcctggaagatacgggtgtgtgttgtggtgaggggtggggatgaatactaaagaaagggacacggaggtattcctcctgctaagaggatgtgataagcagaagcacagaggcattacaaaatggaaatagcttatacctgaactagaagcctatagtgattgtgggaacaaagaggtttagaatgctttgtatgatattttaaggagctagattgatttctgtaaacaatgggaagtcatttgagaggctttaaacagagaagtagcatagcaagatatttgctagagcagtgagaataacggatttgaaaaacataaggctaacataaacaaagagcagttagagaacacgtgtaattcacccaatgtaaggaaggcaatgaagttatgagctagagcaagatggtctgtagtattctttctaaacattaatgactcaagtctaatcatgagaaaacattttgaaagaacaaattccatattatatttaggaagtaaaataatcaggacttaataattgattgtataggtgagctgatagagagtctaacttaaatggctagatgaatggtgctgcagttgagactgatcaaaaaataaaataaaaaaaaaggagagacagcaatctagacgggatataaagagttcactttttaacatattgggtttgaagcaccatgcagacttacaggtaggagcattcggtggggagttaaacatgaaagtctgaaacagcaatctagggtgaaattatcattttgagagtaattactattttagtagtagtgaaatcttattccttcctggtatttgctttgaaaatggttttagcacttaactggtagaaaaattgatttttttcttaagtgaggaatctataatcagtcacatcaaactcctaaagtagtagaagtaatgagaagaagtagaaaccaagcctcctaagaaatattttcatacacaggcactaatctcgtttaaaattgcttccattgtcttggaagggcctagaagcagtgccacttctataccctggtagcaatgagcgtatctggcacccacatcacaattctaaatactgttcttcaacaaaaataactatggatccctagaaaaattgcagattcaaactggggaagagagaatacacggtgaatcgaacattgtgtagtgccagaaaataaggaagtgctaaaaaatatacggtatcctaacaaaagaattagctaaagctagatcaatttgagaaacaaaataaatgacaatagtatcgaataggaactgaataaatatgaatctacgctgatgtaaatgaatgaatgaatgaattagctggggaagatttcatttatagaagaatttcaaataataaatgcagaataaatgagggagatagaagaaatgagggagatagaaaaaaaatcaccactagaataccccagtaatatttgctacagccaagctccattgaagaatgttaaaattagtggactaaactttaaggacaaacaggatatttgcataacctaaatataacttccccaaaatacttattaattaatgtggtgatttgaactcaggcccacaaattctttgatattcctctctcgggtggtagagattaatttctctctccttgagtataaactgtacttagtgactttcttctaatgaacagagtatgggaaaggaaaaatagtatctttacagtggagaaatctggtaaacatcaccttaatcaagtgatgaaggttaatatcaccagtgataagttatgttgatgttatgtaaccctagttagatacaatgagaagagcacttcatctaagcagcatttttcctaagtgaataatgcagtctaaccataagaaaacattgtaaaagaacaaattctacaaaatacttgcccagtactcttcaaggcgtcaaggtggcaaaaaacaaggaaagactaagaaacatcatatattcctaaagaagcatgacaactaatagtgatgtggtatgcatatttaatcctacaataggaaaaggacattagtggaaaaactggtgaaatataaactctgtagtgtagctagtgttgtactaatgtacaatgtacaatatacccaatctaatttcttagatttgagaaatatactatatttatgtaagatgttaacattttcagaagctgagtgaaagttatgtaagtaccctatataatattttactattctataaatctaaaattattttcaaattaatttttttaaattttctgactagtatcagaagacaaatacggagagcattatggaactaaactatgtgaggaaactttaaaatacatatatatatataatgattattattatcaaagccagttctgttatataaattcatttacagtcgaaagggagggaggataggaacataaatacaaaaaatgaccaagcaaatctcagcaaaattccaatagcctccccctccacttcatgtttgagcaagtgagagaaaatcattagttcattcaaacttcatccccataatattgctcctttacaagtatccttgcagtccctgtatctgacaagtctacagtaccctatctaacaaaccaaatgaaggtactttaaggatctattcattcattcaatctattatttattgagcatctcttatgtgccaggcatccttccagatggttgggatacatcaatcctagttaaaactggattagacaatacacagtacataatccaatcctctgattattcagataaggaaactgagatcacagatgtaaaccaaagtcacagagaaacttaatgtcagaaccagattagaaaccagtctctttttcaccagccttctcaactcaaacaatgattctgggttgaggacagacattgagagaggtgtaaatgtgtttgttttctctataactaggaaatacttcttcaatctaaaagggtgatttcagttcaagataatgatgcattcaaagagttcttgcttctagcaatctttattccagaaactggaaactcacacttccaatttctgaaaattcttgttaggtaattctcataattgttccacctttcttttttttttcctccagaagtgaaaagtcaggcttggaaggttaaatgcttttttgagctcatttaatgagatagtgacaaagctgaaaatagaagtctcctgattcctcatgtttgccttatttcacctcatgttatcacactgaattaaattatatttttctgtagtactctatcaggaaaaggtgtcctgaataattgtaaagcatgggggataaaaaatctaatggagctttattatttatttatgaacccaaaaacatgaggatattcagtttacgttcagaggacaattagtaaaacgtaatttgtagaactaggtctatatgactacagtaagtgggaattaaatatttgataaataaagcattctggaaacattttgaataccacataaatacaaacctttcacccaaaaaacataacgaatctagtagtttgaatctttgattttgccaacaagaatcaaaatacattatttggcaatataagtggattttttaataaatagtttaacctaatataagcatttgagtattaacatttgaataacctaagcagaaaaaaaattgttttacttatcatttagtgaaatccactaattaggaacaactgtagacgaccaatagtgtatcttaagattaattctttttcttgggaggctgaggcaggcagatcacgaggtcaggagatcgagaccatcctggctaacacggtgaaaccccgtctctactaaaaaatacaaaaaaattagccagacgtggtggcgggcgcctgtagtctcagctacgcaggaggctgaggcaggagaatggcgtgaacccaggaggccgagatcgcgccactgcactccagcctgggcgacagagggagacttcgtcttaaaaaaaaaaagggacccaattttaaatggatctaaactttctaaaaagaaaagaaagtaaataattaagcaacaaatacaagccatgtgaaaggaattgttttaaaaaagatttttctgagtgctatgggtcagtttgtggatgggatgaatgctttaaaaactgttgctcaccataatgaaagatacaaggtactaatcatcttttataatttcaaaattcaccattaaagtctagctgtgcccatatttagacactcacattttcctaattttaaaaaatgcacctgtagcagaattttttctccaaaaagacagagccagctggagagagagagacaattaaagctgattggatgactcagcaataaaaataggaagctagctggatgagaaaggatgagctgcaaggaaacagattgccagggaggggtttctttgaaaaaaagaaaaagagataaaaaggaacccatcaacatgaaagaaaaagagataaaaagaagcccatcaacatgaacaccaggactgaagttagacttttcagctaatggagaatccatttctgaaattaaaagagtaaaccgtttattcatggtcaaattgtatataaggttatacaattaatacctattatgctttcgtaagtagtcgatagaacaataatgataccgaagcaggagtctggtatttatcaaaggacaactaggcctttcttccattaagtgatggcactccactccttcctgcagcaggaactagtgtcttgtccttttgccgggaacatatctccttcctctttctcttctcaactccccactcatcactcaaaactccaccagcttcatgattacacctagccaaagattaattttattcttcagactgtgtcagtctcctttcataatacaccacttttcaaatactgtctcctccttcatagcccaagaatatatgtgtttaattttaatgtttttaatatcatgtcttatgttaaattgtaggatccataagaggagaactgtgtctttctccttgacactgaacaagcaggcactcagtaaatattcattgctgaatgaatgattcctggagagagactaatgagtcagagatgcaatcctgcctgccactaatcagttccattatttttagacaagttcactttgtctcttcatgtcttagcttcccctcacatcacttccatctctgagactttcataaataggttatctaataccctttgtttgatttagacatgagattctcaagaaactttaatctcaagtactacaataatagtatcctcaattcttttcccatcttctattatttctgcagctgggtaaaaaggcagttcttctttcaggtagagaaacatctcctcgtgtttgaagtaaagaatcctaactattataattcaaaagtgtgatgagatcatttaactattcattcaacaaataatgactataaatttactaactcctttacgttgttttaggcaaagaggacaacacaataatgaaacaaaatctcatgttcctagagctctcattctggaagagagagagagaaacaaatgtatactacatgaagtgataaatgctatgaacaaaaaatagaacacagcaggatggatgagtaatgatgaagagaggattattgctttatataaagtagtcaaggaagatctcaatgataatttgacatttgacagagatttgaaagaagtgaaagatgagaagatacctggtgaaagcatattcctggcagagttaagaactcatataaaaaccatgagtcaagggcactcttggcaagttccacgtagtgcagggagatagtgtggctagaggaaataaacaaggactctgtaatacaaggtgaggtcatagaggtagccaagtcagataatgcaggaccttatgggcctcttgattagattagaggccattggaacatttgaaactgtgagatgctatgatttggcttaggctctcaaagaaatgttctggctgctgtatgaaacataagcctaagtatggcaagtgtagaagtaataaaacacttaggagggttacaataacccacgcaagagattatggtggctccatacaatagtaagggtatatagctggttagaagtggtcagactccagatttattttgaaaatagagccaatgcattagagatggaaacagtgagaaagagtagttaagtaatcagtggaatagaatggactacaattgacagtgaggatctaggaatgcacctatttcacttgcataccctgagaatgagcagaggaaaagagaaagtcaccacttgcaagggctacaggtgaagcattgcccctcaagtgtcactgggttttggtttaacaggaaaaaaaagtgagtgggatatttaaagaagaattggaagacagagggattctattgatagagacctcaaaacccacaggacctagtggaaagtgtgaaggatggggctggagaggggcattagatggggtcagaatcatggatgtatggagccatttgggaatgagaaacatctagtagcctgggccctcttgtgtttatggaggcaagcagggatgtagggcacactggaacaagtctagatggtaccttaggtcaactgtggtaagtaatgaggctgggaataactctaggggaaggcaaggcctcttcttgccatgaatctgtggctttctgagataatgagaaggcatatgcaccctcttctgtcctcaggctcctgttcaaaatatttctcttagttttcctcataaaattgtttgatctaatagtgtgtagctgttaaagcaaggctacatgttggtattaaaaaaattcatctggctgggcgtagtggctcatgcctgtaaccccagctctttgggagccaacatagtgaaaccccatctctactaaaaatacaaaaattagccgggtatggtggcaggcacctgtagtctcagctacttgggagactgaggtgggataatctcttgaaccttggaggcaggggttgcaatgagctgagaccatgccattgcactccagcctgggtgacagagcaagactctgtctcaaaacaaaacaaaacaaaacaaaacaaaaaaaactattaatcttcatgtacaatatgtacaattagtgtcagtctgccatttcctagagtatttgcaaagataaggtagggcaccccagtccccaggcttgcctcattgtccatatcttcctgatacctcataccaataccaactgtgcctagtaccttcacatattatagatgctattgttcttgattaggtaagagatgggaaaaaaaacatgaagagctctaatttatattttaacctataaaattatagaataaaaagcactctcacctgggaaagagaaaactttaaaaaaaagaaagaaaaccctacagcttttttttcaaagtctaaaagggatatgaaaaacatagaacagtaatgtgttaataaaatagatcaattcagtgcgaataaaataaaatttcaaaattgtaatgagctaagctttggcatagggtacttagtaaaatgtattattttattgcaaacaccaaaaccaaaaccaaaaaaaaaaaattcattgtcttattaggacactattttgatcattctctaatattaaatctttgaccttgtttacatagaaggcacatttacaacaacatgaagaaaatttgggatgatacaggcaaaacttttgtgctcacaattcacaacaattcttttatgtgccaggaattgtgttcaggtcttgccttggactctttacagagatactagctccttcagtctttacaacgttcctatgagttatctattcttaaccctactgtatagataggaaaatatacacttctcatgatgacaaagctcattagaagcagaaagaaaatttcaacccaaatcatgtgtatgtcaatcacaccactttgctgtcacttatcaattttataattgtgaaagactattaatttcaattacaaataaacatctaataatgcttctttgttgaaaataattatataactatttagaccacctcttctgaatattgacgtggaaatcactgaaatactacgctcagcaatgtgctgctcctgggaaacatccttcaacaatcactcctgagtgctcaccatgtggcaggtaatatctaagcactgagaattgtgtactaatcaattatgaaccagccagcatcctactagagacagagtagcaaagcagtaaacatataaataaaaccattctaaatgccaacaaacaaagactcatgatgtgaaggtaaatgtaaaggagtagcaactttagctaaaggtgttcaggaaatatctatttgtgaaggttaagatctgagctaagattggggaggcagagaaaacaaccaatgtaaaaattcctaaggaaggaccaagcgtcaaaaaacagaaataagtctaataaagctagtgaatagtctgcaaaaggggaaaacaatacaagctgagtttgaaagggtcagcagggaatcattcagggccctggtcaagttaattctaagttatcagaaggtttcatttggaggacgcagagagttataagatccaattaaaaataaaaataaaaaaacctcacagagaaggtaatagtttcatatacttatatatgtatgtgacatacatatgtatatgattaccatatatatacacgccatatatatatatacacacatgccatatatatatgtatatataacatgtatatatatatatgtatgtgtgtgtacatatatatataactgggtccattcattttcctgcacttctgttccaaatatatttctcaaagtcaaactcttaagggctgatgccaaataagatgactatgccttcaggcaggaagaaatacaattccgtaattctggtaattctgattcatcttgttctttctgtctagatgacagttttctttttggtaactgacattgaaatatagaacctgcaaaatcagccatttatcacaccaagtcactagaaggcttcacatctgaatagcaggaatgttgcctcttactaagtcacacatgtcattttttctccaaaataatctggatatgattgcatgtgatcagtttgcatcatgtgagaaagatgtatagtgttctccctcatcctcattatgatttgcattatactgagccatcactccaaatgctccattatggacgaggtgcaaccatggtgattttatttttcactgatctggggaagcaaaagagactgtcatcaacagttgattatggcatcctacatttctgctgtaacacaaccctgaaataacagtagatggcaaatttttaagtcactttttgtcaaaataatacctatcatgtctactttgcaccacatatatgctgttagaagaaaataatttccttctttataaaataaaatctaaaatccccatttcagggtagagtcaagataagagtctatcatatatagttttatctgtgaatactatgtttaacttcagggaaaatagacatgaatggaaataaacatatatttactttacttaagtggcagggcattatccatgagcttgtgtacaagaaaaatgtcataacataatcataaatgtggcatttattggaaaaatgatcacctccataagccatttacaaccaaagtgtcaacaatactcttagtttctttgtgaaattttagataactttatttaaatatatcaaattttattcgtgaattctacaaaagcatagacgcaaataaataataatggatttccacaccagagtagagaactcaaaaactagcagctttttgaacacttctgtctacagagagcactggaacattggtggcataagcaaacaataaattgccaagcaacttgtattttcatacattgttctttacttctcttggtgtgataaaaattggtcctctcaaggtagagagtgactggagtaaaaaagtgaacacattagtgtctccctaacatcactatttcacatggctcacatgttcccacaccatcaaaagcctaaacctgaataatgcaggccctggccctgcttactgagaatactcattactattattgttttattatctaggttgtaaactctttcataaagctctcaaaaaatcacctacttaaaaaaatcacaaaggaaaagatagaacaaaaactgctaaaaagttggaaaaaacttttctgaatctttgtaaaaactttggtgaatagaagcatattaataagtatacaattcaggataaaatgcttattagtagagaacaaaaacattaaaatataaatgattttagtattacaattaaaaggaatagattttcaggtttgataaataaaaagactcaactatatattatctacaaaaagctcacttgaaacacacacattgaaaataaaatataaggctgggtgcagtggctcacgcgtgtgattctagcaccttaggaagccaaggcggtgggtcacctgtcaggagttcgagaccagcctggccaacatggtgaaaccctgtctcttctaaaactacaaaaaattagtcgggcatgctggtgggtgcctgtaatcccagctatgaggctgaggcaggggaatcacttcaactcaggaggaggaggtcacagtgagctaggtgagatcatgtcattgtactccagcctgggcaacaagagtgaaacttcaactcaaaataaaaaataaaaaaaaaaaagaaaataaaagaaattattaaaaaacatatattatacaattattaaagtacagtggcaatattaatatccaacaaagtagacatcagaggtaaagagagtcattttatagggataaaggcagcaattcaccaagaggacataacaatcctaactatgtatgaaattaacagcatagcttcaaagtatctacaataaaaactgatagaactgaaaggggaaatggagaaaggcaaaatcattgtttagtatattaatatccttttctcaagaactgtgagaccaagcagtcataaaatcagtaaggatatggaagatttgaacaacattgttaattgagtaaatttgacctaattgactattacagaacattctaataaataatagtagaaaaacatattttcttgagtgaatatagaacattcactgagacagaccatattcttggcaatgaagtgattctccataaatcagagtaaggtgtaaaactcaaagataattaaatatatgatagtaatataatttactggtagccaaagaatcctaaagtagttaatttgtaagtactttctaagtctgaattctttaaaaaacaaagtccaaacaaaagtaacacattataagcaaaatgtacatattgtgagtaacacttaagatctgggttttattgcttgtatttcaagtgttctcaaaatttcaagtcagtaagttttccttataaaaaaattactcttattatatcatacatttataagacatgctccctattggtttagacaaaaaactaaatcttaagaattgtaattatcttaagtgtgaaagttaggaaattaaattatgctaatattcatccacaattaataaattattaaactcacactaaatctaatgttttgaaacctgaaaattggtacttccattaatggagtaatgtaaattcctattaaggttgagttcacttacaaaaagtaagtaaaataaagattaatttatagttgatataccccagaggctgctctgagggagtcccccagggtaagtgccagttcctgctaatacctaaaagagtgtctatcagctttctaagcaccttgtgagcttgggagggagatcatatggtagcaccatcatcggccccctaatgcttccactcttgttcaaattatagcacacgccaatcaatagggaccctgcctcaaatcttacctgcctcttttccaaaactagtatataccagtttcagtcatatttaagcagagagggagcaaggtctattcaagattttgaacaacagagtatggatttatatcctggcactataatttactagctgtgcaatatggggaaattgttaatctctctgtgcctcaatttcttcacttttttatggtgacaatgatactacctacttcatagagtcactatggggcctaatcaaattaatatttttaagagcttagaatagcatgtggctccacagtaaacaatgtgtttgctaaaaatatcatggtgttgcctaaaacctttcaaagatttcttattgtcctcagggacaaagtctatactctttaatttgactttcaaaacaccaacttatctttcaaacctcatctctgtatacctaagctatgaggacttaagtttcttgaaaaatcccttacatgtctttttacttaaggaatttaccttggctagaatgtatttctttggctttcttgataagtcctagtcttcttataagtcttatttcaggtatcactttctccctggagccttccttagcctctaaagctgtgatacatcctcaaagagaactgttttttttaaattttttatttatttgtcttttactcatatgactagactttaggctatttaagaaattaatttttgtgtattgttgtaatgtatatgcatagcatatgagtccaatatatatttattaaaaaaatgaataatcaattaatgggtcatacaggagctatattataaaaacgtagatcacatttcctccactatgacctcattagctagctagatggttgtctgggaccaaaaacatccatgagagaaaaacaaagagatcaacctggttggtgattttattttgaacagttacaaaggtaatataagttagtcacaggcctacttggtgatccgttcaagacataccctgtctccatctctcagcaagtccaactactgaagtaatgctattaagcaaattgcttcagttctctgactcccagttacttggtaggactgttcttcttgactttcttgcagttggttgaggccatgtgacattttggccaaaaagttataagaagtgaaatatatcacttctgagtctgattgtttaaaaccctacagagctatctatctccctgtcaaaatgactggcagtggtcatgatggagctgcttagtcagtctacatccaggtatgagatgacaagaagcaggaccgctagcccacctatgatggttatgtagtgggagtgacatattatcatttgctgtgagaagctactaagatatttttgcctgcatgataacattcccaatattgaaaaaaaaattgtcttcaggaaactattgacaactcacagactacatactggagcatgtggatcaagatttctaaaaactctgggaaaacactccaaggaaactctctcccaaattctatgaaatctttgtattattttgtaggctcaagtctgtaacaataacattctttgcatgacagagctatgaggaaactattttgattgtttctttggaaaaaaatgaactttaaaaaatcatataatttaggagaatatgtttctagaataactattgtaaaattttaacaaatttaagttgtagttcttaagctgaagcatttgcttttcatgtcaaataataactgaacaaaataaattatcatccagagatttatactgggtagaaaggaaaataattaatctgatacgtttggtcttgcaagttgagtaagatactttgccaatttggaaatgttctatcttgaatttagtcatctccttaattgcttttattttttatacaaatgttgtgggtttttgcagttttgagaggcagaaaatgaatgatatagcaattaataaaaacataaaattaatggttcttcaactaaggggtcgatcatactggtttcctcaacctcaatactccattcttcagttcaaggtacaatggaatttatagcagcctgagtctctgaaataggacttccttgatccaatgctaatgttccattgtgtgtgtgtgtgtgtgtgtgtgtctgtttcctgataaggcaattatatttattttctcccagttataagaaaaatgactaatagatattttgctgacaaactgttagcaaatcttctggtgagaaatgtgacaaaagaggaggatgaggaaaaaattctgcttccataaaggtaaaagtggttttaaaaattcatagtattagcaagaattgtttttcttggaacacagagacaggaattgatttcctaagagtacgaattacagctgggatcctttgacctctcacttattagaaaataggtattattatctaacccgaaattctggttaatttcactgcctgctatttctcccccaaacaagagtaacaacagcaatgacaataaaaacaccatcaataaacagtcctacaactgaagagatattttacaacagcttttggtggaaagaatgcattggtttttcaaacagaatctatcaatacatggattctctgacaatagccacaacagacacaggtgttggaagtgactccatgctgaaatagaagctggggggtacaagtaaatgaataatatactcatggaaaatgtgaagacaagtgaagcattttgaataaggtaagtgttttcagaactacaggataactgatttgctgttggtcatgcaagtgcctgaatgcagcagtttcttgataatctgttagatatttctaattgtttatttagtaattgtgaaaatttcctggttaagagtctcctacaagggcatccatactacaagaaaaagagagagagaggaactaggttcactttttgttaagttctctgactaaatgcagagtttttaagactgcctataaaattaaaatatattgttatttctccctaaaaacaacaaaaaaaccatttaaggatctttcaaaaatgtgtatgatttgaatgcaaatgaatgtctcatattatattctagcataaggaagttattttgcaatctcaaaagcatattaatattattttaaatattttttttaactcaggaaatctcaccttttagtaaagcatggtatgtaacagcccctttttatttcaattgactaatcaaaggattgtaatcatctggccaaaacatcactattccccactcctgctctcttagaagcctttctaaatagatagtggaggtctttccagtggagccaaaatgtggctttagagccattctcgaaatattctattcaataattcacaatacatgagaattcatacatatttgttatgatcatttatttccttttctaattcctccacaaaaatacaaattttcttttagcaggggttactattcatctttatatcagatagcacagctcagcatatgatatacatatggccaattaatatatgattaagttctatatttgatattataaagatatgaaattttcacatgaaagtctctcatttttatttcgtatagctagtatataattacatatgcaatgtttaactggttgtataaaatcacatatctaagaaatgtagtactaaacagagttcttcaaaaattgcagcattttaccacgacatgtgctcactaaaaatttttttcaccttaagtcataagcttacctactttcaagccattgaaaatgtctgaaatatatgaaataatgattcaactaaatgagaagggtgaaggatttagttggttaagttcccaataacacttagaaacaataaaacaatcatctttgacattaggcaaatctgggtaatagggcggcaggaagacttcagcaaaactgtgaatttttaaaaatttttattgcttactggtgccctcctttctcctctgccagtcaatctaaacttatcacattctagatgaaccttctgctcatacaaatgaacattctctccctcagattgtgacactcacattcatacacctatcctttctgtataaagaattactctcagctacctgtcaaccaacagcctgctaacatgttacctagtaatagcttaaagtatatttcatatcttctatgatactcttgaagatgataaagatcttgaaacataaattaatcattcccaatagtgaaattttagttattaatatcacaattcccaagaaatgtttgagagcagaaaactggtcacttagaacttcaagaatccattactcataacctagcagtcaagagagtgaatgcatctactaccttgcaatctatacatcatctaatattattctaaagtcagtgtttatgtgagcctaaaatattacaaatctagaagttcttcaataactctttcccaacacattggtaattactggcactccttggtaatcactgttattacaaagttgtctcgcttctacaacaaatatgtgtcaggagaagaaagaggagtgatctttactagattaaagattatctagagctacatttctctcaatttcagtctagataaaaatgagaaaatatgttttaattgtaccagattgttaaaagctatgaattcgaatgcttgtgattcattgccagttaactgaaaggagttgttctgaacatttatccttctccttagtatcatccaaaatgaatattttcacacaatgaagaaccacttcccacactaagaaactgtcacactcacaaagctagttgatctcccaagcattactgctaggtactgttaggtagttatagttcctggattctaaatttaaaagcacattttaccacaatccagattctactattttaatctcagctacgatccagaatattgaggaagaaaaaaatttcattctttcatagattctgtgaaagaatcagtgaattaacttgacaagctaattatatcttatataaatatgctctttagactttcaattttagagttcacaaagcactttcatatgaattttccatttatcattcacattttttaaaaatgagaaaaatgtctgaaaatgacttgcacaagatactcctgattctcatttcagaattctgaattcccccattctcaactcacatctccacaaaaacaacaaaaagagcaaaattgaaataattattgtaaaaattcccacctataaacaatctcaatgggaaaccctttctgatcccactactcctgacttagataggattgtatcaaaatagctaccattcctttattttgcagctgcttcaaattatctggagccctgggaccagtctccagaatccttccttactcaacgtctactttcactttaaaatgtaataagaaaaagaatttagctgtcttaaaaaatggtctaaatggcagacttaactcaaaatagccaccagaattatataaccaaccaaatgtatttccttttcacactaagacacgactcatctgatacaaaatctaaattgcacacatcagcaagacagaaaaagaagtcaaagcaggtctttctcagccattacctgttgcaactgaagggctctaattttatttactcttgagctttcataatacagttacagtgcctcataaattgactttctgtgacaattggtgatatacttcaaaaagtatgtttatatttaaatcaatcactcttttgaaataaagcaggcataatcttgttttccaaattttaaattagtaaaaacacctttgacattgaatcagactaaagtgaaagactggtttattagaaaatgatagtaaaaaagcatgtattttccctttttcattagataagtatatttaacattttcatcagagattagtttgagttcacctagttatttgtaacaataaaatattcttggatgtcactgtacccctttccaatgtccatcatgtatcatcacacctttcttatttgtagataggggcactatatacaagaccaactaaagtgactcgttcaactgagataattactaggataattaaagtaacccatgcttattataaaacactctggcaattaaaccagacttcaagtttaaaccagaagcacatcacaaattttgtctccaactttcataaaccaatagtattagcaactttcactctaatagcacacaaatgagtctaaaatagcagtagccataatatatatggtatctgcatgcacagagaaaggaaaaactaagacatctattcggaaactggacaaatgtaaggctaaatgtgctttgtcctaaattagcctgattcatctgctgcttcagttcttcagttggtatattttggggataagtaatgcataataagggtcaggcacactggctcgtgcttgtaattgaagtgttttgggaggctgaggtgggaggatagcttgaggccaggagttccagaccagccaggacaatatagcaagaccctgtctgtacaaaagaaaaattttttaaattagccaggagtggtggcatgcacctgtaatcccaattgtgtgggaagatcccttgagcttaggagttcaaggttgcagtgagctatataatcccaccactgcactttagcctgagcaaaagagcaagaccctatctctaaaaaaagagtaatgcataatagtatttataattctttcaatatctgacagggcaataagcacaataaagggataacaaactcattttgagatttttatattttaaattcatagaaacattcataatataacttaaatttcaataaactttttagtttcaaagtgtatgttcaacaataacatctcatttgaaccttagattctatgagattggacagaaaatcatcaatatccccatactgtcaatgaggaagttgattaatttttccatgatttctaaattcccttggaagatttcccagactttgccacttggaaggtcatatagtttcacacttaggtatgaaagtggccatatttagtgtgctttccctagaacctctcttctactccctaccacacactcatatacaatacctttctcttggctttgttgtttacactataaatgcttgtaatactggattcaagacattgttgttttatttatcggtttgtctatttacatgttttcttttcctgctgaattgaaattccattgagggaataactgaaatcatctagcaagtactttagagcccagttatttccccgacactatgctaggaactgaagatgcaggaaagctatgatatctgcccttttggaatctaatatgtaattgtaaaggcacagatttagagagattacaaattgatgaatgttacaaagcagaagcacaaggagctatactagatccattatagatggaactaattgtgtctgagagattagttaattctacctgaaagaagcaatgcgtaaataaaatgagatggataatctgaaactgttgaaaggaaaaaagttctagaaaacatgaacacatattttcatgaacatgaaacataggatttgaaatgtggtatttggcaaactaaagaggttcaacatagttaaagaatatgagcaaagagtttctcaggttgagggagtttggccagaaacaaatttcaaagggccttgaatattgcattgtatattgacagtaatgaaatgttacagaaatattttcagcaggtgggtaatatggtaatagttactcttcaaaactaccacttttgagttcctgagaaggcaagcaagggtgaattttaaaatagttatgaatggagaatagaaatccaaatgagacacaaattggcttggactaggatggtgataaggggatcaagtgaagaagttacaggattccaaccacaattgggaagtagtagaatcagtaggacttggttatttcttagaaattaaaagagaaggagaagaacactttttagatttctgacttgagcaacaggaaataagggaaaaggagatttaaagaaaaaatgaacctactgagcttgaggaactcatgagatacctttgtagatgtcactgagtcatgtggacattgaggcaactgggtatataatttagaaacttggatatcaatctgattattatcaacatatagccatggaattatagaaaaacctgcaaaacaagaaaacagattgggacaaggattgggctaattaagaaggctgaatgttttaatcttaaaatgggaagcatgaacatttcaaatcagatcttatattctgacatttaactgagatttccatgtcaaaagcactgagatgatacagatctgccacggggcgctgaccaaagagcattcataaaattaagccttacctctaacatatgtatatatacaccacgcacaccctgttaaaactttttagttgtcttggggctgggcgcagaggctcatgcctgtaatcccaccactttgggaggccaaggtgggcagatcacctgaggtcaggagttcaagaccagcctggccaacatggtgaaaccctgtctctactacaaatagaaaaattagccaggcgtgttgggggcacctgtaatcccagctactcaggaggctgagacaggagaatcacttgaactcaggaggcagaggttgcagtgagccgagatggaaccaactaccctccagcctgggcgacatagcagttgccttgacttaacatctcatttccaaatagaactcattacattgtacattaaaacttcagcatatctgttaagctatcacattaaaaagtaaataatataatattgaaaacaattatctcacaatactaataattgtttagagacggaacttaaaactctgtttaattggagaagaaagtatagttagaaatcattttacatatacgaatatccatagtcatctttttctttttttcaagaaatgaactagccaagcaaatagatgattctaggagagtgtaaatgaataacttcaaagaaaacagtccggcattttaaaagatagaaccttaaagtaacataaccaatagaggacacctagtggtctttagcagaatcaatatttgcttgcagaaaatatcaggcaattcacacacatgcaataatgttggtgtcagtagatgtgctaatttcagaaagatgtcatcatatatttataaatattacagaaatatcagtttaaatatttcagataacttccatatgcttcatttcatttgaacttcacaactgtttgattgttcatgggcataaataagtcactttatgtgattttccctagattacatagaaaataatgtcgcagttgaaatatacactaatttctggtatagaatccattccataccatcataaaaattgaaacctccaatataattgatatttaaaattgtaaaacactgcaaatagacttcatagaaggccttatcatatttcattaaccgatacaaacattttttgacagcaagagtacttggcaaagataaacctttttttagctatctaaaaaagtactgtgtttgacaccgactgcatacaaaaaaatgcgaggaagtgataaacctctcttctaactggtggtgttagctctatccacggtggcctccaacccccttcattctgtagcactctaaaatgtaaatcccctgcctaaaatgtatcaatggcaccttttgattaagtccatcattagcacaaattctggtctacatctccaaactcaatctgggaatctgcatctactgcactaggctgcttgtatctcgtgtcttctggaacacactcttctccctggtccacttgttcagcctggtaatccattctccagattcaaaattcagttcagtatgtttcaaggcctcctcttgtgcaaagcaattgtgttgctcactcccttatttgtgccactacttcccacatcatctgtgattatttgctcacatctgcttttcttacaaaactggcatcagtcttctatccttatttgcagcatctccacatacagattactcagtaaatgcttgggagtgaagaacggatactctcttattattatttaacggatttagaacatgggagattgccagtatttagcggataaacatgctctgattatttattgtgtttataaccctgcactaatatacaaaaagattcaagggcaaaatttgacactgattcttccctatgatatctatgtctggcaaaaggaaagcaaaatgtgtgtaataaagcattagtaaccaaattatcatgaacaaatgcatgtagagccagtagaaattttcactggaaaggtattgactgtcacgatagagtgtgtcaatgtagaataccttctggaaatgagttgaagtctgattcttttttttttttttttgacggagtttcactcttgtcgcccaggctggagtgcaatggcatgatctcagctcactgcaacctccacctcccaggttcaagctgttctcctgcctcagcctcctgagaagctgagattacaggcacccgccaccatgcccagctactttttgtatttttagtagagacagggtttcaccatgttggccaggctggtctcgaactcctgacttcaggtgatccactgcacccagccttaactatgatttttaaaggagtgatagaaaaaaaaaaaaaaaagcctttccaaatcggagatgtagcaggaataaaattatagaagcagaaagaatcatttcctgcaagcagcactgtaaaactgaaacacaaacagaaaagagttgggtgcaaatatgaagtgacaatggtgagaccagggaacaatgtgctggagagacttgaaggcacagcaaggaaacacagatttgatgtgataagcaatagggagcctctctaagttctaatacagggcaggtttgggaaaactctgctgtttgcttatggcaagtcttagaatcctatgtgtttttaaaaatataaaagtaattagaatatgtattgtataattatagataggcaatttatagtaacagttagtttctactctacaccaatttgaatgctaaaattaaccaaagatagaaactgtaatctgcattagctccctatggaataaatttccttattactgctctgttgttatacataatttgtatattaaactatctctaagccagtataaaaatctaatattggtttcaagacaagcattgaaatgttcaagacacattattcatctgaaattgctatagatacaaaagatcaaaaccacaggccctctttcctgtcccaaaatgtatttaattaattgtaatatgtcccagttctatacaaaggaggttggggagataggaaatgatgaataaaaagtaaaatattatagttatatattccaaagccatagttattatataatgatgcatttcccactttttaaaattaagaagaatttatgctttatctatgacattaagtcctacaaagagataatcattacagagtagcatttgtatttgcaattaatatttcctaaacctctaaaaaatttcgaaggtcatctcctgttgataaaatgactgagatcagcagctgtaaaggaactcttcacctttacaaactgaataatctcctattcactaagcccttaatctactctttatctcttcagtggcttgtgattgtcacatattccatttaatttccagggatttcctcaccgtatgtctcttttaggaagatcacaaggaatttgttacccttgtgataggttatgaaatagcagtctggcttggatcactgtctttaaacacaataacaacaacgacaatgctgaattcaaataatagttttttaaaaccaaacataaaaattggaaagattcacctcagctttctagctattacaagaaaagaaatttctggcttgatttatctaaattgtctctggtttttacctcacctggcaatatatataaagtttcagtgtaatgtcacagaaagctatttttacatcccaaatctattgatcttataattggttcatgaaaacaacttccctcctcacttcttaacaccatgtgtttcataaattagttgctcaaatcagttttttcctcctgtattaaccactaattcagctttagtaatgataataacataagcacaaaaatttaaagcttctgtatctcattcataatatttttctaatttatctggcatcagggcttcttgttgtttttcagttgaactaattcagtccagaaaaaaaaaaatgtattgttgaagatggaagcagcttcctatagaaggcagcagctttcctcaggaatgattcatttagaacagtggcagcttccagacttcacacattacttccccaaatttgctgaatttagcattagccagcttgatactaaaacacccagaaccaaagacatgtgggtgaactcacatcttcctctgaatttttattgcaaaagctcacagagctactttttctgatttatttgttgtatttttacttgtaaacacatcctggtgacatttagaaaaatcaggtagagagatttccagttttggaaccattcaagtttcttggagattatggttagaaacatgtaggtgatggaaagattaatttgtattaaattctggattatgactctgtttcttccctgttgaacagcattactaatgggcattaaatacccatgatatatgatattatatgggggtatcatataatcaagaaaacattcttcacctaaatgggcttatggttcatttattaccaaggtcatttatttataagaaacatgttgccaacccacaactctagcctgaatgtgcttggttaccaaatgtctgtaagtgcatattaaattgcattttacaataatgatagcagtgagctgatgttcctaaattttatcatggcatctttaaaacacatcatgttacacagatctaggtgcctgtaattactgccagaagccaaaggacattggtggtaaggagtatactcttatatgaccacatggcctgccattttatctgataggatgccatctgttcatcctgctgccattctctagggtaactgggctaaaaccacaagatattaaaaatagtcacattgctactgtatttttaattgactggatgtttatatcagtgactttcctctcacaggatatttgttaaaatatttttccatggccttgttttaagaggtactattcaactctgttgtattgcatggcccacagtcttacttaagaaaagttccctataattcgttagacaatctataaaatggtagaatattaagatatttataactaaaacattatatatcatagtaagaacctatatagttttgcagttaagagcactggctcctgagtctgattgccaagtttggaatcccagctccacttcttactagttctatgaatctggacgagttaccttattgtatttaattgttctcatctgtaaaataatgacaataattatatttacatctttgtgttgttaggaagattcagtgagctaatatatgtaaagaatcaaacatactagctgacgtgtaataagccttcaataaatattagcaattattagcaagaatcatcttggtttggtattaatctcaaattagcataaaaaggctttgagaactgaacatttattccattttagatggaatgtgctatatagagaaaaattacaagatgaatctgatttctcaaatgtgcttcatttgattttaaatatatcccatatctatattttaagaatgatccatttttatgcctttttatcagtgtattatgcagtgttttattattgcatgtcatttcctgaaatcctgtgaaccaaaatgtcactgacaagcacatacaaaaacactgctaccgcctcacagaaatcaaacagaacttccattttatgacatatttaaaaacataatttatcttgaaaatgctaaaaagtatttctgtagggaggaaagcaatattctatagccagtatatgactttatatgactttcattagtgtcgatttaggcattctacaagtcttttggactcttacgcttatgcagactataaaattcaggttataattaatacaaaaagacttaggaagaaaaggaagtcaaaatggttaatattcagactttgaagatagggatatgaactcctttgcttgatgatggtttaactcagatctttggaaactccagttggctgagccctctcaggtcccacccactgcctaacaacagatgctctattcagcaaaatatgggcctgattggtcagattcactccatttattcactatactctttgtgttttctatgtactaatgtccctcatgaatatgttcctttttagtattatgaaatgaactaatagggagaaactaaaataagttactataggcaaggcataacaataagcaaaattaatatgctaaaatcaaagcctttatatatacaatttggaaataaagaaacaatctgttttacccaatcatgaattcaatgaaacttcaatattagaggatacaaaaaccacactatctcacagagctaatgatgtgccagattagcaatcagaccctacacatctttatcaaaataatggtacttgatgtatttatattagattaaaaaaaaccaaggtgggaaaggggttgtattgatcaagataataattgctgattaaagtgcatttatttaaaaataaaataaattggcataaaacgatcactatttttttcagttcattcaaatccattatttgatcatatattttagggatacaaatatatcacttatgcatggaaaagagtcgtcgaatacatttttctacttgaatttcataaaactcattacacattgcacagttgttcattgtaaaacagccataattaacaatttcatgatatagatttaaaaaagaaaaagatgcatcttacctcttcccattgatgtatgtatctaattaaccttgaaagtcgtaataaacgcaagagactgagaatttttgtaaacctcacaatgcgaagtgccctggctgtcttgtaaacttcagaatccattcctttttctacaataagaaagatataatccactgggatggatgagatgaagtcaaccacaaaccagctttttaaataattcatcttgatcactttggggtccaggatgatttcagaactgtcttcattgacagtcccagtcctaaaattcatgatcaggtccaataggaaaactgtatctgatgccacattgaaaataatccatggtgttgttgtttgctctgtaaagaatgtgattccaactggtatgatgactagatttccaaccatcattataagcattattaaatcccagtaaaacctacaacaaataaaaaaatcagattttaagatatagaaaataaccagcctatcccccccatgaaaaattattactgatatatagtgagatcaataagtaaaagaacaaagaaatgattttattttttaaaaatgtaattccttaaatggctatatgtttaaatctaagtaaaattaatatattcttaaaccaaggcattatgattatggaattctaaaaattatgtgatatgaagcattatacaaataaaatcaaaaacattcatacccccatttatttagtaaagaggcaaaaaaagcaacctaccttatacttaatacaaaatatagacagaaactagaaagaagtataagattagaagatctgtaagaaagcctttgggaaggctctttgaagatgttttgaattattttagatgtcaatttaccaatcatagattagaaaaaaaaacccagaaataaataggatactctaacaattttagttatgcaaatttatctcaaggaatacagattagttttgccatggaatctagaatacactggagttttgcagtactccaaatattttatgctttatttttcttttgcttgaaataagaaaactaattttggtctgatgctaaaaagaactgagcaagttctactccatatttgaaactagaatctacctaaaatttgtgtttttattactactctattgaacaactacttcaaatatattgccactacttttccataaaaattctttctttctttcttttttttttttttttttttgagacggagtttcattcttgttgcccaggttggagtacaatggcacaatctcagctcactgaaacctccgcctcccaagttcaagtgattctcctcccgcctcagcctcccgagtagctggcattacaggcgtgccaccatgcccagctaaaaaaaaatctttaacatttctaatttaattctgaacatgcctatgactactaagtaccttttgaaatattcttatctcaacttacattaaaattgagagaaaaccaggaacttcattgctggtttatatagcttaactaaattaactaaattcacttgacataactatagtgttatttttataagggttctttcagtctgttgacactcctattaatcaaatatttatagttgttacagtatatacttgcaaaaatgaaaaaataaacacaactgtataatcatgaaatgtatccagaaacatgagttactttatcctagtcataggtatgttatttgaggagttttgtataaacaatataaacttccatgataaaaatgtctgtttaccaagatatttttgttttacatgaatactcctacttagactatttgagctacattttggtgaggtatacatgtgtataaagctttcaaagttactatcatctgtaattaagaatgactcctgaaataaaagtactagttgaagaaaaaactataataggccctatctcccctgtctccagcctcaggatgttgtaaaggataagcgtttgttattttgaagatttcaccagtatttctgtcaaaacttgcctgcaatttttgaaacaactgtacaaatacccatgtcagccatacaacatgtactggcagtttaaatgaaatggttttatatcttctcacaatggaaatgcaaaatataccattcaacacaataaggacagaggagagatgtagaggaggagcaatattgtaacagctatttcacaaagaaatggcaccactaaactctaaaatgaaactgtgtgtaccctgaggatttttcacttctgggcactcctatcaagtcccttctgtaagcttctctctctgccctccccttcaaggctgttgttcccctgggtgtcacacatagccctttcatcttctattctacgcattgcccttgagaaatattatacacttatccatgcctttaataattaatttgtaactgatgaccccaaaagctttatcttcagtccattcctatcttctaagcctcctaatcctcataatcagtagcccgttaaatctctctcctggcatatctcacactcatctcaaacagcatgcctaagctcaaactcataatctcctctcccacatatattcctcacatatcccctatctcagggaatggaataactctatgtgtgatttgcaagccagaaaccatggagccatcctaaataactcctggccctaaatctgctcaaacccatatccaattgatcaccaaggctgtttagttctcacacctaaatgtatgttgtattcatccatttgcactttactattcccactgcagctgtcctcattcagaaagtcttaccagctgttttatttaaatacaagccaattaaatgattttattttacattttctaacctgttcaaagaagattattacagagccaaatatacagggttttatggattaaacgagacgatatatgctaatcccagggcctggcatataattgtggcacacaatgccagtggcctagtcactacccatttacccttcctcacttaccacaagaaatccaattttgtgggaagcacccagcaacctaatgaaaaatactcatttctacagacatctttgcatttctgtaattaagatagaagctttttttgaaggaaaactaatatcccatccctcagagcaatagagatgaaaagaaagcaccattcattctttactacagtaataatgcttatcacactatagctttttgctagcaatacttaatatggtctgaagccattagatatctcaataccagtaggaaactctgttaaaccccataatatccttttaaagtaacatcgactctattttgcagacaaaaccacaggtgcttttatatgcttacataatattgtctttagttagcatggattcattccttaggtaacaaaaaaatacaatcatcacctgttctagaagtgcaatataccttctttaaaaaaagtaaatgggttcttaaaaattgacctcatgaaaatctcttacctaattgcccatgagtctttctttctagctctttactctcaaaatttctcttagatacccaagctccttctttaccttaactctcagtttctatgtcttgcacattttattaccatatcatctttcctatctatcccctccttccattcttatttctctggtctgggcagagccaccttctgcttgaaattcctcatgagtctcctgcctcttctctctaatcaagtcccaccactcccaaagcaacttacctaacaatcaatttgctaggtcaacaaccagcactgactctctcaattaaacgaaaacaacttagtctgtttgtcaaggcactccaggatatggcctcctcctgcctttccatccccctcttttaacaactgaggacaagcatcccatatctcaggcaagagggcacttgctcatgctttgccctcatgcctacctgggtacacatacaggagatatgattacttccattccagctatctttctacctaacagccctcaaatcccctcaaatccctttctacttctccctcaaatcccattctggcaatgagtttcttagtttgtttgtgtgtgagtgtgtgttttatttttgttttagtagactttatttttagagtagttttaggttcatggaaaactttaactgagtgtacagagatttcttatatacctcctgcccctacacatatatagtccctccccattatcaacatcccccaccataaaaaaaaaattgttacaaatgatgaacctacactgacatctcattatcaaccagagcccacagtttacattaggattcactgttggtgtacattctatggtttgggcaaatacatagagacatgtatatacaccagtagtttcactgccctaaaaatcacatgtgcttttcctattcatccttctttcacctcatttgttagtttttttttttacaaccctcagagcagcatatattctcaacatgtttcctatttttgattctgttactatttgtatgtgtttcttccatcattactgattcaagttatttaaagttcaaaactgtatcttgtcttctatatattttctgctataagatagatagcatctaagatagcaaatgttaagaatatttattaattggatttttaatgaaaacatacactttaatgggggatatttaaagaaaaccttttataataagccaaagagccattaacaaagtaaataataatttcttatttgtcttgcatatagatctggattttacttattaagggttttcatttttacaacagaatatgttaaaataaataaaataggaaacaaagaggttagaaatatgctcttaggttagatatctaaaaaacaaaagagttgtgtatttgagatgtttttacatatcatatatctacctacttctattcatcctgccccagagaaaaagtatttgtaaaagaacttgcttggactttgaaggcagaccagagttaaaatcctagctccactaactggatgatttggagcaagatatttagctgccataaactttcatttttttctactactcttagagttactctgtgtgaggactacatgcaatagtgtatgcaaagtgtagcatatagaacctgtatgaagagaagccacgacacaaaaatgatagcttcggaattctatcttacactggaatctctgtggtatcctgaataaggtgccagttctccacaaagcctaacgtcaacaatgataggactctttacttatttctccttccttataataaaaccccatcaactgaaggggatggagaaagaaactgttacgtagaaacttcctttctctgaaataccagcaaagcagagaggacactcactggaaaactaatgatctttataattacagcaaaatcataatctaggtaactattttacctttttcactggaaatatatagaataggctaaataaaatattatcactaataagtataatattaactactaataaaataattttcataggccacttattttttatgtagagtgtatcttctccctataggtttctagaagagataaagtggcgttgtaaagattagtccatgatactaaatcaagaagaatttcaaattcagtcatacttttttttctctacccacatgcaaccctttaaggcttgtggtaaggagaactcctccttgttcctaacaagaacttcccactcttcttaaggtttcccagccccagttgcttacgttatcttctctacttgaaacagcctgatgtcagacatttctaacctaaagctttaatgagatttaaataatcgtcatactttactactactaaaggtgcttgtatttacaatattttctctaaatattgaatgaaaaattcttttctcccctctctgtgatgaaataaatatttgtcattgagcagaattgaataaaaatatttatggttaatttcctgacacggtaccagatttacagtcgctcctattttatctacagttgaagtcaaataatgtcataaatctgtcccctcaactcacacttaagattcacttctaaaagaaagaaatagaattcccaaaagataaatgcttttgataacttctcatgaaatatagcacctctttggctgatatacagccatagtgtgctgcttctgtgatctgttactggtttcaaaattagtggtattctgggagactaattaacatcattagccacaatataaaagtttggaccattgcatttagaagaatggcctcttgatatcaattattttataaatatgaaacatgaattgagcatgtttataacaacttatcaacctgcataaataaacaaataaataagcaaataaatacccagctagatttaatttttataacaacaatagtcctcaaaatcatgtcccaaattttatttaaaactgattcaatttttaaaatctaatagcctgatgatttggtacatatgttttgaaaactagcataaggtgccttctcttaaatgctaggtcctcttcccaatcctcttaatactaagattcacactgggaaagatattttgtaaaatatgtgtatttagaaacttcgcaaaaaagtttcattggccaggtttgctacttggtctaatgccttgatgtctcacaaggccaaatttattatccatggagggtgggaaggaaatatattttaaaaatccagacaactcaaacataggcaatttggagtggaaatatgctaactttcttaaaatagtaaacccttgcaaaatgatcctatctgagggaaagtttagcctaagtaatgaataaaacaaagttagactatatttaaaggcatttagatgtcttccaataaactagcaatttatccaatgagaatatgagatgggtgggtggtgcattgttttagctactcatgaaaatggtttattaaattaagctaatgaaatagaaatttaaaacctatgaaagtattaagttgtgtaccaatccaagcaaaagtaaacatgttttgtctatttcccccttctcctgaaactgtatttttttattgtttgttaaccttctgtcaatattaaaaatcttatattgcttcacatactcttgtttgtgggattttacaactacagctgctcacctctcctacttgaaactctcccaaagctttgatttctatgactctacattataataattcctcactcatatttctgtattagcatagactcatttttctcaattcttatctgactcctcttctaccattaacaatgtggacattacacatgactcaattctacccaactcttcttccttctattcactctctccttcagcctctccaacctccacaggtttaactaatatgttaaggtaaatggtcctcaaatcgatcactagctttaacctctactatgaagttaggcattgctaactatgcaggatatatagttacaaataactatatatcctgtatagttagtggcttccaaatttcctgatagaatagtcatctcaccagacttaaatctagactaattaatcttctagtctcaaaataattcacctgatatttttatttctgtttattatagcatagctttttttctttcatccatccactatgcataaaactttagaaatgtccctgactcttctctctgcccagctctggcatttgattacttgcccagctctatatcttccctaatacaatatttttcaaattcagcttttcattttgttccattgtcatcatcctggatgaagttcttatatcattattatgttttctaattttcctgtttctacctgccctagtaaattgcctcctatttatatccactagactttcctattgcttacaaaatgaaatgtaaccactcaaaatcctcttaagtatgtcccaattcggtacctggaattttttcacatacacagtcccaagctaaattaaaaagactctttttcagagtcatcatctttgccatcccccaccccaaaatgacaactgggatttccttttcctaaacccaaactcaacctctacattgccttacattacttcaacagtcaaataaattccagttccttcacagaactccctttcacctgatctctatcccagttggagttgatctcctcttgtcccaaatgcctatcgtaatttctctacatgattttcagcatctgagcacatctactactgaacagtgaatactctgccataatatgatgtcaacaataatttgataaagactgcttaataaacagtctccaaaaatactgttttagcccttattcctagccaaattaaatgccaatcatctttatacttaaattgcctagcaaatagtatatatactgctgatttcccaatgatcaaattccaaattagtatctgcgttaatgattttaaattgcctagcaaatagtatatatactgctgatttcccaatgatcaaattccaaattagtatctgtgttaatgagggtttattatagcattacacaattctagttaaaaataaatacgaccataggtgggatttgaacaatgagaacacatggacacaggaagggaaacatcacactctggggactattgtgggtggggggagaggggacggatagcattgggagatatatctaatgctagatgacgagttagtgggtgcagcgcaccagcatgtcacatgtatacatatgtaactaacctgcacattgtgcacatgtaccctaaaacttaaaagtataataataataaataaataaataaatataatcatttgttcttttggatgatttcaaaattaatcaggtataagcctttatttctcctcaaatggtagaattatgatgcacgtttttaataaactattttaatcttcttgctttagacaacaagaacaaagatatctttcaaggggacttatattgcatcattcaaaatcacttcaaatgaaggccacaagtttcactttgcagaatccaaacatctgttcctccctaaatataacccatgaattatatttctgtaagtctatagcttttattaaaggatacagaccggagcagaactcccagggtattaagaacatctatcctgtagcattctatctttataatgacatgtagattttccatttaaaaaatccttaatttaaattatttagaaataatgtataaaatagctcctggtgtttaaatttagagctcttctagaagtttaatctaaaactactccttaacttctaagtattttcatttgatggaccactgagtggtttttaaattttatttcctgcttctaactcttgacaatttattcctttaaggaaagcaaaaatactgtcagtggtcatgtcgttctcaacaaaaatgtattctagtaccattcactctagtatacaattcagtaaactgaggtctatgttttagctgtttctaaagaaggacaaagagaatactgacatttggttatcttaccgataagatagtcctatgacacatatattgaagacattttattttgaagctcaactgaatgactgtgagttacagacagttttatatttactgatatactttcatctaaccactgtgaaattatgaaaagaaaatagtgattgaattattttctgtctaattacatggctaagttaaagtttattcaagtttggagttttaatttcagatagatttttccctcattgctattgtaatcctcccaccacattgcatattttcaaatcatccagtttatttttcctcttgctgataatataagtcacctccctgtgttttttgttactctacagatgtcaaagaatctttatgctctttattaatacataagatgccaatgccatacatatcatttggattattgttccagtttgcaggtgtgatggacagcacaaaatcaaacacgtaactgtgcccttcagtctttaaaatgttcacgttttatggaagctttggaatgtgttaatgattctgatttctggatataacaatttgtcttactgaatattaaggaggcggcattagggcaataaagtattaaatgttaaataaagtattaactaataaataaaatatttattagctaatagacactttaaagacatggtcttgtttgatactcaaacaaccaaagaggtacacaaccttgtctaagtttgaaaagaggaaaaccgaaatcatctagtttaggacgcttcttaatttcttgtaatcagaaaattatacaaattgattttgaacccaagaccaatttctgtacttgcactctctccaccatattcagataaataatttaggaatttaagaaaagtctttttaaaaatcgtacacttattagagaagcaatgacaatacttccacctattcttatcagtcacctatctgagcaggtggtttacacaactcttttcacaagagaaggggcataggctatgatgctataggtatagctcaatgtctggcctttggtctctatgtcttttgatatagaagccactgagagtttgcctacattcccagaggctcaaagtgatagctcccttgtccttatgcccatatagtagcatgcaacttctaaacagaggagctatgagatcacctatttcaaaagggatttctgaattatttctgccttagcccacaaagatatctcactggtgcattgaccaaagtcagttcagatgctctaaatgcaaaaaaacacttgggaagcaagagtcaaatgtagtaccaaatactctctccaaatagttacattataataatttcaaaaaatatgtacacagcaggtattgttctaagtactgtgagaaatgcatacacaaactatatgcaaatactgccttcaaggagcccctcaaaaatgaagacctaatctgcctaatatgaagaagttaaatatgactaaaagagaatttaagacatgttcgtaaattgcacaccataggtactctgggtttccaaaagagataatcaattggtcaccttttaagtaagttctggtattaaagaaatttaaagacagcatttgctaaggagttccgggggttgcatggcacaaatattaatttgtcaacaaatatgtgctgcttcctgggcttgccactatgcctccaaagagaattagatacagcctaatcctcaagaaaacatgaacaaatcaataatgtcttataaaacagtacaagttctaggttaggctttataaagggcagtcctaaaagacacaaaggagagtgatcaagtcttctgtgtacatgacaacactgcaaacattcattgagcagcaaacatagtgctagtccatgggttgccaggaggaataccaagagaactagaaacaaggtggagataaacggattaaattgcataaaagttaaaaggtctagtggcatatttactttttcagctaatgctttagatgttataatataaaataaatccaaggctatcccaagagtttgctcctaatatattttcaagtctttgctttcccaattaaaatgtaggctcatgatcaaagacagccaagaatgtgatcaaataaaatctcaatttaaaaagtgttaagttctgtttataaatttcataatatctttttccttcaaaatgattttctaaaataatcaacctctacttatttatgttaacaacaaatttttgaagttaaatactactcatttctacatatttagtgtcctacagggataaataagaatgccatttctatctagtatatgttcttttccctaaaacagtatgtttaaagatgttatttgatattatactgcattgaagttttcacccactggcagctgcgtattatctgatggagcagaatgggtgatgtgtcaaggaagaaaatgattctaccaggagcatatgtttccaggtctgtaacaaatatcgagggtgtgtgggcagaccaacatttgctgtggaatattaaagaattaaagactgagtttctttaattttctgagcaattcacaccaatcctacagcatactttaagcagaactgccagtatagtgagaaattttccatcacttacaaacgaattcaatgaatatccactccaattcactacagtgcccacaaagaactcatgtatgtatgtttctgcataggtataacaagaaatgtttttgtcctatcttctttcatcctttccttcataatttagtggtacttattaaatcttttttgcttcaacagaaaatacacatatggatgatatgatgttgctcaatagataacagaatcccattagtaggcagatgttgcacttgctttttttatgtaggccagtaacttagaggaaatttttaaattatttataaatttactaagttctgcaaaaaggttttgtaatttgcacattttggctcactttttaaagatatggcttctaccagagagttaaatcatgagtgaactcccatttacaattgcttcaaagagaataaaatacctaggaatccaacttacaagggatgtgaaggacctctttaaggagaactacaaaccactgctcaatgaaataaaagaggatacaaagaaatggaataacattccatgctcatgggtaggaagaatcaatatcatgaaaatggccatactgcccaaggtaatttatagattcaatgccatccccatcaagctaccaataactttcttcacagaattggaaaaaactactttaaagttcatatggaaccaaaaaagagcctgcatcgccaagtcaatcctaagccaaaagaacaaagccggaggcatcatgctacctgacttcaaactatactacaaggctacaagtaaccaaaacagcatggtactggtaccaaaacagatagatcaatggaacagaacagagccctcagaaataacgccgcatatctacaactatctgatctttgacaaacctgagaaaaacaagcaatggggaaaggattccttatttaataaatggtgctgggaaaactggctagccatatgtagaaagctgaaactggatcccttccttacaccttacacaaaaattaattccagatggattaaagacttaaatgttagacctaaaaccataaaaaccctagaagaaaacctaggcattaccattcaggacataggcatgggcaaggacttcatgtctaaaacaccaaaagcaatggtaatgaaagtcagaattgacaaatgggatctaattaaactaaagagcttctgcatagcaaaagaaactaccatcagagggggaggagccaagatggccgaataggaacagctccagtctacagctcccagcgtgagcgatgaagaagatgggtgatttctgcatttccatctgaggtaacgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgagggacgcacctggaaaatcgggtcactcccacccgaatattgcacttttcagaccggcttaaaaaacggcgcaccacgagactatatcccacacttggctgagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagaccagtggttctcccagcacgcagctagagatctgagaacgggcagactgcctcctcaagtgggtccctgacccctgacccccgagcagcctaactgggaggcaccccccagcaggggcacactgacacctcacacggcagggtattctaacagacctgcagctgagggtcctgtctgttagaaggaaaactaacaaccagaaaggacatctacaccgaaaacccatctgtacatcaacatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagatgatcaaattactctgagctacgggaggacattcaaaccaaaggcaaagaagttgaaaactttgaaaaaaaattagaagaatgtaaaactagaataaccaatacagagaagtgcttaaaggagctgatggagctgaaaaccaaggctcgagaactacgtgaagaatgcagaagcctcaggagccgatgcaatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgggaagagaaactccaagacacataattgtcagattcaccaaagttgaaatgaaggaaaaaatgttaagggcagcagagagaaaggtcgggttaccctcaaaggaaagcccatcagactaacagcggatctctcggcagaaaccctacaagccagaagagagtgggggccaatattcaacattcttaaagaaaagaattttcaacccagaatttcatagccagccaaactaagcttcataagtgaaggagaaataaaatactttatagacaagcaaatgctgagagattttgtcaccagcaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatataaatggactaaattctgcaattaaaaaacacagactggcaagttggataaagagtcaagacccatcagtgtgctgtattcaggaaacccatctcatgtgcagagacacacataggctcaaaataaaagcatggaagaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacatacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacggtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaatcgacaccctaacatcacaattaaaagaactagaaaagcaagagcaaacacattcaaatgctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactagaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatattacaaggctacagtaaccaaaacagcatggtactggtaccaaaacagagatatagatgaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatccctttcttacaccttatacaaaaatcaattcaagatggattaaagatttaaacgttagacctaaaaccataaaaaccctagaagaaaacctagacattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaagagaagacatttatgcagccaaaaaacacatgaaaaaatgctcatcatcactggccatcagagaaatgcaaatcaaaaccactatgaggtatcatctcacaccagttagaatggcaatcattaaaaagtcaggaaacaacaggtgctggagaggatgtggagaaataggaacactttcacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtctattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggagggggagggatagcattgggagatatacctaatgctagatgacacgttagtgggtgcagcgcaccagcatggcacatgtatacatatgtaactaacctgcacaatgtgcacatgtaccctaaaacttaaagtataataataataaaaaaaagaaaaaaaaaaaaagaaactaccatcagagtgaacaagcaacctacaaaatgggagaaaattttcacaacctactcatctgacaaagggctaatatccagaatctacaatgaactcaaacaaatttatgagaaaaaaacaaacaaccccatcaaatagtgggcaaaggacatgaacagacacttctcaaaagaagacatttatgcagccaaaaaacacatgaaaaaatgctcaccatcactggccatcagagaaatgcaaatcaaaaccacactgagataccatctcacactagttagaatggcaatcattaaaaagtcaggaaacaacaggtgctggagaggatgtggagaaataggaacacttttacactgttggtgggactgtaaactagttcaaccattgtggaagtcagtgtggcgattcctcaggcatctagaactagaaataccatttgacccagctaacccattactgggtatatacccaaaggactataaatcatgctgctataaagacacatgcacacgtatgctattgtggcactattcacaatagcaaagacttggaaccaacccaaatgtccaacaatgatagactggattaagaaaatgtggcacatattcaccgtggaatactatgtagccataaaaaatgatgagttcatgtactttgtagggacatggatgaaattggaaatcatcattctcagtaaactatcgcaaggactaaaaaccaaacaccacatgttctcactcataggtgggaattgaacaatgagaacacatggacacaggaaggggcacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaaaaaagatatggcttttacctttgggtaatttaagtgacaggctgtgtatctggtttcttcaacagcttaaaaagcaaacaacaaaaacagaaaacttgtgaagaaataaattctcagactctttttggtaccagagagatacttggaaaaaaaagtaaagactcaagaatggatcttataaatgcatcaaaaatagcaattcttaaaataataattttgttgtgtttgcagattactaactcaaaagtcattatttcaaaacccatatggtgtcacataacagaaaagattaaaagagaaataccaacctatagaatatgtttatgagaattaaactgtgccaaaactcttggcaatttaaaattgatgtaaatgtcttaatttacatttctacctaatctctctaatttctctgaccttttctctcactaatcctcaacctgatcaaggagctttagacaagctagtctatttactcagcttcacacctcctttttaaaatgtcttctgcacaaccgctccctgtaagtacttgtaatactctccccccaagttctcttcttgacattctccatgcccaattgagcttaccaactcctccagcataatcccacggtctctgagccacagtcattgtactctttctgctgaacttgtgtagcctatgaatcttagaatgtgttaaatctaatcccaggacaagtagtggtgcctctagaatatctatttaggtgaaaatgagggggtggcaaaccgggaatataaaaaagtagtttaggaggatttgaagtaaaactgtttccttagccagcatgctgtttttgcttagagtttaaattactagtcaatgaaacatagcaatgtgtcctaaagatatttattcatacttcacataagattacaaaaacatttgtttgggcataaattctcataagctaccccttgatacttctatattaggcaacaaccgtgtcattgttctgttacatataaagaaaggccacaaccacaatatgtacataataaacccaaatgagcattcatagactgaagaaattactctcagacttggtcaggtggcctagtaatacattccctgaatcatgtcttttccttcatatacataaaatattttgtatttttgtatgtatgtggataattgtttttaaaggtttatttctccaactacagtaaatgtaacatggccagggatcacatctatctctacttcccattatattatatcaccattgtctatctaacacagtgtatgcaactacagtgaactccctaaataaattgaataaatgagtggataaataccacagctttaataaataaagacactgcatcatagaatcagtctatatgtgtctgttccttgaatattttattgtttggggcacctcaatatcatgaaaatgcagacaaattggaagatatccagaaaaaatcaggggggtgggaatgattaaggaaatggaaagcctaatgtctaagagaagatttaaaaagtgaaatatctaaaacttggctagattaaagctatgaaaaaacatgacatattccacacatccttgaaggtaaagtgagaacttagtttgatcagtatagtaagaggaagaggaagagccatggaactcaggctgggctcactggtcctacaaacctcacctgctttcaagaaataagccacatagggacacagtaagaatgattgtgggcatactttcaactatcaggagcccctaaagtcacctagtggtttctcatggggtcagagttcaaggattattctctggcctacaatctctctccagagacccatgctggtcctggtgggtagaagctcccagtctcataattgtttgctgcaaaacaaatatccaagggaaatctattagtttcctatactattcattctttgagtaaaaattatatatcagacttaaaaaaaataaaggtatttaagacttacaacccccatcacactgaaaactataattccaagaagttccaagaaaagtaatgagttgaaaaacattttaagtactagtacagtgtcagatgtactataggtttgggaaaatattagcaaaggctgctgacattaacaaatttacagtgaattttaaaacatgcattgaaagaaaatcatgcctaggatcaatctaaatgtctgcaagttataaactcaaacattctagaatactttgaattaaaacttgatgaaatcttacgaataaacacaactaacattagtaaggtgattaagctttatagctctcttgttatgtttcaacttggttgtcaagctactatgacattgtagttcttccgacaatagccatgttcccagttgctaaaaaaacaactcctattcataaagtattttcacagtattaattttcattgcattttctcaccagttctatgagacatataaaaatgtgttgttcattctatgtttacagatgaaaaatctaaaacaattaaaatggtatgtgacttggccaagatcacttgactggttaatggcatctaagatttggaggcagattttctggtagctaacccagggctctttcctatgtaatgtcatgcatcagatttatattgattttgtattttatacctcccaaaatcaaacttttttatgccacaaataatagcacaatttccttatatgcctaagagtagcttaatgaaaaataatctgtatttattatcaaaatagatagctactgatatggtttggctctgtgttcccacccaaatctcatctcaaattgtaatccccgtgtgtggaaggagggattcggtgggaggtgattggatcatgggggcactttcccctctgctgttctcataataggaagttctcacaagatctgatggtttaaaagtgtagcacctcctccctcaatctctctctcctgccaccacataagaagtgtttggcttcctcttcaccttccgccatgattgtaagtttcctgaagcctccctagccatgtggaattgtgagtcaattaaatttcttttcttcataaattacccagtctcaggtagtatctttaaagcagtgtgaaaacggactgatacagtcacacatgcaaaattatatgtttatctctagctccactacagatacatattactgaaaatgcataagattcctatgtgatacattcataatttggatttagatgatagccatttctaaattctgacctttatggatgttaggagataagcaagtgttacattctgtgacaagaacttgacgtaataagcatgatgcttgttttccactttgctattttccaaattaattgctctttcccttaaaacaattttataaaaaaaaaattctgcacttaagccaaaatcgtggtccactagtatcttgttgtcagctctattcatgtttattattgaccaaagcaaattctttggtgttgggggaaaaaccacttaagaacagtactatggcatagttgaaagaagattagaatgaatgtagaagggctgaacttctcatatttagtatacctagatcttaaaatcttgagaaaattcctcctgttctaggtctctatctcattccttatagaaagtgaacccagaaaagttccaatagtttactcaaatctaaaagttttagtttgtagaaattaaccatgtgtcagagcaagaaattgagagagttagagcaactttaaagaaatttaatataaaaaactaacttggggaaggcaaagaagaagagatggagtcaggagtctttgtgagagaaaaattagtaagatatggaattgcctgtacttgaagagaggaagttgaaggagtcaaatataactctcaggtcttatgccagagaagctaggaaatgataatgtgaacattttgagagtagatgtgggggagatcataagttcaattttggagataatgactttaacatgtttcacattcacatggcagaagacagttggaactgtaatattctaaaactcagaagtgatgccaggaccaaggaaacagctttaggaattgtatagatttgagaactgaacctatagaggaacatgagtcctccaaaggggaaactatacatagaaagaagaaaagatccaaaatggtggtcatgagccaagtttgttccaacaggaagatggagcagcaaatgagactgatttgaaaatttctctgagagaaatgtagataaagaacaaacttttagattgatcatgcaaagataggttagcattatgaaagcaatggtaatgaggttgtactgaagaacaaattgcaaacagtgaacaacagtttgtgtggagatacatgatattatagactgtgttaatgaaatggggctgttaacaaatgaaagtcaaagataggaaagtcatagaaaacattttagaataagtgaaatttgattattcttttatttatttagatgagtttatggtgtttcccatccccctctgtaattggaatgaagggaggtgtaaagttgtttcctccttttcaagattaggaaaaacctgattacatttgaaggctgatagtatggaaactcttaataaaaaataaatatgaagagtaaaaatgtggaaaatgtagtcatagatgaagagaaaaaattatacattcaccaaaatggagaaatttgctttcaatcatagatgtaatgtatctgccacacagacagaagaaaaagaaggaaaggcaaatttaggaacaaagtgaaacaaacaaacaaacaaacaaaacccaaaaaactgcatctccaaataacgctttactggagcttttcatttttcttcaataatgaaaaaagttaattgccacattctaaatccaacacatttcatatgttttgcagttaaacaactgaagctaggagagaattttaattccaacttctggccctatgcttctttaaaatattgctaccaaaggagcctataaacatagcagtgcattttccttaagggatgtaggcattttagttcccaagctggaggtcattaagaatcatcctcaattagaaaaatatgatataattttggaccatgcattttttaacaggaataatttcttaaattgtcatgcccctacactattttaatctaacgaagtctcaatttactctgctgtaacatgcaaacatacatttctctaatattcaatctatatccaacataaactttattgctttaggatctgtctactgggaaaaaagtcgtatcttttataggaaatgattaaatccttctttcaatgcatatttttcaaaggacagggccaacacatagactaacataattctaccatgcaataaattacagttaatttatccacaatatcatctaagatcagtttttactaaaaatgtgaagcaaacagcacattttacaaaacagattcaaacaaatattcataaatctcggttactttattatagttactgatacatatgaataacagaaaaaaggaatagccctaaagtacattttatacaatcaaattatttttaatataacaccaagagctttaattccttgaaaagtggcaaaacactaaatgcattattaatcagtaaactcaaataaattcctcagttattttagagaaaacaagtttattttccatatgccttccttaatagccccatcacccttgcctactattctgttatcatcgatgttctgtcctgtgtgtgaaaggcctgttctctccaaactccattacccaaatcccacctgtcattaaggtccagctcaaatgtcatatcccttcactagttctccagaactttccagcttgaagtaattactctgtcctattaaccctaatgtttattaccagcaaatcatgttcagtatgcattagattatctgctattatatattattaaagtactatatatagtactatatatatatagctatagataatcgcttcaccccatccccacactcccactagactgtaagatccttaagagtaagattcatgccttactcttgtttgaatctatttcagcacctaatacatggttacatatagttgcaattcaatacttacattctgagtaaattttgataagtgaggacttatcactttgatgactagcagtcctttgatgattacttgtcagataaaaaaatatgaaggtagaatttagaaaaaagatcaatttcaatagttgtataactatttatagttcactagtaaaatgctatgtaaagtgttccaatataaacaatagttaaatattaagactgtatattttataagtctgacatggttctgttctaagttaccactaatttaaattgagttaggactgtcaaaaatctgttattgttatatttaaggactttatctttacaaagtcactaaatgtaagtttgcagataatagggtttcttctcaattggtttaaagtttataattcacataagatatttacgccaagaaaagtattaaatcctttagttaaaatctgcattttgaaattctttctttcctgaatttcaacaatgtcatggggaaacaggggtggcagagaggaaagaaagagagagaggatgttgtggaatataaattattcaacactgcacctacatgtataaattgatttgactattgcaatgcacttgaccagtcaaaaaacaccatgggaacaatggactactaggcttgtgcctaaagcaaaatgtgaacatgttactaaatcaaatatctactgtgcataaacaaaggctgtcttaattattagcatatttatgcagaaaatactagaaattatattattctcgtacagaattttgttttttaaagttattgttaataataataagcttcaaaagctagaaatgatagtaaaagcttctttaggactcagtgagcttgaacagacagaaggatgttttcagatgccacttgtctacgttaagtacttgctagtatttatagttgtattacaaatgtttattctcaggctatcagtacatatattatcaacccagtttgcaataaaggaactgaattctatcaaaaaattaaaaagtccttagcgaattaagtaaaaaaaaaaaaaaactaaagtagattttgcctgaaaagacttgcttgttgtctgtgtttgaaacagacggttgccatatttaataattcagaaatgcaaatgatgtcataaaaaataagaaaaaaatgttatgcaaaagatccaattttttttaattggagaggcttgtagctttacctatgttctctgagtccttgttaattaattctgccctgagtctttcgctgctaaaaggttgttttatctttttttttaaataaacctttgctttagaatagtctcacgtttacagaaaataatagagttcccatatatctcacacctaatttctctatttttaaatattacatcagttataaataatgaacaaatgtttatacattattattaactgaagtccatactttattcacatgtttgtacttttgatctaatgtccattctctgttccagcatgctgtccagggtaccacattacaatttagttagcatgtctccttagttctgcttcatatgacagttttctcagattatttttcttcttgatcactttcacagtttggggggtactcgtcatatactttgtaaaatgaccttaaaaattaggatttatctggtgtttttctcatgattagactgaggttatgggtattgcagaggaatagcacagaggcaaagactacatcatgtcaagtgtatatactatcaacatgacttatgactgttaattttgatcacttaactgtaatgttagtccagtttctcaaatcattatttgaaagaaattactattgacagcctacaggtaaggaatgcacattaatggcccacttccctgagggtataatagctacacaaattatttgagtccccccacaccatttatttattgattcaatactttttatatcagtatgatctcatggatacttacattatactttgggtttataactcaatcctagtttattattcagttgttcaatttgttccatctttggccactagaagctctttagattatcttttcaaattccacccaagcatccctactcattagtggcttttttgagtaatacaattctttgcttatatcagtatcacaagtaggggttagaggtgataaagaaatgtatttgtcttcaaataaagttttctatagctacaattaactgataagacattttaaaatagaccccttaatcaaaggtcacaaaattgaccatatgctctctaccaaaagaaaggcacagcagaatcattctagtactaacttatttcatgaatcatgatttcaagtatgaaattctaatactaatttatttcatgaaacgtgatttcaagtatgaaattatgtgcccctaaataatttcccattgttaattacgtatgttaagtgaaatctcttgtgtaatgtttaaggcaaaataaatttttctctttgacaaaagaccataccaaggcattaagtgaaaaccttttagttattatactcagctttccatgggatagttatgttttaaaagttaatattaaaatgctagttttcattggcttttagttgatatatatgtatatatatagatatatagatatatcacatatatgccttaagttgctttctatgaattatataaattagctctttgggataaataactataatcctaaactttctctagttaaaacttaataatttaaaacaattttatgaggagaacttagaagtctatattttaagtgccacagaactctctgagaaggcagctatcaaaatcactaaataaaaggataatgaataaaaagaggaaaacattcattctaggaatcttctgtgattgatcttatacagatcttctatctacatatacacagtatttgtttataattttatgttaagcttatgttatgaactctaacaaagttttgcaagaatgaaagagaatatttattttgttaattacacaagtattaatataatgccatttattagatacaacttaagaaaatttgtgtcctcttctacaacttacacttaatttaatatcaactgtatttttagtcattatagataaattgaaagccaatgttatcagttgacaagatttttcaatgtcacacatgctgaatgttttattaatacattttagagtacaataaacaatatttgtggaatttaaaataagaaagtatagaataaatgcattttcaataagatatgcatgggctgggtgtagtggctcactcgtgtaatcctaacactttggaaggctaaggtaggaggattgctggaaggaaaccaggagttctaggccagcctggccaacataacaagacaatatctctataaaaaattttaactatttaaaataaaaataataagatatgcatgcatatataagtacttactatatgttgtatgtaggtggcacataacttcaggattcccaactattgctacttagaaaatatatataagtggcaatatggtttcccagaaaatatgacttgatgaccctgatggaaccagtgttctcactactactctgaattttatcacatatatcctgcaagaagcatactgtcacatacctacagataatgtgtagaacccatcttatatcgagtctgatagtagcttggcccccaattcagatgtggcatgagatcaacttttgtcccttaagatatcctaggccagccaagtcctttctctcattctgtctgctagtcacattttatctattacccatacaaacctttgttggctgttccttccctaaacacactggatctcataatgggaattatccagaacactcattctctagccccactgagtcactagtgatccttgattcaaacacatccaaaagccaaaacccaaatgtggtttgagcctatcatctaaattctctctatacacacaggcatgctgaactagtagagaaaaaaatcacacaattatgccaaagatagcaagacaaatttatgttcttcaacatctgccccattttttcaaactggacagtaccttttgaccattccctggaccattccaaagtattaaatcacctttagcttcacaaagagccaagtaaagctaatatgatttcaaggccatctctatagctcccatcacccacttgcatccaagcagtttgttcatttccttccattgtgaacaattatgttataccattagacataaaaacttaaagtataaaagttcaataaagtcatttcagtgtgaatatacttcaatctaaatagcatgaataaatggttgatgtcaggtccttttctgttttaatataagataagctcaagagtgaaaagagaaatgctgtaagaaaaggttggtgagcaaaccaaggattatcacacttcacaacttttccaagactcagtcctgttggtcattgattagatcaagacaaatatggaactgtccattgcagttgtgtgcatgcatccctgcttcacatgatttataaaggatgtgagtgcatgtatgtgtatgtatatttttatatggttgaacttcatataaacaagctttattctcatatttatttttgagatatcactttacttcaaattttcacatatactttgtcacttaagcttttccagtatgacctgctttttcatcatgaatattgcctatgacatcttcaggaaatcaaccatattgtaatatgtgtcttataagtacataaagaatatagacataacttgcactagacaaatacacacatatatgcataagcaaatctatatacaccttatatttttattggtcaatcagatacattagagatcatattaagtaaagtatatccataattatactattaaaatattttttatttgtatttctgtacaagaaaatcaggagaaaaatttttaacatgttcagagcaagatatgtttggagcatgtcttggaacaagacacttaggccattcagataaatgataatggaaggaaactaaatcaaaaggaggtagaagacataaatgctctggaaggaatctgaaataaaatacaggaaagaatagaaggtctaaaataaccagagaatatttgcagtctcaagataatgagatatgaattataaataagttctaagagaatgcaaagtaaaggaatggtcatttacatgttgaaagatttgtgggaaatcttaaccttgaatggaaatatattcaaatacaatcataacagaggaaaaatgggcaaaggttgtgatgacacattatagaagaaatggacatgcagtattatccttgagaggtagttaattattacctaccatctgtcgatcagctatcatctagccatcaatctgtctatctactagcaatccatatatcatataatccaactaatactggtgggaaatgattcaaaatttttttcagcagttgcttcattataactttaacttgccaagtattcagttctgtcttcacagatgcctgaaacatgtggctaattcctatttgtctttgaattctaagttcaactcccacatcttcatggaggctttcctaaccccttggattagatgaaacccctagctctaccctgccacatattaccctgtagtcttcctttgttatcagtgataacctctcattacttcttttctgcatgtcttcctcacaagattggaagttcacaaaaaaatagagtgatatctgacttcttcactgctctactctggttgagcagtggctggcacatactaggtgatcaagaacctgtattgaagcaaattgcctatctgtagagccttgtctaaaggtgaaaactaaatgcaaaagggctggagccttgggggaaatttgagaagcagtgtgcagacatgtaggaaaacaatccaaagagaaaagaaacagagacctccaaaaggggtattaagtgccactaaggggttaaattaaataaattctaggaagtgtgtgttatatttaaaaagaaggaggttaaatgacatttactgtttacttatttggcttgtttaatttcattttgttgttctgttttgtttatttcttcaaggtaggaatgaaagggttacagaaatggtaatacaggattaaagagtaatgacaagcaagagagagaaagagagcgagtaaatctaagttcccctttcttaaagtctgggaaggtcaaacgtcaaccacagaagtagcaaacataactgagagccaagggtttgttttaatttacattaaaatgttttgagcatgtttcttatagagaaagaatttacatttaaatttactcaagttaggaggataaatgaaatgtatttttaaattatccattattacagcatagtctgatcttgaagactggtgatacctacctcatctttccaaagattaaacacatacacacacacatacacacacacacacacacacacacatacacacacacactataacgttaaacagaaaagttttagtagcattttcccaaattctccagtacatctgtttctttctaattctgtttggggttcggcttcctcggattatttacatagctctacagtccaaataagtgatggctacttatgaaataattattttggatgcagtgattcccttaggtgaaatatcctgctatcagaccacaagaaaccagaaggaacagtctcagaggtacaacggtaccatagttaatggaggaatttcttgggcatctgccatctgaaaccgtatgcattgtttcttgcttttctcagttgccttttctttagcagactcaaagtctaataacaactctcctaaattttaccaagcaattgtaatccattattattataataaactccaatttataagctaatacataacatttatatagtggtagattgcaacctaatgacaaacactgacctttttgtataataactgcgtctctcctcaatatttgtggctaaagttttagagcctccttctattttcatgtgcctcccaatgacttcatcgtgagtacagctcttctttgctattttcatttaaatagtctgttcattttggtacttaagcaccaccattcaaaaggatacagaaacacataatgaaaggaaattaaaagtatttctaggaagaatgttttcattggttcttgtagttttctggagtattaaacttaagtacagtctaaagaagttttgtttcttttttacatgtcttcctgaataagaacatttctattttcaagatttgcccttaactctttactgtcaaatatttaacattttgcaaaaacaaatgagcatctgaagtagttaggttttaacacataggatctaatccaacatgatgaactacaaatgaagctcccagaaaattgtagccaatctttgactaaaaaggcaccatttcccactggagaatatcacctaaataactagaattcatatacccagaacaaaaaatatgtataattcctaaaagtgtataaatttaaaagtctgagaaaatgactaagtcattggatcagcatatgactgaatacctctgggacaaagcatagtggttaagatattgggctctgagccaggtctctgtgttcaaatgttagtttctccatttataagctatcattataactgcctaacttttccatagttcagttttctaagctgaaataggaaacaaacagtacctgtcatagggttgctctaaggactcagtgaggtaacagaaataaagacacctggactagcacctggcacctagttagaacttagcagctaatactgcatttggaacactttttgtagaatatctcactgactgtgttgcctttcccgtgtgaccagttaaaacaacatttcagcaggaaatcgtcccccagctaaataaatgtaaaaataactatgatggagaatgcttaaaatctctacttattttgggtatttaaaacaacatagaagcatgcatttcaataaaaatgacagtatttctagtcacacagcgtattttgtgaacattctaactcaggtgaagtcatggaaccatctcaagtctagttattgattatgaaagaatttaaatatgtgagtgttggactggctttaattgataaaaaattgtactttcaatacaaaaagtagatatttaaaaaatcacatttaataaaattgtttcttgggagaaatgctattttcaaatgtcactagcttctaaatattgccttacatggctgtatttcgtaaatgtctatagcaatgggcctgttgttgctgtgacactgatttaagaacacattttggtcattactatctcttgctgtttgcctgcagtgagctctcataattagggctgaatacactgcactattaaaattaaaccaagcctctgggaaagaatcatggaactagatggttaaaggacacccaggcaattaacaagcatgataaagttaaaaattgaaaataggaaagtaggttaagagcttttctctctctttccaacatgatttgttgatacagaaggaatatatatcagttttattttacataggaaagaaatgtaaaagcagtgccacattgcagtcaactaaattattttgctgttttccagtggatttttctctttgtacacttagaagacgtgcaattctaaaataattctacatttgactgactttcaaaacaagcctgaaaatgctttacgctttctggaatcacaacagtgtaacaatgaacaagtaaagaattgctattttataaaatttatactaaaaaagtattgattatttatgatttgaatttattaggcttcctcaattccattacataatacctcctttctatttgaactacatgaaccaaataataaaaagatttgcatcccaaaatgttggtagccatgaaagttttcactcttcagaaaagagggaaaatccattcaaatccaataaaaagagttaagattctgatccttctgagactatgtctgggatattttccctgcataaagttgcattaagtttttttgcctcagtattattagagttttgttggaaatacaaataagatctgtgagtaaaacagaaagataaataataatattgtactgtcctttaattatagccttgatctttccttttcaaaattaagacctcttcctttttccccttcctttttattgtgaggctcattaattaaatagggttggtaaaattatgcttttctaattatattatctcttcatgtattaggtgaaggtaggtaatcattttttacatcattatgaactcaaatttaaacatctgatgggtttgaaatcatagaaattcttaccctttttgaagcttatctttggcttcttcaagtgggatcctgattctttttgctattaccctggtagtctttgataacctccttaatatctggtatgtcaagtttttccaggctcttcagatacattgcctgcccaagaactgggatcacacatttctcctcttcaaattaaggcagaccaattgtgcaaattccatcccagtttcagctgctgttccatcccattcctgttggctgcgtgggagtctcccatattctcagctttgtcagacacccttgcttaccactgcttccttcctccaacacatagcgcaaaatcaggtcttgcagttgttgaaggtttgtgtcacttatttttcaggttgctggggatagttttcctgtaaagttgcccatgattttttgtttgtttgtttgtttggattttgatcttgctctgtcttttatatgcaaaaactaagctgacatcttagttttgcatcttttcagactcaagttctttttgcttttgaaaatcatgtcaacttcaatttcctttactaagatctatgatatattttctatttacacaagggctaatttaacactgctcactcaggacgtttttcactggaatattatttcttcactgtaaatttggtaaacacgataaaaaaaaaatcctggtcaccaaaaagttaaaatttaaaaaaatcctttttcaaaatattgactcaatattttattaattaagccaagaggaacataatgttacctttccatccctgtacaataaggttttaaaggtgcactgttaaatcaaatagcacaatttggcaaagtggaacagaaaataaatgatacatacctaaaagtaatgtaattatttctaaatgtcattgcccaaagggatacattctcaactttattttgattaagacagcactgattctaaaggcaatgacatttaaatagtttttatagggctgtgaaagaagggccatgccaaatacaatagatagaatgtttatgtctccctaaaattcatgtgttgaagtcctaacccacatgatagtggtgttgggaggaggggcctttgggaggtgattaggtcatgaggatagagccttcatgaatgggtttggtgccctcctaaaagagatccctcaccccttctaccctgctaggttatagtgaaaagacagccatttgtgacaagcagactcacaccagatagcaaatcaaccagcaccttgatcttgcactttccagcctacagaaccatcagaaataaatttctgttgtttataatccacacagtctatggtattttcttatagcagctcaaaagaactaagacaacaagatatcatatatatatatatacatatatatatatatatacacatatatatatcccaattttaaaaactacataaaaccaagcattatagtaaatagagctcatagaaatatgcatttatttaattgtaatggcttcaactcttatttccaaatgtatgtttctgtgaaggaataaaatgcagattaaatgtccacactaaattattgttttttatagggcacatagggaaaaaggttgttggaaattatatataaaaaccaaagttaagcataatattgctaaaagtctctttattttttcaaatttattaagtgcctactttatactctgcttacttctagctttgggagcctgggagtgcagtaattcaaacagtaaaaaaacaaacaaacaaaaaaaagcacctcatcttagtgggccttaaattccagatggagggggtgataaacaatactcgaagtaaagaaacgaaacattaagtatgataaattgtgtaaattgtgacatgttctatgaaaaaaaaggcagagatatgagaaatagatgataacctggagtttaaaatatgttgaaattttaatgagattatatttgtttataattttgtgctattatgaaaaataccacaggaatcatctttgttctcatgtctttgcaatcttgtcatattttttctttacaataacttactaccctatacattttcaatatttgtaaaatataaagtatcaagctgacctttagaaaggttagaataatttacagtctttagtgtcatatggtggcaagctccccctccatagctttattattaaataattcactaatatttttctaggatttctgatttcagttatttttaccatttataaattaatttttttatttttttttaccatttataaatttaaacctaactttggatttaactttgctgaaaaataataaaaatggattttactcaattatttcagtaaatcatttttctaattccaaattagggtatatagcttatgtttttagtttttttagtcagtgattttcttttcttttatagattccaatcattgttgatatataggaaagttactgatatatcttaatgtatttatcttagaagcagccatcttactgaacttagcagttaactccataatttatctgttggttcaatcaactctttaatgttcacaaaaaataatttaggttcctttcacccaagtatatttctagttagaattgtgtgccttattgtattgcctgacctatccagaacaagtctctcttcaattcctgctcaccaggtagctagcctcaaaactaaaccagttgtttatagagaattctctccctctcaaggaaactccttctagccagttaaatatatatatatatacacacacacacacatatgttttgtcttttttttttttgatacagggtttcactttgtcatttagcctggatggagtgcagtggtgtcatcttggctcactgaagcctcaacctgctgggatcaagtgatcttcccaccccagcctcccaagttgctgggactacaggcatgcatctccatgcctgcctaatttttgtatattttgtagagacggggtctcgccatgttgcccaggctggtctgaaactcctgagctcaagagagctgcccgcctcagcctcccaaagtgctaggattacaggcatgagccaccgtgcctggtcccgcttcagctataattcttaagtagcttgcccaagcaaaagtctctatctttgaatcgtccatacactgtttttagtgtctctatttcttcatgacaatattagatagttcaggaagtcttaatttgggttccaaaaataaatgtgcttcaaggaaactacaaatctttgaaattacaggcaaaatattgtaaataaatgcatgggtcagagggtcaatagctttaatgtgatttgtgaagtattttatgagtcttcaagcctagaatcactaacacaaatggctaatcatgaatgattagtataatcagtaattatagccaatagaattatgggattatttatattgtgcaatacttattcaaccataacttggtgcttctagcatgtatttctgctttttatacattagatatatatccagatcacagaaaatacaggtgtccaaacttttcattctaattcacttacatggatattcagggtaaatatcaaatttattgtttagaaaaagagacaacttttaaaaaatactatttaaacaaagaatgactattctataggaaaaataaggaacagttgttctccctttaaaaactaatcaaataggccaggcacggtggctcacgcctgtaaacccagcactttggtaggccaaggtgggtggattgcttgaggtcaggagctcaagaccagcctgaccaacatggtaaaaccccatctctactgaaaatacaaaaactagctaggtgtggttggtgcatgcctgtaattccagttactctggaagctgaggaaagagaattgcttgaacccaggaggcggaggttgcagtgagccgtgatcatgccactgcactccaccctgtgtaacaaagcaagactctgtctcaaaaaacaaataaacaaaaaactaatcaagtaactttctatattcattttttcagtctctgctcatgttcctcaaacaacctaggtagtgtaaattttaataaggtgcattgtctttttaataaaataaggctaaaacattctgcaagggtataagtgacaactgctctagaaatgatatcacaaagatttcttttaattctgtcaaatttatagatttctcaaattcttttacgttcctaactagaaataattatatttctaaataacaatttttagactgttaaacatgacaataaaaaagaaaaggaaagatttatcaggttataactcatcttatttgcctcatatgtaatacttaactgatttgaaataacatcccaaatggtttaactatgccattttctgatgaaaagaaagatgaacagaaagtagcacatgcaacccaatgaatgccattataattttccctaaaagctatttccaaatgttcaatacggtagcattctataccaactaaagagattaaactggaaaattttgcagaaacaggatatattaaaagttttccgtccggaagcagtgtctcatgcctgtaacgtcagcactttaggaggccgagccgggcggatcacccaaggtcaggaatttgagatcagcctgaccaacatggagaaacccatctctaacaaaaatacaaaattagctgggcgtggtggcacatgcctgtaatcccagctacttgggaggctgaggcaggagaatcgcttaaacacaggaggcagaggttgcggtgagccaacatcgtgccattgcactccagcctgggcaaaaagaacgaaactccatctcaaaaaaaaaaaaaagttttccagtgctaactgcctcatgactagaccaatttcacacagcatatataaaatatggcattgcacatcagggcttctgctgccagggattgcatgaaggtaaaaaggaaatagcagcacaccatttacatggccattccttcatatatttttttcttcagaaattatggaaacggttagagtatgtacttagagaatatttaatttttcaaacaactaacatgccttaattctgttttaattttacactcatacaaataactaactcttaaatagcattaaatgcagagcataacttctaagcactacatatatagaaatgtttatatagcatatacagtatatatacacactatatatactatataccccatgaattttacatatatatatatttttttctattataattgagaaaattaaggtccagttactaaggtggtgaagctcagattctgacccaaacagttcctaatattgttacctcaaaataatatatgcccagtcttttttttttttaagcaaaacagcatcaaggattataaggagaacatataagcctctcccttttccttttaccctacatatcactttccaaattcaaccaccataattgtttcttttagtgtttagttcatatttcaaagacaaattaatttatcaattttaaatactattcattagctgccaactgtggaacacaaggacttagctttctgacatcacccaaaccacatttacgtttctcctgccctcccaccaacctagaataattgcaccacaatctttatttaaaacagtcaacttgtttacattattatgaccaaataaccattaggtactgttgaaccaagcaaggaactgtgattcttttcccttttttagacacctttagatcattctggagttaataaagttcttttgtttatttacttgtctccaatgtactctacaaaatatgaaagtcatcaatatattgttccaaatgatctctggaacacctagtaacattatttatcaaatgctgatatccatctatttgtttttcctaccctgaaggccttcctccagaacgctttgctttaccgccccagtctggactggtttctttcaaggctagctattttggagtactcctgggacttcaggtttctctgtgttagagcccatttcctagcttctatgtcttcatgttgtttggtgtaatttcttgttttgcaggaacatgtcatctaataactttctaagaaagggtacatgggtagttaatactagagttcttaatttctgaatatctttatttaaattttgtattatggcaaggtatggatttcttatggagattactttctctcagaattttgcagactttgttacatcgtcatttaccttaaagtattattcccacttcttgatatgtaactttttctttgaaaagtcttagtcatttgtttgtttgttgcttattcaatggtgttgtaaagcttctgtgtaatgatccttggacagtctttttctttcatgatgctaagtattccataagttcctcagaacagacatttcagttgctgctatctggaaaattttatcaaaaatgtctctattaattccatatgtccattttcacttttttatcattctagaataccttatggtagattttgaccttataaattagttattggttttgctatattttcttatatttcctattcccttttgtctttttgttctaattctaacgggcttcctagactttatctgctaacacatttcatccaagagctgttttttaaatttcttactatttttttcatagcaacgtgttcttattgtgcagataaaatatttatgaagatatcatttgtggagtattttttataatactgtcatttctccttatgccatccctctggaccttctttggctgtttgatttagtctttctctgcttgatttagtcttccctcatgagacttttctcaaatgtctggttatcttttgctttcagttccatattaaccaatgccataccaaaaatataatcacagcctcaatgtacacatgcgggaatttttgcagagtgattaggcaataaacatgattttttatctgaagactttgaaatgtctccctttggaggtattttctccagtttcccgactgagaaaaattggcctggctccaagcatcctaatgtgagcacagggagttctgtattcactaaggaaacccttatttaattctgttttcagtctggctttcctggaactatttcataactggcatttccaagtcctgaattcttctggatttcaatgggtgaaggattgtggaagtggaataatttgtccattaacttcctattttacaaatgttcttgagatctatattctctgatgtctcctctttcttctacttaccaatgtgtctgtgctttttcatattattttggagtgacttcaagagggaggaagtataaatgattaggttcaatccatcacgtttcccagaaggtttggagaattatttatactggcagccttgtttcttattatgtaaaagagttgaagtgacaaaattaatattcacaagaactgaattcctggcccagttcttactatctatctatgtcaccatgttcacgctacataacttctctgcagtttcatttattcatctgtgtattgggcagggaaatgtaatagttggggcacatacttgcaggtgccagtgggaaggagatgccaggtattactgtaggaaaaaataagagctttcattgctttcatctgaatttattaactctaagattaaatgttctcatgacctgcttggagaataattctttgtccattcagtcaataaatatttattacaggtctgttatgatgacctagaaatttcactccaaagagaaatgaaaacatctctgtgcaaaaacttgtacgagaatattcatatcagcagtatttacaataaccaaaaagcagaaacaactcagatgtccatcaactgataaatgaataaattaaaggtagtatatccataaaatggaatgttattcagcaaggaaatgaataaagtactgacacaggtaacagcatgaatgaaccttgaaaaaacattatgctaagtgaaagaagccaataaaaaatactatatattgcatgacttcactgatataaaatattcagaataagcaaaaatctacagagacagagagaggattagtggttgcttaaggctgagcgggagggcgggagaggagagaaagtgagtgctaatgcatatggggtttctccttaggatgacaaaatattctaaaattgattgtggtgatggctgcataactgtgaacttactagaaaatattgaattgcttactttaaatgggtgaattgtatggtatatgaattttgtctcaaaaaagctgttaaaaataaaccatatctgtatgtaataattaggtgatgggatgatctgtgcagcaaactaccatggcacatgtttacctatttaacaaacctgcacatcccacacatttacccctgaagttaaaataaaagttgaagaaaaaaaaatgaagcctctaagaaagtttggcaagaaaagtctattatgtgcatttttacaacattgggaatgtaaaactgagtaagattcataaggtagcatggtttaaattccagggaaaggacacatataaaaataattataaattctgctgaacagaaagcctagatagaaaaataagtgtgtgcacaatgattaaatggaaatctaaaagatgagtagaaactagttatgtggagtgataaaaagtgaaaagagtatttcaagcttgggggtaatgtcacattaaaatcttagttgcaggagagaactcaggttgttctaggagctaaaaatttacccaagtggctggaacacagagctggaatgagtggcatgtaatgaggctgcatatatcggctgaaattatgcagggtcttgaagctcatagaaagtttgtccaatgtagtctaacagtaatgggaagttactaaaggttttaaagagcataacaatattattagatttgctttttaaagatcactcttgtcactctatgttgaatgaaatggaggacaggttacattttctgtcctaaaacagcctgtaaatatcataacaggaatgtcaaccttggagaacctacgttattcgtgtcattttaagaaatctgtaaactggaggcagtattaattggtcaaatcaatatgtatagaatctctagaatgttcataggcagtcattccattccctgaactttagccaaaacaatgaagagtaaggtgcgaagatgtttgttgcagcactttttaaaaaatactgaataactgtatacaacaaagctgatagtctaaaatttataaatatttactaactttgtatgtatgtaaaattagccttatgtttttagagttacagctagtgacctgaaaataaaattaggtttatataaataaaattataagttgtaaatttaaagcatgagtaatgttgcttccttgctttaactgcgtggtcaactattagacaaaatagaaaaatactatgagaaaactaactaacataacttgaaagagtcatgaaatcaatcttatcaaagttgggtgaaatgtgtcagataaacactcaactcaaaaataatcaacttctatatatattctttacttctatatatattcttctacaaagtcccttgaatagtttctgtagcacatatatacaaatagaattaacagagccatgaaggtttattttgcaaaaacataaaattccaggatgcaccaggaatcctgatttttttttcctgtaaaactaatggtaagttgtacatccagatgccttcacaaagaaaattatttttagaagaaaagtacttagagaaaatataattttcatagtgcatgcagacttttttctttattatcactatttctacaactaaaatatatagtgtcagcctaattcatagtttgttactcctttacacaaaatgataaaatgaaaatttgtcacagaccctgcaaatgctcagtactcttcatgtagtgctaatgatctgcaataatttgcactgtacttacaagagactctatttgaaagttcttttccggagcccaattgttgtttctaaataatgaagtgaattatctgctaaacacaagaattatattcagaatgataagattatcacctgaaaatcatactaaatgcattctgctggtttcctgctcactataggacataggtgcattgagtataataatgcagaattacaaatactatttatcttgctttgtggtggtgatgttgttttggtttgtggtttttgatcaagcagatatagttgaatataattttcttaaatgaacctatgatacaaataataagtaatatatctttccagtgcatttaaatttctttcattattcaacaggcacgttcataaacccaagtccacataattaaatatgattagtaaagtgtacctctttactgattctcaatttataatcataccccgaaggaggtttaaagggaaagttgctcagaaaaaaatgaaaactatcttataatattttaatagtataaatcataatatctactaaatgcaacagtgaaacatttgctaaaatttaaagttgcataacttacatgtatactaagaaaaagtaactaaataaattcacacgtttaaatctttgaagaaatttcatgttgtgtctaacagttgctagagccactaagaaaaatgtaattgaacttaaagcacaaaaaggttcacctaacatagaaaaaaaataaattcttatggttaattttggctatgttgatatgaaaagcaaataaaataagcattgctggcagatacagagtgtgttcagcacaaagataacataacagtaggctaattcgtctttaaaccctagaaggttgaattgttttcttgtgagaagctcctggaagcaaatgttctctctattatgaactgtataatatgggtgaagcctcccttccctaatgaacacatcagtgatctctgatatcagtacagttgtggctgcaattcaaagcagagatggaagaacggatgtgacggtatcttcaggaagtaactcccatctctagagtccttgagtacttacaacaaaataagcttttcacacactcatactaatgatgaaaagaaattgaaaaaaataagaagtcaagatacaaaactgcctccgttatgaggagcaagatgttggctggcaatacatatggaaaggagcattctttttaaaagtccctttgtgtaagcatgatggaacaaaataatgacagaatccctaaaatggcaaatagtctggtgataaattcttccaagataaattgcttgcataataaaaatcatccacaaaagtattctaaatattctttcaacctatttaaatgattatatcataactatcaattggctatggaagcacaatgcttgccaagcatcacttttaaaccttagtaaaattctagctaattaatataaaatcaccatgaatttttaaaaatcatatttaacctccaaattaaatgtgtctatgtgttgttcacatgaaattcaataagactaagaccatactgtcactacagaaaaatcgagctacatttgtttttaagtaactatccctattttccctagtttgggtgcttatataccacagcataaacaaaaacatgagcttgttgtgtttactaaattctgtagcttccacccagttatttcaaacagtacctatactattggactgctttttactctctgaaggtttctattgtcatcctctgctgaggaaaaaggtaaatacagcaactctgccctacttacgccaggggtagagaaaactacctgccagacacagcaatagcactcttgggctctggtggggaaaagaggcactagctagctctctgaaagtctcagtgggagcacagccttgtcccttgaggtaagtaaagtagaaagctatcagtcttaaaaattatcgtgagcagggaaactagaaacagtgttaaagtcacgacatgccctggagtaagaacatagtaaacttctctggccatgtaaaggtttattaaaagtgtcaaggaaaagaatcctctggatatcttcatttgtaataactccccactcttcatagaaattactcttaagtgtcattcactcagttgttaaatgattaatgaacttaagtttgacattttaggaattgtagtaaagcacctccctgaaataatccttcaggaaagggcctaaagtaaaggctagatcatgaccgcaaaaatttctagtatctgttgaaaattactcacacattcctttccctgtagaaaaaaactaccgctagaattttgtctttcctatttttgttctttcattacattatcttgacgttatagattttagaaaatcttatattggttttgagatcatacaaaaaaatgaaacaataagatgtaaatatattctgaatgtaaacaagtacatgattatttttgcagtttgttttagaacaccagtgtatattgtaattatgttttaaaatctattttttcagatatctttcagtttaaaaagatctaaataatgataattgcttaatttgtgcctgccattttcttttttccatttatacaagggaaaagtcaaatattccaaactactccacactggaatttagagtattagctcagtttttaatcatttcccatttctttgaaatggataataaaattaaatcatcacctgatttcaatttgttcctttgttcagtaacaatgtttttattaaagagatattttgtctcagaagatttccttgggaaaataaggagaatcctgtaattccattcattcaaaagactttcgcatgctattctaattcctgaaaagtggccctatgtttttatttagcaagtgggaaaaagtttaattacttgatgtgtggtatcattttgataagggatagtccttttcacattgctgaaaaaataaaagcatcatatgtaatcattttattgagtgaaattaaatgttaaaagttcagcatttttgcatgttaatattgaacctggtacatttctggaaataccacatttatttttgctattaagactggagacttttttcatgtaagttattttcatttaaaaattttaaaatgaggtgaaatatatttccattggggactgaggaaaagataatattctatacttgattcccacctttaaaattctaaagaacatgacaaccttatacatcttagaacagggtcatttataagtttgcttccctatcttcctactggaggaaacaggtttgattatttattacatctttttaatatgaacattttcttttttttaaaatttttaatgaacgttctttcaatcaaactcttaatgttctctagactataaacgtcattaggttttataagttctcctttggactttgctgtgtgtttttacaaataagtaccttaaaattatacactttctaaaatccattcactctttgcatagatcacggaggctactgatttctgagacgataaatatctcaaagaaggcaaagaccgtcactctgagcctttgtgtggcgggactgtggatttttcacagctaatgtcattcagaactgtggacagctcccgttaaggcatgtagttggtgacaatttcccttagtttctaaactaactccaaggctgctttacattgctatatttatcctataaagaatacttagtatatgcacatactcctttagttgattcttcttttcttttcgaacgagttcggccaaataaataaatatcaccctgagttattaggagttactagttctggattttaaaatgggaagtccagccttgttcaggagctaagataatcgtgcacacgctaataagaggatctactacacgaccttcatttgacaatctctaaatatgcttatcaccgaacgaatacttgagcgacaagtaagatcagaaaacgtcttaattttaattctccaaagcggagttttcctgctgacagctttcctgtccttcttcccgagctggaggacgtgaaaaagatttttgaaatagacttgcagtcaaggtcaagaaagggtgccgctctatttcagaaaggggctctgtcaacgccccctctctctgtttcaggaactagaggcttcctgccacgctcctgccctgcctggaagcgcctggctttggtgagacctcacgtcagggactatccaagtgcaaattgcccttcttttgcctgccggccgctgtttctgagtaaacacagcgaggataaccagcgcctataaagaaaaacagactaaacacactccccaggggcgagcgcggcaggaactgctcgggcttgtgaatcgctgtctccggttacccagtcttcttctgagccccagaagcctccttttccctcctggttgagaccacacttgagggagccgcgcgaggaagggtggcttcccgcttcctcacgctctcgtctctgaagtaaaagtttcccttgtacaacttcgcctcctcccaggagggtgaccgtggcctccatccttccctgatctgtccccgaagttcaggaggccaaggaggagagcccgtccgggattcccgggcaacaggagcacatcctccgagcccctcctgggtggaaactacccggaggcgccgagtggagcctgcttagcccgagccgacgccgccggcagcgccaccccccgcccgccctcctagtccccgggacgccccccacccaagggcggggaagcgcgtttcagggcgcgcctgaagggagggtggggcggcgaccgggagccctcacctgaaatcactgtaagggtggataatccagaagcctgcagttttaaccctttcctgctccttttccaccgccttctggctcccaaacatgcggagggagaatttgttgaccccgggctgcagcatggaggtgaactgcctctgcatgaagccgtactgccgccggggcccctcggcgtcttcgaagccccccgccggctcctcgccgccgccgccgccgccgccaccgccgccaccgccgtccaccttgaagcacacggagttgccgtgctccttcgcgccggccccgccgccccccggcggggtgcccaggcgcttctcggccgcggccggccccgcgcccgtcgcggacgccttggcggggaagacgctgttgccatcgtcccggctgttagacgaagagttgggcttgccgcctccttccatgcccggaggacgcggccggcgacggcgcgggctccagactcgccggccgcccggcgccggagacacgtagccgagagggtaggggcccgagccggctgccggcgagcccagctgcccgtcgcggcggcggcggcggcggcggcggctgctgcttcccgaccgcgccgctgctagctgcgcgcctggctcccgccgccgccgctgcccttagtggctgcggtccgggctccggtgcggctggtgctgaagctgaggctgccggagctaggcgaggctcagctcggctcagccctcgcgccccagcgcctcccctcggctgccctctgttggccagaaagggtctctccccgtccgctctccacacatgctcgttactcttgctctacttctgcccagcgtgacattgaactcaagagccctcggaggagacattcattggtacacgtggagaaggactcggtgtatgtttgcatgaaagacaggggagagaggagagagagcaagactgaactagcgagtgtgtgttggtccaaaagaaacaaacatcttaaactcatgaagacattgtctgaacgcctgtttgaataacgttacagatggagaaaaggggacaagctgactatgcatgccaacaattcaagtgcaaaaccaaatgtccaaaagaaagtaaagtttgacaatggaaaataaatgtccaaagtatcagggaaagtgtgcctgtgcgtgcgcgtgcgcgtgtgtactagaaagagaggcagagggcaaaagctaccaggtctgtgtaatcctaggtaaccagctgcttggggcttttcagattaaggttctgcacctggggacagacaactgacctccttacacttatccttgttaattcttgcagagttttttaaacagaggacgggatttctttctttccaaggccattcgtatcaatacacgtgcaagcagatctatcagccaccaatattgaaagaaaagtgtgtgagggaggcctcgcctgagctgacctatctttttagataagttacataatcaataaaacacattaagggatgtgtgtgtcggtcagtgtttaacgacaccacgctaggaagttaagacgtcttggaatctctcgtcagaatgtcattaccatttcagaaggggggaacactcttaagggaaacttacaagtgtagtactgatgctgaggaaagcattatccgtttcctcttattccctctgcgtctctgaaacccactggattagctaaaggaagcaaaatgtgctgccaaacccaccagtcactcagcaggggagccccggcgtctgaagagcttcaagactcccgaatgtcccaaaacatctgtttcagatacaagcattgcctccctgcccatagcctcttcaaaggaaatcttgccctgccaagagtcccagatcccctgggttcctgtcagctgtagccacattttatggagaaggggcaggcactcaaggagggaatgtgtatgtcaggctggcaactagtgagctatcatgaggaaaaaaaaaatgagtggggctaatcaaggtgtttttctgaaaaattaaacagtgatgaagccaattaacaatgaaggaagcaaggataaagacaaaggaagacaattggatgccttcctgaggggttaacagaggctgagaaaggaagcagagaacagagaaaatagcagagggaagcagaaacgagccattaggcctaactcagttgcaattctgtaagatttccttaccattctccttaccatagcctgtgctaaatctccttttttcacggagctatgtcctgactcaggcaccatctgttttcaactaatcatataccagaaccctaagaataaatatggatggccaaattttaatggtaagagataggaaaaatatgaaaatatagagctctgatctgtcaaaatagagacctttctctactttggaaagccaagaggtcagataaggataccaggtgctgagggcagaaggaagccacgggaatggataaaaacaaacattgcccaaagcacagttctgcctaagaaagacccgattactcaggcagcttttctttattagactaaagatgtttccctacttttctcccattctgcatgcttcctcagtccctctattttcagtcatgagtgtgacaatgtatattttaacataaattttaaattttataataatgtaaaaatataccatctaaaatgttatgctgagtttaagtaagttttgcttttcttttagccaatctctctgtttgttctattgcaacttaatcttactcatgaccaggcagttattttagtaaaagtttttctgagtttcaaggtttgtactaaactgatatgacagaatcactgaaaaacaagatctcaaaatagaactaagaaatgtcttaaaaagatcacaagtcattggttgttccaagtatagcttctaggccatattttatttattcaaaatctcaaaaaatacattttcttaaaaatttgagaatgtgtatattatatcaatgcattaacttaaagttgtcagcaatataaaaagtcatgtttatttacttttcagagtgttgatttaaagttgtttagaatatgaaatttaagttttctttggaggaagaatgaactctcaagaagattgagacaaagtgaaagcaataaaagaatggaatcagtgatagaagaagagacagagagaatcttgaaacttcagaataatctcttcttatcttgtctttgtatcggtttgttgataaactatctcaagctaaaatctagcgagctaaatgcgagtgtttatttcaaagacatcttagaaataagactaccatcatgttgactctgtgtcattagatgttcatgatgtcaaaatgcttagtattttacaggaatctgatttctgaggactcattagagaatatcaattatgaattaatttcaggagaacgtctcatcagtagttgtaatgggtgctattcaatatatacaagaattgtgcatcttctgaaatgttccctgtctcctttaatactctgcttaagatcaaattgcaaggcagcagcagaagattaatatgcatctaaaataaaatctccatgcagcagatactagcacacgtgaaatgaaagaaaaaagatagatcggtgacttgaagtttgatggtttattggaaaatctcagtgaaacttaaagatttaagggataagacattttgaccctcttagtaggacagagtaatatgttacaaacatattacacgtgtaaggaaataaaataagaacatctgttgaagaaggcagtggtaaggaacagtgaaaaaaaaacttcctcattgacaacctcacagtctttctgtgtcttgtgtacaggcaaatctgattatctatctggaaagccacatcaacatcatgcttaatatgaaacattaaagctgttaaagtcagaacaatacgctcatatccaccatttctgcaatgcatggtatttttaattgataatattgtctcctgaaaaccccaaataatcaactggataatcatcataactaataatagaagttgggaagttggtatcaacttttggttactttagtaaacatgcaaaaattaacatttttcctaagcatcagcaataaccattaaggcaatatagagaacaatgatttttttcacaattgcaactaaaaatgaaaactacacaataataaatttaacaagaaatgtctgagatccatagtttaagatactttattttgataaaagacataaaaagcatttaaataaattagctatatactttgtccataaagtctcaatattataaatatggtgctccttccaaaattgattttaagtttcaaacaaaatttggtgattccatggacacagggagggaaacattacacaacagggcctgttgagggttggaaggcaaggggagggagagcattaggacaaatacttaatgcatgaggggcttaaaacctagatgacaggttgataggtgcagcaaaccaccatggcacatgtgtacctacgtaacaacctgaaccttctgcacatgtatcccagaacttaaagtaaaacttaaaaaaaagaaaaaaaagaaagcaaaccaaacaactcaccagcaatatacagtcattcctggtaaccaataaagcaacttacttactttaaaacgaacaacaaaaaaaagtgttattagttttctccatgcggacaaaagcaacaaaatgtttttaaagtttaactggattaataaatcatttttaacagttcataagctatggcttaaaaatgaaaacaatgaaaaaatgtccaaagtattagaattgcttagggtagcactgagcagagaaagagacagataaggcaatgcaaaagagtcaaaaccaggccgggtgcagtggctcacgcctgtaaatcccagcactttgggaggctgaggcaggcagatcacttgaggtcaggagttcaagaccgcctggccaacatggtgaaaccccgtctctactaaaaatacaaaaaaatgagccatgcgtggtggcatgctcctgtaatcccagctactcggggggctgaggcatgagaatagtttaaacccagtaggctgaggttgcagtgagccaagatcgcgtcactgcattccaacctgggtgacagagtgagaccctgtctctaaataaataaataaataccagaaacacactttagttttaatcatagctccaaattgtcattccacatcaatgagcaaaggatatgttgtatagcaaatggtcctaggatggttaactattccagggaaaaggaaggtagaatataatatcatgtcatttcctaaagtgaatttaagatgatttagtattataatgtaaatactaaaaatcatgataggtaaatgtttataaaagcaaacactggaaaagactatgccactttaaaagattgatagatatttacttttcagaattttttccattgacctgcctatataaagactaacaatactatacaattttaatagttttaatatatggtggcccaatcccaacatctgtatttctcttcatgtgtctgcatacatacatattaaacatgattttttttcatatacatgtagaattatttttgacaaattttggcacttgtctttgtagttaaggcatttcgtttgcattgcacatagagacattttaggaagaactatcatctttcaatattgagtctctattcaaaagcaaaatagatattttttccctatttcttccttcttgtatcagcgctaaatgatacatattattgtcaaacatttgaagaatacaagatttaaaaagaaaaaccttaaagtagtccatgaactcatcttcattttgctggcacatgcctatctttcttgactctaacatgcatatattgatttctattattttacataactaatctcttaatatatttattgtaccagcatttggatttaaggtttcaaagtatatcttgaagatattagcatgagataatttatagcatccttttctttaatgcctgcatttgttttgtagaatggatataccataatttacttaacatctcctttactaatgcacatttgaggttttattcttttgtgctaaaacaaactgtgttacaattaatatccttattatatctctgtgtagttatcaatatagatatggagaaaaaacattggaggtaaagataattactcaattcatgggtaaatttgcttttggtagtaactatcaaattgccctccaaagactgtaggaatatatatttcttctaagaccacatgagattacctgtttcatacgcttgccccaaaatcagatattaacaactttttccaatttaaaatgagcaagaaaaaaatgataggccattggagttttaatttcattttcacaattattaataagaataaacagatttcccatgttcattgagtttcttatagttattcatttgtgagttatctacttttactatatgatcatatatgatacatatgtatgttttattttcaatatattttacatataaaactttcaccatgcatgtaattttagagtaatgaattccttgcaaagaatgaaaagaagccatatataaaagactgataaatttgagtcaatgaaagctgactttactttccatgtctgtttaaaatattcccacaattattcaactattctctctctctcttttatttttttatttttatctttttttagagatggtgttgccctgccctgtatttcccagactggtcttaaactcctgagctgaagcaatcctcccaccttggcctcccaaagttacgggtttataggcatgagccactgcacacagctaaaattcttggatacttttgttcctattttctccttcatattaatttgagaataagtttgtcaaattattttaaacaatctagctggaattttgtttggaattacattaaatttatgcattaattgataaataattaacatagtcataaccttaaattagtacatcttaatatgtaaatctctccatttatctgtctctctacctatcttaccaatgtatctaaatacaaggtaatctattgcatagttattttttgtttatttatttatttattctattttttaattttttttttgcaatggagtctcggtctgtcacccaggctggagtgcagttgtgcaatctcggctcactgcaagctctgcctcccgggttcacgccattctcttgcctcagcctcccgagtaccacgggtgcccaccaccacacccggctaattatttgtatttttagtagagacctggtttcaccgtgttagccaggatggtcttgatctcctgacctcgtgatccgcccaccgaggcctcccaaagtgctgagattacaagcatgagccaccatgcccagcctattgtatagttttttaatataagtcttggaaatttttcgttcagatttgttgctaggtatttgatatgtgttctgactttttaaaaaagagacattttatcattgtgctttccaactggctatttttggttatagaaaaattatttttttactactgactttgtccttgcatatagctgtagtagggaattattaaactgtatctaatacggtattttagtttattctctttggtagtgtcagtaaataatcatgtcatctatcaactatatgtttgttctctttcttaacaatttttataatacacttttcttgacatactactctggcaaacaatttcaattaaatgctgaatagtaatagttataatgttaactgacactgttttaatgatatgtaatagtaactcttctgattttatggcatttgctataggttactagtaaggtagccttcatcatattaaggtagatttcttcttgcttgttaagaagtgttttaatgagaaaataaattgatacatattattaataattttacatatgtcaagatgattgtcttttctcttttaatctgctaatgtaatagattataataaacatgattaatattttctttacaggcataaatcttatataatcacattagactatcatattaattcgatatgttgttagatgatgataatgctgatggtcatatttttattatttgctatttttggccagctttggttatgctggcttttcacagactgagatctgaaagctttattttcttctgagctctataactgtttattccatgtaagtgatatagctgtcaaagtttatgtttagaaacacacaaatgtgttcatttgagtatctttgccagctttttgattattctacaattgttgggctatctgatagtgctattgaattgtttgatactgtatattacatcagaaaattccccaattttccaagcttttaaacagtgagtgtaaatttgtatactatattctctttaacagcaacaacaaaactcccctctctttatctttgttctttatcttattcccaatgttgtttctttttttaatttttaatttattttattttattttattttttattatactttaagttctagggaacatgtgcacaacgtgcaggtttgttacatatgtatacatgtgccatgtttgtgtgctgcatccattaactcgtcatttacatcaggtattatctcctaatgctatccctcccccttccccccaccccctgacaggccccagtgtgtgatgttctcattaatgagtccaagtattctcattgttcagttcccacctatgagcgagaacatgtggtgtttggttttttgtccttgcgatagtttgctgagaatgatggtttccaatgttgtttcttttctctttgtctttttaaagagaatggaatgagcttatccatttcctttgtctttttaaaaataaccaatctttaattttgttgaccaagtcaaacattttttttgctttgtgttttattaatttctcaaaggcccaatgagtccagctattctgaacccagttttcaagtaaatgctttgaaaattgccccagagtgcctctatgcaacttttttcatctgttcattgaatatgaagtaatgttaccctctggaaaagatttacctttgcagtgcttttttcttataggatttttcctgtttttattattttgttttttattacatttttttttcaaaaatttcataacatttactttctctgttcctagaaggtcttgaaattacaggtgcggggaaattgttattatttttctcaggggtttgtactatttctttaaaatgtatcatttctgttattttacggaacttaattctgaagtggtggtgaatgaatgttctgttttccttcttgatttaccccttgctatgacttctcatttaattaattattgttttattttttcttaatagaatttctatttcttagtaatataactattaaatattttctagttacactatgatgctttcttgaaagtatttttgtattggtcattattatgaacatatttgcatctggtgtaaattctaattttgtgagggttattttttataaaataaaatttcagggtttcttttatattttagtcttataactaagtattttactaaattatctttattcattcatactttctacaaatattcgtcctggcgcagtagctcacgcctgtaatcccagcactttggaaggccgaggcaggaggatcacgaggtcaggagattaagaccgtcctggctaacacggtgaaaccccgtctctactaaaaatataaaaactttacctggcgtggtggtgggcgcctgtagtcccagctactcaggaggctgaggcaggagcatcacttgaacccgggaggcagagactgcagtgggctgaaatcatgccactgcacttcagcttgggagacagagtgagccagactccttctcaaaaaaataaaataaaaataaatgttcattggatacctactatatacagacactctttaaagcctgcagtttagcaactgaacagaaaaggggaaaaaatctatgctttgcagtatcttatttttatttttttttttgtttaattgatgtgtaattctatcatgcacagataagaaatatattttatctttctatgaattatatatttttattttgttatcttcttaaattttattggtttacatttgaaaaatattaatttgtcttataatgaatagtctcagaatacttctactatcttaacattaagtattattctatttgtttgaagcagagatatttgaagatataaatacagattatatcttaaagaatagcactataagaggtaagaagtgtgtgcgtgtatgtgtgtgtgcattttcattaagtataatttttaagtcttgttgaattcctttttaacacctgttgcattattttaatgaccataacagttatagagcactagaataaaagattccctaatgaacttctatctagcttaacatgattaggcacagattttaatctcaaggtggaaaacttctctgcattcattcccctccctccaacttcttgctggggtttccttctggacaaacccaatagaagccccatagctcagaggtttgttcatatgtctaggacaaggcaaaggatgaagagtggatctgtagagaaaaaaaaatatataactgacatgctcttcaatttaaccttcctcacttccttctcctcattatgtttttatctgttttatttccatttagtgcttctttcctaaatgaacttgtatatttattttttacttttttctgatacagaagaaggcaccacaagagcaatgaccttccctataggatttaacactgaatcttataagcctggaacaaagtagggattctataaatatttgttgaatgaataaatgaatgaatgaacctcttccaggaatcctccagcttcatctagaattccctcctctgtacccctagagtatatatgtatatcactatgcatattattactgcatgattatcatagtgaattataattgttaacatgcatcatttaccttaaagtgtgagtaaagttggttcttataattattgacttgtgttttttaccttagagtgtgagtaatattcattctatagtatctaatgatagcactgtgctgagtcctgtgctctgtgctccatagatgtctcacttaaacctcaccacatgtttgtaaggccaatattgtctcctttttacactctaggatagagagcttattaacacaaaaattttacatagctttcatgtgacagagctacctcttatcatgagtctcttggctccaaagttgcctgtgctccttactgaagtgctgtattttctattttagtaacaagtatacatatattttcaaactctcatttcttcacatcaaaaatttttacatgtctgatcaccagatcaattaatgcataagcaacatgaaaaagggttaataatttgccaatactgaactgatgaattttaatttccttcttaaaattgtgtccctttttaaccttacacttccaaagccaaatctcatgactagttgtctcagaaagagggggaggatattgtcaccaacaaagaggccattatcaacttggagtctcaaagctgattttctccacctctttagcaagaaattcagtgaaattctggaaatgaaattacacacgattataaatgagattattattattattgtctctgagtgaattaagatgcataaattgggttaaaggggtttcctctttataattatttttaccgtagcgatttacaaaactccacagttcaagactttgtttatctgttgttttgtttctccccagcagtgacaattattgtatactgatccattcttcttctcttcttaagacttttgtaaacttttcaaatcataaaaacagttttaaaaacctggaattaggcataaaggttttggtcagacaaaaagggagagaaaatctcaaaaaaacaaatatcaagctttgactttattgcaattgagaagtgaattaaacaacattcctatattctgaaatattggtatccatttagagaaacttacctgatttttatttgttaatatataaatatttcaatgttgcaggagagagccttacgttgattattaaatattatataacccctttctttgaaacacactcccttcctaactaactccacatgattagaattgggctccaattactgggtccttccagcaccttcccctgacaaatgtgagtccttgattcaagccaggtcatgaaggttattctcccagaatctgagcttttcagcatagactaagtgagaaaacgggtggttgcagctgagttttctgtgataacaacatagacatacaatctgtagtttattttactggtatttcatagagccttcctcatttgtgttgaccttcagatcttccttaaattatgtgaaattctgtgctatatattcttaatttgtcactgtatattcaatttctacccctttcttccctcttggctgaactccatggactgcattaccgtggatcttatgtattgtgactaccctaggccgataggagggaccagaaagaaacagaaggacaggagaaaaagaacagattttttatttcccttgtcccacttcctcccttcttcaccatggttctattcctggctactttcctctatgtccacagctcctatagtcttctcaatggctatagcttgtaccccattcagtaataatttcctctgccctgccattaccactcctaaaggcaaggcggaggaaattattactgaacggggcaccagctctggctagtttccatgttgctgcttcaccatatttgttggtccccttaactttatccatatctctgtaaatagccctttcattaaaatatcttcaattaaattcattgagtgagccatctttttcttgctaggacctcaactggtacaatttcccaatatatgtttaataaatttctttgtcaaagctggcatctcttttccacatcaaatgatccacagatcaatcaattaattgttttatcttgctgtctattcatattaatcaaaagtatgtattttgttatgtgtatgtataaaatagtaactacatatatatacacaaattttaatgtgttctctaagaatattattcagtagcacgtgttttcaaaagaatttctccacttatttctggttttaaattaatcattttaaaatatcaactataaatctaatgtacgttctacctgttcaggtaaaaaatcatgactttgtcttttatttctctgcttcatgtctaccttacattcaatctgtcagcaattcctgctttttctacattttgaacctgaccacttctctctactttgcctccctataatctaaactcaaactctatagctacagtgaatcttttatgacaaaagccaggccaggtcattcctcttatctcaatcctctaagggaatgatggccccattaaaagccacggtcctcacaatgtgctaacccctgtgacctctctgatcccattgactacttccccttcccccaaactctgctcccacaacacaaacctgcttgtttttcttcaaactcagtgagcacatgtcaatgtcatcacatagcacatgctgctccttctacttgcagtttttctctcaccttaaacaggtgtgtactttaagtgatcatctcagttatcattttacataaaaaccaacccctcttattgcttcctatctcccttctctgctttatttttctgttctgcacttgacaccaagtgacatactcaatattttgcttcatttgtagattatctgtttcccacagaagaatgtaagtccataaggctttattcactgctgtgcttctagcacttagaacaatgacatctaatcacattcaatgatttgattttgaatggatgaaatgaatgaaatggaattacatgaaataaatgaaggaattttctgcccctctgtgtaagaaatttacaaaaaaagataactaattatttattagtaattatataattattccaattattacttttaatacaactgactgaaggtttagggtatcttattaggttaaaaaattcacagaggttttgtttactaccttcatttacatttttgatggaaatattacattatagaaccaagctcatgtcatgttgtatcataaaatatggatgaaattactaatttaatattacaattaaaaatgagtaaagtgacttaatataaaagagaaagggccttaaatgttctgtttaacaatttgataatttttttattttttttgaaaaaaaaaggagaaaagagattagtatattatttcctggagactaaatagaatttgggtaagtaaaatcatgtttatgagcagtatctttaaaactgtaactttcccctagaaattcagtggcattttattgtggcatgtattagaagtagatggaattaatggtagattacatttgggtcatgaaatgtataataaatgaatgcaagtcctttatttatcagcagcctgacaggtgggtaaagggtagaaatcgggttattcatccaggaccgttagttaactaaactagtcggaaacagcaaggctttcaaataaagcaaattggtcatcccaagggcagttcaaagagtcagaacctcacagatttacagattatcacagccagaagtagctttatataactagagtccttgtcctagagttcagttgaaataattggtactatggttcatgaattaatgagaacccctttttttgtgggggtggctgacttcagatgtgacaatgcaaattgagagtgttagtaagcagtgtttggcaaattggtgaatgaggcatcagagatccattttatatgaagacagagaagcttcttaaaaaaactcattctaaagaaagaatctgggcaccataaatctgaaccagccataaaagggaatgagatcatgtcctttgcaggcacatggatgaaactggaagccatcatcctcagcaaactaacacaggaagagaaaaccgaataccacatgttctcactcataagtgggagtggaacattgagaacacatggacacagggaggggaacaacacacaacagggcctgttgcgggatggggggtctgtggagggaacttagaggatgggtcgataagtgcagcagaccaccatggcatacgcatacccatgtaacatacctgcatgttctgcacatgtatctcgtttttttggtttttgtagaagaaatagagaaaaaaaaatctgaaccaccaaatcagccataggataaagaaggatacagtgattttgaggagagtgtggtgcctgttactggacatcccctccaaccaccttctcgtatgtctgagcctccaggacagagaaaatgtaagacttgtttcactaacatttataaaacataacccttatgttttatatgaattcttggaatctttacagcaaagaataacactaaagggaaggggattattttttgctagtctacactgactcacataaacttatatatatacacacacatatatatgatgttttaatgtatttcggcaatggcacatggttgagattagtaaaccttttctgcctctaaaaccttggagatacttggtttctacgctccccaagccagcttcttccactttatcttcaatgttgtgaattttctttttggcttaagttagtttctgtagcttataataaaatatctggatacatcaaatgcggccagaagtggggtgcaaatatagaccatcagggcgatgagaagtatttgaaattaataatgttgcctagacagagctaaaatcggtggctcacgcctgtaatcttagcactttgggaggctgaggcaggcgaacaacctgaggttaggagtttgagaccagtctggccaacatggtgaaaccccacctctactaaaaatacaaaaattagccgcgcatggtggtaagtgccataatctcagctatttgggaggctgaggcaggagaatcgcttgaacctgggaagtggaggttgcagtgagcacgccactgcactccagcctgggtgacagagcaagacttcatctcaaaaataaataaataaataaaatgaaagcagcaaaattccatttgtatccttgtaatggaaccaagaaactcacagtaccagatgaagtggcgaaacagctaattaaagtgcttgcctgaagttgcttagaaccaattgcctactgagagcaagattctggagaaccagttaacaattgctattaaacactataaaggacataagaaatttcttgtttattgtttttgaagcacttatccttttcatttgttaaaatcattactattggcctttccccccctggaatataaattccactagggcagcgacttagtccatttttttcactactctactcgcactctccagagttcctggtagatggaaattattgaagaatacaggtgtaagggataaattaactccaggacaatggaataatatgcttgctactggcaatgtgtgattattaagctattgtctcagctttaaactggcctatatatacttggatctgggactatgcaaatcacatttctattttttgcagcaaatgactattaggctcttccagtagtgggtaatataagggacaggaaagctggagaagggaaaagaaccatttctcctgtttgttttctactcctatcaccatcacacaatagtggttcttcaccatggcactggcaatatttctagtagcagcagtttgttatagtttgcaaattttctataccgcataacctttccagcatgttctttcagagataccagcaccagttgaagagggtcacttcctcagaggtcctagtccagcatcttggaagggtgagggagaaggaggaaatttcacttcatactttgtgtaattccagtgtgcatggatcttagttacaaaagcaaaactacaggtctgatgaacagagagctgatttaagccaacacaacagagaattggctttgtgtgctattcccaggcaggaaccagttcacaaaccccaagcttcataaataaaggactaaattaaggagcttcttacatagtttggggcttgactccctggggttatcagctagttgcctttctcctcactcacggaatggttcctttcttatttctctgttttggccttcactgggccttcttcttctctcctgccaacatctccaaacaaacccaatttctggagattcagataactcctactgtcaaccagccagcatggacttgatggtaaagaaaggaagcagatttttaaaatcttgatgtggtccaagcttcagggcatttaacttgcacagccctgaaagaaccccatcagtgtgtcactactgttttacaatttgtaaacgtaaagtatttctatcttctttttcccaaaggaggccttttatattgtataagcttctgccttcataaaacctgggtctgcctttaaaaaggtagtaaatgagattttaaagcaagtccgtttatcagtagatacaacggaagaatgaaaattattttcagagtttctatctgttgccaaaagtctctgttagcctaagacagtggcttatacttattgtcccagtgtgctcttagagtttgttctaaatttttcagttttcaaataaagtatggagcatatttaaaattggctttggaattatttgggaagattttggtagatctgccatggtctcttctagtagggtaggaaacacattatgcagaaaattgagttgttactgtagtgcatggggaagtctgccagatgaccagaaataacttgcatttctttctccagcacttttcagagatgatacatctaacaccttcctttcaaggacagcataaaggcattcactgataagacaagtctccttgagcatgagaggcgaggacacctaactctttcaagcctccagggagagtggaagaaaccggcaatgatgttgccactaccaggcacttggtggactggtcaatatgccatgcctcctgctggagcctacaagatgcacaaaaccaccaagctgtatgtagttggtgaagtcagagtaacaacaagcaaaacttttttgttatgaatatgctgtttaacacaaatgaaattgagagtttcagtcatactatagcatatcacatttggcaaactagcaagaaaataataaatcaaaaggcatgaatcataatagtaataacattgatgagttttatcttgtaaaatattaatttacaaaggtaccttgaataggagtgaaaatatagtacctttgaaaatgttaagacagaaatatttacactttcaattgggaaagtcatccacaaaaaatcattgccaaaactttaattattctacttataatatttattctacttatatttaaaatttaatgaatacaaatttttgatactatatgcagatattttatttataatttttacaaagcattatatttttgaaaatgaatttgtcagtcaagtcaatattcaaaaaattaagtaatttaaatttttggtgcccctttctcttttagtttgtgttttgattatatgattgggtataaccagacctcttcaagcaacaggaagaagtatctcagtagacttttgtcctgtacagtaagttcttctggtaggaagggtcaattctggaccctataaacctttctcccaatcaaaattttaaatcaaaaagtgctgtattttttgtcaagttgcaggaatctgtcactgttaaggcttgaaagacacaggactgttgattcctagcatatcccaatttcactctagttggtccagagcagcagaagagtaggtcttggagaacagcagaagattattttaagcttgcccaagtgtagtgatcgcaattgcatctcatgtttcagatgtgctccaacagctggagtaaatcattatagcctctggcatgtggaaggctactgctagcctagggaatcttttctttccagggttaaatttaaagatgtcgccatacctccaaagtaatctgttgcactttatgccacaacatttatcacctatttcactgtgctctgatataatctttgttaaacagagcaattgtaaatactcacatgtattgtgaaccaaaaaatatcaatcaggaagatattatcttaatacacctgtaacatcagatgcatctatgatttatttgtcaaccatccaccctagtatcttctcatagtactaatttgaatccttgagtatttaacatatttaatatgttttatgatacttttagttaggttgattttctagattttaagtcatcaagttctgctctggataaaattacctattgttattctaactgctatatcttccaattttctgtctccctatttatttttatattatttcagtgagacagaatgtgtgacaagcatttgtttcatgcttttaattagcttcaatacaaaagtaggaacagctgactcagatattatcttgtgagtctgatttatgctttcaggaaatcatagtgtgctaagatgaagacttgtgtcccaaatcaacaggaattatagtagtatttgtcttttcaagaggcatcattcaaccaaggaaaacggaaggcaagcttccaaagcattcgtggctgccagtaacccgaagtgcacttcagaggggtagttcctgctgagtatttgctgataaatttggaactgatatactgcatgtatcaattcaagtttagctgcttcagagataagaatactttaaaataatactattcagaaaagaagaaagatcaaaagagactggaaggatgaggggcataagggagtaaaaggagagaaattctaaaagagtagaacagattattttttctccatcaagactctcctaatttttcatttcaccatttcatagcattgccaaaatcacagtctttagacaatatgagaattgatggttatcagtgtaacaagaagccataaaaattgaattttttccctagcctgtgtttggataaagtagaatgctattaataaaagatactgattgtctcatgaaatttttaacattcattaaatactagcaatgttctaggttaggagtggcaaatatttagcaacaacaaaaaaagagtcactcctttaaccagtgtttttggatattactaatggatcatggcaatatgccttattgaatccagatgtgacctcaaatttttttaaacatcactctgagaagactactaattggtcataggtataaacaatataatgcttatttaccctttctcttctaggtgaaaaattgcatgcagattaaaagtgtctcctttatatctaagctcttgtcctcctactatctacaataagtctgtcgttagttcataacgagaataataatgatacatatgaaaaggaaagagaactttcacaaagctcatttgagcactcttataatgttaatttccattttttagaaatcaagccagttcatggcaagtaatcctactttgccacagtgcattgcccctatattacaggaaactaaccatttctatttcttagttcccattcatttaaaaaatgcttttcatgctttgagcttcctatagcaatcacaaagaaaccagattaactcaaatcataattttatatttatgaatctgtctccagaaatttcttctactgaagaagtctacctttgccatggtatctgttgtttctggcttttctcagaagattgagatctgcaaaattgcaaagcattttattcattccctttgtatttaataaatttcagccttagaaaaaccagagattttagtgactgaaaatgctcaggagagatgacgaagaacaacaacatagtcttctccttctaggcaagtacatgccagtaaatggaaataaaatattatataaaatatgatacgtattgaacacattatgcacataatacatacaaacatgcctgagttattcaaagaagctaatgcttctaattttatgttgactggagaacgtttaataaattacaggccattaggagatgttgaaatgaaatcttctagaaacctaatagctatcatcaggaacaaaattcagaaatattaaattatttctttcacttccagtatttctgccataggttattctgtgctaagttggtttgttgtggggaaacaatcttatctacccagaggccttacagtagatatgtaatcatgtctgagagatttttctgactaatagaaagttttataatttaaaaatcacttatggttttattataaataatgtgataatttaattcttttaataaataatctgcaaaagaaaaatcaattttgtttatatatctttaggaacacttgatccctaagtcaggcagataatttctttgttatttagagatgttcagatagttggaattttgcagatgtaaaccatcctgaagaatgtaagatggtagtgatataaaatctgattgcaaaatgtaattagaaacaaacttttagcatatatcttgcttttaaggtcttttaatttgaatattagcagtatttattgattcatttataatactctaattataaagtattttcttttccccacaaaacaataaaaatatgggattacttccccctgggaagcctggtcaacattgaaatgtacctttactcacccctgaaaaatagttgcacttaactgacacatgtcatctaatgcatttttattatcctgtggcttattaggtcattcaaatatttgaagtctatagatgttttagatgaaacttaattatttctcaacatgaagtgttataacaacactatcttgtttttgttcttctatccttctaccctttgtttctctttccattgtccttttccttctccctctcaattaatggctaaaaagcaggtacagtaactaccattatggaatgcttaacatgtaacaaccactgaacttttatatgttttctcatttaatattctcaataatctcatgttaaagacatgagaatttactcatttatgccaaatttcatgaagttattgagacaggatttttaaaaagccctttctacttcaggaaaggagttggtctgggaccatgtgataactggcttccagttgtatatagctgtttactgacttcaagacaagctcataatgcaggcaaacttatatttaagaatgcttatgttccaaaagtttattggttaagccattagtttgttttattgattgattgattgtgacaggatctccctctattgcccaggctgaagtacagtggcatgatctcagctcggtgtaacctcaacctccttagctcaagcaatccccccatctcagcctctcaagtaactgggactacagacacataccaccacacccaactaatttttgtattttttgtagagatggggtctccccatgttgcctcagctggtctcaaaatcctggcctcaagcagcctcccaaagtgctgggattatagtcataagccaccacggtcagccaaagccattagtttagaacttggaaaataagataaggctatgcacaccatgccaaaaataaataaataatcataataaattacatttacaatatcacagaagaacagcattagcagtatccttactgggcatctcaatggcatttcattccattcacttaaatagcatatctctgtaattacatagctattcttcttcggtggaaaagtgctttgtgaatttctgttcatttttccttttcttaactttaggcccagaataaatatgttgatgccattgaataagaagtatatacattaatacaaaataatgtttgaggccgggtgcagtggctcatgtctgtaatcccagcactttgggaggccaaggagggtggatcatctgaggtcaggagttcgagaccagcctggccaaccatggccaacatgacgaaaccccgtgtctactaaaaatacaaaaattagctgggcctggtggcaggtgcctgtaatcccagctactcgggaggctgaggcaagagaattgcttgaacctgggaggcagaggttgcagtgagctgagatcgtgctactggactccagccttggagacagaaggagactccatctcaaaaataataataaaaataataaataataataataataatgtttgagatatttgagcatggcaaatgtggtagaaacctagtctttacattttatgatcatggaggttgatcttgtttattgctctatttcccctactctttttccgaagctcgaaatcttcttggtcactgctgcatactaagaacactgctctttgtctgcactcccacaatgcattcttgctttctttcctccttcccaaaacactcaaaaacaactgctcccttgtagtgtatgtattgcttctaagccaaatttagtagaattttataaatgccaacaaagcatgggagtgctggcaatcttaacaggaggaccatgtgcttcattttgtacaattagtcttttagaactttatacatataaattattttttcttttgcaatattgcatgaaatacattggtgacaaatagttcatttgaaatcagaaaacatgtattagattttcattatctcagttttacagcttggctgagtgactttatttgttatcgtcatctataacttggggagataatatgcattttccaaaattttgataatgattaactgagaatatgtttaaggcatataaatattgtaggtgtcccaaaaagtcagtcaataaatgagagctccatttccactttcccacttaacatcctttcctggtagactattttttaaatccttctatcttcctagccacttatatataactacatataatacttctgcagcaaccaaaattagtcaggagcctaaatgtataatcttttatagaaggttttgtatatgtatgtttggttcataggcatattgatcaatatagtgtatgggggggtgaatggagttagaggttttttttaatggaaagtcagatatccagatatcaagttgtttcttatgaataataaaataatagcttgaactatgcaccaggatatgaatgtgctatccttggctgaggaagggcttgatgccatttgtcaaatttcccccctccaccaactaccactttttttgttgatttgtctattatcctttgttgaagttgtctttctttagaaatatttttaaaagaattaccttttaatcttcctcctctcaactccaaacctctttttctcctcctttgctctcttatttcctgatgccaatgttccagaacagcacctggaaaaaattacctttatagcctgaagtcccctaatatgtaacataaaatcaatgacttctcacattcttgggtaacaaatggattagcaaattattcctgttcaccattgcacggaaaacagtcatacttttttgtgaaatctttgtgaaattttccccaaagataaattttactggttgcaacaaataaaacatgcaatgcttgcaaagttccatggaaatgctctctgactaaaatttaaaaaaaaaacaaaattagtaaagcctgtagaagggaatcatttctgattttagcaaatatttaaaattatactgtcaggtcaccgaagccaaaaacttgaaatcagttgcaactgctctctttctcttaccctagaagtatagttgatagatcctgttgttactttcaaatttaccaattctacaaacgtttattgtgtcaaatattgccctaagcactgggcaaatagccatgaataaattgacaaaaatagttgccaggatagagtttaaattctagtacatgtgtctatggtgggggagggggtgaaagaatggaacaatcaaataaataagtaaaatctacagcatgtcagaaggtgataaatgctttgaggaaaaatgaatcttgaagaaagtgtttagggacagccagaaagaatggggagtatctcactgcttcaagagccagatggggattagaatccagggatgaaaaatgacctgggagtctctgggcttcttgtgatgaatgatgtaaatggggataaaggaaataatgagattttttactcacacgtgaatggagaggatttcttgccaggagcaagagaaagtctgaggcatcttaataattcttgccaatagtgatgtggaggccggggaagggcatttaaggagggtgtgcagaattcctagaccttttctagattcttgccattgaagttactttctggaaactttcccttcctcatcatccttccttggccctgttctaattcaggctcacaacagctgtgccaggatttcagttttgcttcctggagtccattttttgacacaatcagtgaaaactaccgaaaacacaaatttggccatgttattccccttctccaagcctttcgtggtcaaaatcatgaacacagaatctgtctcctttctttcacctcatctccagtagtgcctgtctcgtattttatgtttaaataacacaaatctgtttttagtccttgtcccagaacactctgagtaagtcttacgggcttctctctggccactcccttgatgtgaaatgatctttctgttttcctaacctgactagacctttctcatctttcaaggcagcttcagtgtcctcacctccaatgtgcatttcactaagccacattaactcagtgctacttctcagtgctaccattttactctgggcacacattttgcatggtatttaaagtctcatagactgttagctccacaagggccatgtattattcatctagcacttctagagcatagcaaggtgtctcttaaacaaaccaataagaaatctgtaggctacagtgaaaccctgtttgctaatgctgatttctaacctagaatgcactgagaaattattttgaattgtatatattcactgttttattttctccagttctcttttagtccatcagtgccatcagccctctgcattggttcaaagagaagcagaattgttacaagggaatgagagggggaaaaaggaaggattcgtgtttgttttgttaacttccaagttgcattttgaaggatcaaacaaaatgtacatgaaaaattaagcacagagttggggccataattatagaatagaaaaatgatttgaggggaaataagtgccccttttcctgtcatttaaaagaatgtcaacctgggtcatggtcagagatggtgcttatcttcggggagaatgggagacagagaagagagtcctgatatgtggtgactcaatatgcaggattggggtcagcctcagggaactgccaagtatgttaagaaatgagcacaaaagagccagtgctgcagaccacccttaggatctgaaggagacacaatcccatggaggaaggctgattctagaggagatttcagagtttatcctgttaagaggcaaggaaacttttttttttcatcttgctctgtctcccaggctggagtgcagtggcatgatctcagctcactgcaacctctgcctcctgggttcaagcaatcctgcctcagcctcctgagtagctgggatgacaggtgtcctccaccacaccaggctaattttcttatttttagtagagacaaggtttcaccatattggtcaggctgatctcaaacttctgacctcaggtaatccacccacatcggcctcccaaagtgctgggattgcaggcatgagccactgcactgggccgaaactgaccttttttgttcccacatgagtcagttaatgggtgtgatggtgggtggatataaactcttaagtatttctggctctctaattccagagacaaagtggctttagtagcccaagagtagttcccccacaggatactgggtgctggccccaagcagaagcacatagatacctgaggaggtatacacagaggagcggaagggatctgagagaatctgggcaaatccctaatagtgtctatggctacacagtggctgtgccatacaccgccatggactgtgtataccacacatctctaggatctcagtttaaagcaatcgttttaaaataagcaagtggtatgagacatcgttagcctccagagagctcaagacctttgtcagaccctgaaacacagcatttagtcctgtggactcttgagtagcattaagtagaaaagaagggatgctgaaagagaaaaaagaaaagggccttaattgaatacctacaatgtgccaaaactacactaaacaatttattttatatccttaatatcatttaatatttataacaattctacaacgtgagatcatcattcccactttgaagaagagaatgaccaagtcttagggaggtaagtacattgcccaatattatataaccagggatgaaacacaaatctttgccatcctaggctccatgttctttccatcacactactgctagcctccaaaaggaggagaaagaaaatgaaaagggtattgagggagataaaaagtgaactaagcttccttcacaattttgcctatgcccagctttttctgttataatacaaattatttttttctgcaaaatcatacattaattccctcagttaattactgaatgtctgctatatcctagctatgtcctgaatccaatcacttctaggtcatgggaattgaataataaatagaactgcaaagttctaccttcacaaaatttctattttctagtagagggagtatgggatttattattcacaaataatgaataggtaaataagtaaaatagacattatgttagctattgataaataaatggccagaggagacctgactggtatcaggttatttgtgtaaaattgagaaatattttcagagagagggcaaatttccagaagcaataacatgttttgtatggctgagaattgctaagcaaagtgaagatgtgggaagggaggatttgtaacagttgagttcaaaaaaataattgtgacatggttgcagtgggtggagataaagaagttgaataaatagcatctcttaagccatagtcaagttattggtttttactctcagaggggaaaacattccttttttaaaaagcaaaggcgtggcatgagctgacttatgattttaaaagaatgtttcttgatgctttattgagactctgatacatgacagagatggaagcatgaattaattcagttagaaagctaaagcaatgctccaggcatgaaacaacagaagtttataccagaatgaaattcacagaagtaaagaggaattataaacttctaaatatttgttttgaatatagagataacaggattttcagaagtggaatgtaagagaaagagaggaggcaaggatgatcccaagatcactgagcttcattaacttaaagaatgaggttgtcatttaatgagataaactctaagaaaagagaattattatgcggaaggggaggcaaagggaaagtaactttcttgctaattattgtggcatggctttacatttctttagaaaaagaaatccttgatgagtacaaaataaataggtgaaacacctttgtgttcttttttctccccttccctcccttctttccttccttccctcctctttccttccttcctctccctctctctctccttctttgcttcttttctcactttctccctcctccctctctccctccatctccatacaacttttctccgttttcagacatcactgtggccatcaatgtgaaagagaggctgaggatagcattgggtataatgtcactattgggaaaataccctggaagtctcccctcaaaatcaaaagcaagatgagaagagacattgttgggaagcttttattcttttttttttttttttttttttttttttttttgtaactcagtccattttcttgctctggctaaagagatactaaaagttttcaaagactacagtctttctacacctgttttcttacacacctcctgatttgtctaaaatattaagttacccgaatgatacagccaattagtgggagctatttccagaaagaaacaaaagggtcgcaaattccgttcttctgaatctcttctaattattaacaataaacattagtgcattctattattagtatgaaaataataactaaatgttatttttccaatatgcattttaattttttgatcttttgaatcttttttggaaactgttaatttgctatgctatattactacacttacactgctccctaaatttaaaaatgtaaaaagaaaataaaaatagctaaaaataatgggtctcatggaaacacataagagtagaatcttttgaaatctttttataaaatgtgagatgcaaaatataaatcttgtttgggcttctttggctatccaaggtcagaagcaatgttggcactcttccaagctgcccacccctagcctttgagccctttgggtatccagtagatcaggacttatgactcctaatgagtaatgcagtggtagtcaagctgttgcagataggatgggaatagcaaaaaccacgcctctctaattacaggcattagccctctggcattggaatgccttctaacattttaggttgggggtagctagctgaaaaatcacaggaaaaatacaaatctgcaggagctgccaaagttgtcccagattctagcttccagacagtctcttccctattctgatgctggtattgacagtctgcctacctcctgtggatgtcaaagccaaggttaaggccaacggaagtgaacaagctgtcagcctagcataagaaaacaggtaagcacattgtgaagatgatagggaagactccataattagcagaaatgttgggcaggagctataggtcacgacattagtggaaatctatgagatcactccctccttaatgctcccacaggaaagcagaaaaatcagtacttgatgaaacgtcagcattttatggaccaacttcctctcacctatacctttcaaatgtctttctttttttaggctttacaacctttttatttttaagataggctctttaatgaatgcactttatgaacaatgaatctattggctagttaggaactaggcaatatatgatttaagtaaatgtagctaactgtgttaaactataataaactaattggagaagaaaattaacaactgactgccagttatatctcataaaggctgaatgactgaaatatagcaataaatttgctaagtgggtttcaattctgaaatacaattaaaatgtgaaaggataaagccacaatttaaaataatgagctaagattataagtggattaaattgtgtatgcagataccatagactttacataacaataatagtaactaataattattaaactcttcttatgtactaggcacctacactaaacacttttatataaattattcattttagtcacaaagcaggcatttccattaggtgagtatatataactgcttagagaagtaagtggtgaatgtaggcctcaaaattagatttttgtctgactgggtagtcactactcttaatgacagttttcttaatttcttcacaactgactctgaaaagagtcaaactattgaagaaacatgaagtgaagtgatggtttgagtaaaaacagtgataaactgaggagaagtatttgggtaagtccctcttcagtttgtaatttgtattctaattgaattatgtttaaagctcctttccacaaatttctcacagttagttaggaaagaggtgattgaaacaaattctaatgcatgaggaagaagatattttccctatcaatactacagacacacacacacacacacacacacacacacgcacacacacactacaatagcaaatgggtactagcacatatcttctttacacgatgaaaaagcaggctcattctcaaatgaaaataataaaggctcatttctgctggatcagaactgaaagcatactagtaatgtcagagtcacctaggtaataaatatagatgaaccaactctgaaactattttaaatacgttgtagactgctcatgtgttaatggctgttgggagtcagggttctcactgtggaagaaaacacacacatatgaaatagagaaaagcaagagaaaaaacttcagggatggattggaattgtagggttctgtgcaaactcctgatttctaaaatatgtgtggctatgtatatacatgtatatgtgcacatggaaatgtatgtttgtgtatgtatactgtatacacttatgggtgggtgtgtgtgtggtagagatgggggtgtgtattttttcctacctctggctgctgcaagggcctagaggtaatgttgccagagtaaaaataagcatacacagtaaccagattatatctttaatattactttaatttttattatttaatattattttcattttattatattttataatattattaaaagaatcctggcttcctcagagacatggctaattccagggctggggtaggagggacagaggtagaagaagggcttgacagagtgtaaggaaatgctcaaaaaaattatataggcccatcacaggagcaccagaaccagcttgaatgggctcccactgaaaacatctgggtgtctttgagcatcaaaatgattaagaattgtaataaattatatgtttatttgaaaaaaagatatataatagtgagaatcaggaagaaggcctcttccctacactgaaatgttgagcatgaactagtgggatattagtttgcaatcattgtagtaaagactgataaaggtaagaatcatcaccggggtaaaatttgagaagaagatatgtggctatccaattaagtagggatattttaatactctcttgggtttttcatttcttttttgtttgtatgtttgtttgtttgtttttttacacctcatggttctgtcagtctcaaaatctgtgtgtattcattaagaatggatttctggagggtagggatgaaagttaaaatcttgtagttgcccatgtatttgaatagctttagcatcctgtttagaaatatggaacattttgttattaaatgataataatactggaaaatgaccatgtaaattggatattcaaggaaataatttttaaaaataatttgttttggattttctattttaaaagaaagtaaaattttcaatttgtttattttgtatgtaacaagaaatgagtttatgagttcaaatatgagcttatttgaacaatgaatggagcaaatatttatttttctttgttaataaatgaagaaatgatttttccaacacaattttatgatacatcaaatgtctaggctttatatcgcatttgactttcatatctaaattacctctcaaaaatcacacttttatgcataataaagatcagtgtttttttaaatcagatattttgcttctttggtgatcaaaatgtcctcttttgaggtcccaactgtgttctcatacaattttggccaaaaatttatcttagtaaacacacatacacacacacatttcatttttttttcccctaagaattagtgttttgttgtatatgtgtgcctgttctaactacattatacccttgctgggtaataaattggcactggatttcaccagttgtctggcattatactattgattccatgaaatcttgatgttgtcaatttcacattgtaatcaattcagtctgcactgcattgtcctattaaaagcattcaacattttgcaaaacactgactgtgtaaccactagagagaagggaaatgtgaattcagactaattttataaacggtcaattcactaacaaatgatgttgtcttgtgattacttttctttccaatttacattgtaaccatgtagacattgaaaatgaatattgagaaataagaagcctccatatgacttctggtatgcactagtattgctagctatttgcctaaggattttgattcttttccaggatgcttttatccagcaattctagcatagctgatgtaacactctgctgtgctagatcaaatccgggatgaagaccagtaacctagttaatttgaatggacatttagttgaaatggccatggcaagctagggaagttccagccacaggaaagagaatagaataaagggcccctataaattaaggacagatttataccaaattgccagcttaaatatcaatacattccatcttcaaaagaaaacagtcatttctagtttccagcccagcatgtaagaaacttggaaaatgccactctatcctaacaagcaaatagctgaaccaactgaaaaaagtcaacaactgtttttagatccactagagaagtaaggtcacagagaaaactgctacccccacaattgaagagaaagaaaagcaaatacagagaatcacaacatatcaaaaaagaaatccatgagcagaaacactgtgggaaccagtgcacaggtcagaaaccctaaactgtaattgatgaattgctggaggttcagtgtgaacaaatcagcaagttaaaaactccaagggggctcactcatgggcagtgtccacactattgaaacttttctctctaggagctctaccaggttgtcatggtgaattttatagaaaatccattcgtgcttctggcagggggaagaaaaaggaatcattttgacatatgccagagcattaaaaagccctgtccttaagagaaattattttaccatagtccaacctgctggtttatatcagagcctaatctacatgggggaagaaaactatccaactcagctggctctagccttccaagtgaaaaaaaaaaaaaaaaaaaaaggaaatacttaactccagctccttctagctgtcctctcccagtggggtgggagggtaggggaaggaatactgagaaacataaccaagggcacaaagtcaccaaaagactgaatcctaattacaggactaaagaagttttcccatctcccaacatcttaccattataatattaaagtttatttactgcagttctttttacccaacatataatatccaccctccaagaaaaaaatcacaaggcacactaaaaggcaaaaatcatcatttgaaaagactaaaatagtacctggaccagaggcagatatggcaggaatgttggaattgtcagacaagaatattttttaaatgacgatcgatactgccctggactttaatgaaaaatgcaagaacagatggataatacaagcagagagatgggagtctaacaaagaactaagtgaaatactagaatcaaaacattgtaatagaaatgaaggaggccatttgtgaacttattagtagactggacatcactgaggaaagaatctctgaagttgaggatatctcagtagaaacctacaaagctaaaaagcaaagagagaaaaaaaaaactattcaagaactgtaggacaactacaaaaggtataacatatgcatatggcaataccagaagtacaagaaagagaaagaaacaaaagcaatatctgaagcaataatgactgagattttcccctaaataatcaaactacatcaaactacaaatccaggagaaccaaagaaaaccaaacagataaatgccaaaagtactacatctaggcataacatattcaaatttcaaaacatcaaaagattaaaaaaaatctagacaaaaatatagaagaagaaaagaaaaccttaactagcaaggagcagagataaaaataacatctgatttctccttataaaccatgcaaggaagaaaatagtgcagtaaaatatttagtgttcagagaaaaaaacagatgaaacaaacaccaacttagaattctttaccctgtgaaattacacttgaaaagtgaaagaaaataaatattttttctcagacaaacaaaaattgaaggaaatttgttgtcattagatttacactccaatacatgtgaaaagaagctgtgcaatacatgtgaaaagagagttggaaataatatatgttagaatcttgaatctatgtaaggaaaggaagagcattggagaaagaataagtgaaggtaaaacaaagtttaaagtttcttattcctcggtttgttcaaaataattacagcaacaatgtatttgattgtgtatgcttattttatgtatatatgtacttatatgtatatatgtgtgcttgttacgtatgcattatattatatatatatatatatatatatatatatatatatgcttatataaaagtaaatgaatgacatcaaaaatacaagggatgggagggaggaatatagggcaatctcccctatccataaggcatacattccaaaatccccagtggatgcctaaatccacatggctagcaccaaatcctatagatagtatgcttttttttcctatacatgcatgcctatgataaagttttatttagaaattaggcacaataagaggttaatgataataactaataatagaacaattatagcaatgttccagcatcttgactcttgtacgttggggtcattattaggtaaagtaagagttacttgaacataagcactatgatgctgcaacagtccatataatcacctagatggttactaagtgacaaaggggtcagtagcatatacagcatggatacgctggacaaagaggtgattcatgtcccgggggatggagcgggacagcacaagatttcatcacgattcatagtggcctgcaatttaaaacataaattctttatttctggaaatttctacttaatattttcaaactgtgatttaccacagatatctaaaaccgcagaaagtgaaactgcaaataaaagggactactatatttaaaatatattgttattataaggtacttgcagtagccacaaaatagtatagtgttatttgaaagacgactaggaataatagtaaatgtatattgcaaacttgagggcaaccactggaaaaagtaaaagaaaaaaagtgtaactgatgtactaagaaagaagaaaaaaattaatttcttataaacgctcaattaaagtcacaaaggcagaaaaagtatgaaataagaaaaatggaacaaagaatagggaaagaaacataaaactaataaatatggtagacaataatacagctatttccctaatcacattaagtaataaagcattgaaactattctgaatatggtggattcatgtcattataaatttgtcaaaactcaaagaatattcaactccaagagtggaccccaatataaactatgaacattgggtgatcatgatatgtcaatgtaggttcatcaattttaataaatgtacctatattgtactggaggttgtacatgtgtagtaacagggtgtatacagaaactccctgtaccttctgctccattgttctgtaaacttaaaactgctctaaaataaagcttgtttatctgaaaaagaaaatgccatgggcaggttaatgtattctattaagttttatttatagattattttaatcaaagaatatttggtaaatatttcccattcaccaaatattgtgatcaacaaattaagggtcataaagagagagtgtaaaaatgaaaaagagagtacgaaagaagaaacattgtttacctgcattgtccaatctacatttataaaacacttatgaaactttgatttcactgagcaaatatttgatatccagtgacaaaaactttgttcttaacatacggttacaataaatgcgttcaagtgaaaaaacaatttggattgttttaacatgtctcaaataagtcatccattcactgaaattgatgtttcatttaatactgtttaacagttaagaagagagccaactggttaacatgcagcagacaaaattgttcccttggagaggaaaacattgacttacaccactccagtgtgaattgaggacaaactgtaaattgcacaaagtcaggatgagctgaatatgcacgtgattataaaaacaaacttcaatttgtagacatctgtcttgcaaatacgacataaggagccatttactcaaaacttcacacagcctaatgcactgcattcttttagcagctagaaaataatggcccaacaatcaactcccacaagtcacatgaagagtttagtggtttcaaagcaagtaaatacaattatgtcttacaaagagccaccacagccactaggaaatgttttgattcagagttttgaggcctatttatcagaaaagaaaaactgtattttgtttatttatttatttatttatttatttattttttttttgagacggagtctcactctgtcacccaggttggagtgcagtggtgcgatctcggctcactgcaaccttccacctcctgggttcaggcgattctcctgcctcagcctcctgagtagctgtgattacaggtgcacgccaccatacctggctaatttttgtatttttagtagagatggggtttcaccatgttggtcaggctggtgtcaagctcctgacctcatcatccacccacctcagcctcccaaagtgctgggattacaaacgtgagctgctgtgcccagccaaaactgtatcattttatctgcaattacaatcttcagatatttgtagaatctacaaattaaaaattattcttatattgccagtgcttcttttccattttcagtggaatgtttcttggtgttcattatagcatttctatttgggttgcatatcagatctgtactcaattattttttgtaagtgtctagatagtttcatgagattgtcagttggattccttatgtaagacatacttaatatcattaattattcatttgtgaactgtcctgtgctcagcattattatagggctagatgacatcaaagagaatacatttttttccaccttggagtccattttgtgatgttgttgcagaatacctgagactggaaatataatgaacaaaaatttattggctcaaggtgttgaaggctggacagtccaaaatctggggatcagagtctgttgagtgccttcctgctgtattatcccttggcagaaggcaaaaggccaagagagagcaagagagggctgaacttgtcctttatttaacagcacccatctcatccatgaggggattaccctcatgacctaattacttcctaagagttccatttcttaatactgttataatggccattaaatttcaacatgagttttggaagggacaaatattcaaactatagcagaggatcacaatctagtgtggagatagataaaataaaatcagtttattaattatgaacaaaggagaatgttcctttcagaaatactgtagaaaaaagtaatcaaatcacatctgtaaaaaaatttacttgtaaacagacagtattgagattctctgaacttgatttatctcattattgaccagaccttggtcatccttgcagctccagctacatttttttttctgagattagtatcagttttcaaacttccttcacataaattgggaggcgaaaacaggcggaattaggcagttattagtatagtatgtcaaatgttcttcctcttccttcttttgtctttctcacttttgacaatgaagaaattgtgatgaattaagaactatgaagccaattgctacaataagactatcaccagcagccttcctggcaaatgtctctggctcagagtgagagcaatgttctaaaatatctgtccccacccactgctgggcacagagtttggtgtctgctgcctagggtttctgtttgagctgaagattttactggttttccactgaactgaaaaagagtctaaaagtaataatggataacatgtactgagcacttagacattgaccttaggaacaaatgagcccccaagcatcctcatctcagatttgagaaatagcttaagactagtcaactcctatttaaaaagtagctcagataacctaacctctacccattttattggatccataactgactcataagtctattatctaattatatattgcttagacatattaaaataaattcgatttttcatggcgaaattcaccatgtctcatttgaaaagagaaacatcatgtgagtgaaaagcactctaagacttatgaattccaatgttagcccttcttttatgaactcaagagaactgtcaggtcacaaccttatctgtaatattaataatatgagatagctggccagctttcaggacgtttatgataatacatataaaaaggctttttttttttttttttgagatggtgtcttgctctgtcgcctaggctggagtgcaatggtgcaatctcggctcactgaaagctccgcctcctgggttcacgccattctcccgcctcagcctcccgagtagctgggactacaggcacctgccaccatgcccggctaattttttgtatttttagtagagacggggttccaccgtgttagccaggatggtcttgatctgacctcgtgatccgcccacctcggcctcccaaagtgctgggattacaggcgtgagccaccgcgcctggccgtaaaaaggctttttgaagattttatacacacacaagaataccatataaatttaaatatatataaatgaaaatagaaattgctttttattcagatgtctttatttagagtagaaattgtattttactaaatactgtgatgccatttctttgtgaggctttatttgcaaagccatgtctagtttcttaactgggagtaatttgtttctaaacacctgtattacttaagtgtattttaagttatactatactaatatatgcactggttaatacatgcttaggatcaaggatgtcttacccaactttgaatccctcttagaacattatgccttatcctaaattgaaactcagtaaatatgttgacatatttattgtttgaattcaacttttccatagagccaaggttaacatatgtgctaacatgacatctttaaatgaaaagttaatatatctgacacctagaatgtgtaaaaaatgtatttagaacttttaaaatattattattgtaattacaattacaacagttataataatcatctttttttagatggttcttactcaggtccatccatagtctctcaaccttggtacatacaatggtccagtctgtgctcctaaaataaagtctaattatcctaaatgagaattcaattaataacaactttcctattagctaaatagtatattttactaactatttatctatttgcaactaaatttacattaatatcatataattaataacatgtaaattattaattaattttatataatatcatgtaattaccaatatataattaacatataaatattaaatgactagtatattagttattacataaaggtgttattataacttattatttaacttagattaactgaaggaaagattctttttgataacgagtagaatgcaaattgtttattattcgataaaaattgtagacacaaaaattattaacattttctctaaaacatctagagggtacattatttaagatagcccaagtttctgaattgttctggatttcccatgaagcaatctcaaggtattaaaactgaccttgtatatgttctcatgatagaggtagagattctttttcattgctaaaatgattatacagaaaggaaaaaacattcctgaggtgttaagtggagtgtccaaaggtcagagtaagtcagtggacccctgacaactgagtcattttctggataatctgcatgatatggttgaccagtcctgccctcacacctgggaaagaggaatctttactctggaaccgaagactgagaagatcccacatattacaaatagcaatacacaaagatgttttgttgtatttggggtacataagaaaagttttgggctgggtgcagtggctcaggcctataatcctaacactttgggaggccaaaacgagagtactgtttgaggccaggagtttgagaccagcctgggtaacacagtgagacaccatgtctacaaaagtaaaactgtggtgatgcacacctgtcgttccagctactcaggaagctgaagcaggaggatctcttgggcctgggaggtggaggctgcactgagccaggatcatgccactgcacttcagcttgggtgactagagcgagaccctgtctcaacaacaacaacaacaacaagaaaaacaacaacaacaacaaagaaatagaaaagtttttggaggtttggtaataacttgggttatgaaaattacaggaaaaggacaattgatctgaacggagccactcataccagaggggaagtgtgtggaggctgtgtgtgtgtgtgtgtgtgtgtgtgtgtttatgtgtgtgtgtgtatgtgtttgttggagggtggtgagatgagaaaattacaatctttgtctgggaaaaccagagagtgttcaagcttcacggtcccaaatatctgaaagtgggtggcgtagctagacctgcctggaaattctgactcagaaaagtgatgtattgggggaggaaagttgctctctctggctcgttgggaagcctgacttgtcataggtccaggcaggatctgtcaccacccaggctctgccctgccttgttacctcaggtccttatttccagttaggctgctagacagctagacagctaggctggctgggaaaatcgtgcccccttcagcctctagatcccatattctatatctaaggaacagttttgggtgagagtggggaatctgcggggaactagtctaggctatgaaaatagtttgatttataatctttagatatttagaaacatgtttatgggtctcttgccctggaatctgcaaatgttggaagaaggcttgtagccttcctcactgcttcactgatccccatcatctccatctggaaagaaatctgtttcaatagtctcgcccatctcaagagaacacgttagtattgctaaatattggagaaaaaattaccaatcccccaagaaacttccaaaaaatatgattgctgagtaaaacgaccaccactaaaccaaacttaatctaacaaatatattttccttatgaagttgcatgggtattggcagattcctagaaattgatttactctttcctgtttttagatgagaaatttgaagtcaagaggactgagtgaattttccctgctgagctttttattcaatatccatatgatgtgccaagaaggaagggctaacaggatcattagaaatgatttaagaggatataaagtcacataaggatcctagtttagttacaacggtcatttaaaatggtgctggcatttgaaggagaaatgaataaaggagagaaagggagccatatgaatatagaaaagaagaatattaaatgcagaaagaactggaaaacagatccctgaggtagaagggaatatgtttgttatgttaagacagtgaacgaggggaaagagcagtgaaaaaggtgatcctagaggtagccaggacccaatcatatagggctctatgaacataatcagggctttaaattttatgcagagtgaaatgggcagaactgaaaggctgataccagggtaatgacatactctgatttacgagggtggaggatccccatggctgctgtgtggcagagactgaagaagacaagagtgtaatggggagacagttagaacacagcacattaaaggcaactagtgacccaaagttccttctgcacactttacttcctcctgtgagagttgacaagttctttgaaaaccacaaactttttattatctttaaatttgttatagctctttgatacttcctttaaatttacgattttatagggcagggtaagctattctttctttcacttctttcattccctttattcccagtggggatacaaattttttaagatgatataaaaaagcagtgctttattttatttatttatttctgtgtcacccaatctagagtgcagtggtgtgatctcagctcactgcagcctcaatttcccaggctcaagcaattctcccacctcagcctccttacagtagctgcgactacaaatgcacaccaccacatccggctagttttcattttctgttttttgtagagatgggatctcaccaaattgcccaggctggtcaacaattcctgggctcaatagatcctcctgccttggctcccaaagtgctgggattacaagcatgagcaaagtgccctgccaaaacattgttttctgttgtaatagttattattaatataaaatgcagcaaaattaacatattaaagtaagtaatatcaataataatttatcttctagaatagcctttgatagtacacctttctcagctaaacaaattaagcctgaaatatatgcaaatttatgtatgtatatttagtttattttatatactactatgtgtgtgtataaattacgcactatagagcattataaaaatatatattttaaataattttaaaaggcagaatataaacagaattgtgactattatattactgcactctgatagatcattccacgcacccctggagcatgtgcagtccactttggacacatcaccaaaattgtgcaggcttaattctgattacataaacattaatagtcagcttgtccattgcaactggagcgacctatttctatcattccagaaaagggtcatgctgcctgtgaatttggagattttgaggcccatctccaggacagagttcagaagaagacgaaaatcatggaaaagactgagtaggtgagactgtatgagagaaggaagggagacagaaaatactctgaggtccacccaagagagctctgtgcaaactgagaaatgatttaaagagaaaagtacagaaatgctctgctccacctcccaggttctgtatgtttctgactagtttattatgacattattttccctctgtattatactataactgtatacctttctagataatatggacataactcagatttttttcttctagctaacaacgtctccatatacttctaatagccatgtctacatctgtattcatctccatgtttatatctctaaatggagatatatgtgaatattatctgtctatctacctatatatctctatcatttatatacctctccatatatttgtggaatttttgttggaatacttcacctaacgtatagatgtatcaatatttatgcaacgtgttctacatatggtgtcttgagagaagggaggaaggacattcacctgctgaatacaaagcattaacttgtattgtcatctccaccttcatttctccactactgacttgaaaatgaacagaggcatggaatggatgtttaatttgaaaagtgacccaatggacttgagaaaaatagagtatttcacaatgccttcaataggtgaaataattgaaatttcccattattgcatgcacaaactaaatataattttgaataaccttaagattctgggtgaatcggttggaaagtgcacaattcactagagcaagtcaccatagtatcttgtatttattctgattctcaaagtaagtagattcttttccccttaatattagttgtcctcttcctttatgtaggcttttctctcctacactgttgattttcttcaactatctgatgattctccattatcagttcatgtttaagaacaaaaaaaagaccaggtcacctgctatggttagctggtgtgggaatcttctgcgattgacttttttttttttcctaacaaatctttcctttgaagggtagtactggctattgctctatacatatgagcagagtgttttcacaggccaactttgtcttaggtcacataacctaaagagcagcccttcccctgacctcttgtaccacaacaaccagagctttattttaccatgccaaggctcacagttggaacttcagcctttcctaacacattactaaaattttcacaaacagctctttctctttaacttggagcaaataaactctgtatcatgacagccatttgcttttaattataagggtgggtttgcaggagaaatcaatggggctgactagatgctcccactaattataagtccctaaataaaataccacaaatattccccaataatcctactgttggttcaagatggcagagtaccctcatttgtgaatagagtgcacctattttgaaattcaaggtcttttggggtgctcagctttatggtctgccaaactcttttgctgataggtgctcccttatttcacgtagttatattttaatgaaataaaaaaaaacaaaataagcaaacaaaatcagattatctgtggagatttttattgcctgaaaaatagtgtacattgcttccaaaaacctgagtaataaattgttatgtccataaggagattttaccatccaagctgctcagaatcaccctccttcaatcagccctacagtcaacaactatgtgagctttccgcaagctaacttccgtgctgatagattggccgcattccaatgtcccagggtgggagattctgccaaattatctcaggcaaagaatgctttgtaggtgacactgatgagacaactcgagaagccagctgtgatgtgggtggaaaatccatgcttcaccatcacgcagaaggttggactttgctggctctcagctgcccttaaatttggaatggagcataatggtgctcttcttttcttgccagatctcagaaggcataagggcattcttgattaggttttctacttactttcaagcagttatcacacatcctgctgcctggaaacagaataagtcagcagctagtccctgaaaacatatgattatcctggcaatgtttgacctgttaaaacataacttgtaccccaatagtttgcaaccttcacagtggttgtcgacactctagaccagcacccaaaaacttaattaatacataatctggttgaattagaagtaaaaggaacctgatccacagtcccaaatgtaagtaatgagttttgagatattcttctcagccacaaaggtagaagcaaacaacacaacagcaaaatgataagaaaagcattcagtgagttctctgccatcactcagctatttctttcaagtgtatcactgccctctcacattcatccttattatttcagttaggttaatttactttaaaaaaatttgatttgtattttccttacttaaaaaatttcaagaatttgtcgacagtttctgttttctcttcccaattctttgaaactcatatttgtttttctttcctcaggaataaagatttaatagaaacattcaaacagaagccatgtctgtgtctcaggcagtggtgagacctgcaccattacctgccagacccagggattatataccataggggaagggcacacttgcttcatagagaatgggtgggaatttgccttaaaggcaggatttacagtatttgttcataagggacaatagatatactgaaaatctgaggcactcctggaactgaggttaatcagaagcccacatggaagattagcattcaagatggagttgctttggcttccacactccacctccctagtttggctcttacaatctcacttgccttcctcttctataatggtcgctgagcctttagggagagtgtttgatatggtatagctttagcagcagtgtgttggcaatggaaaacagatcgggccagtaggattccaaatgagggagagtcacaggctttgttggatcatctctagtcttcagaagaacatgacttcagttttcacaaaagaagtagaacaacaaaatatataacagtaataatttgaatagtagaaatataatatacacaaggattacaatcaaaagagaattggtattccagaagaacagcaacaaaaaaatcttattccatcagggagtcaaacaaaagcatcaagaagaaaagtgaaacccaattcttttttagagactttttgtaagcagaaaataactcagggaaaaaagtctttccttttactttctctgtgacaccaccatttcttggcaaagtcaattacttcctagtatttactactttggaaacataaattttatgattttattactagtagtagtgttgaacatatttttataattgtggtggttccttatgttaaattttctttctttttttttttttttttatcagtttagaagtttattttgccaaggttaaggacattcctgtgccacagtcttaggaggtcttttattttactttattttattttattttattttattttattttattttattattttattttattttatgttattattattatactttaagttttagggtacatgtgcacaatatgcaggttagttacatatgtatacatgtgccatgctggtgtgctgcacccattaactcgtcatttagcattaggtatatctcctaatgctatccctccccactcccgccaccccacaacagtccccagagtgtgatgttccccttctagtgtccatgtattctcattgttcaattcccacctatgagtgagaacatgcagtgtttggttttttgtccttgcaatagtttactgagaatgatgatttccaatttcatccatgtccctacaaaggacatgaactcatcattttttatggctgcatagtattccatggtgtatgtgtgccacattttcttaatccagtctatcattgttggacatttgggttggttccaagtctttgctattgtgaataatgccacaataaacatacgtgtgcatgtgtctttacagcagcatgatttatagtcctttgggtatatacccagtaatgggatggctgggtcaaatggtatttctagttctggatccttgaggaatcgccacactgtcttccaccatggttgaactagtttacagtcccaccaacagtgtaaaagtgttcctatttctccacatactctccagcacctgtggtttcctgactttttaatgattgccattctaactggtgtgagatggtatctcactgtggttttgatttgcatttctctgatggccagtgatggtgagcattttttcatgtgtgttttggctgcataaatgtcttcttttgagaagtgtctgttcatgtccttcaccccctttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctagattttcttctagggtttttatggttttaggtctaacgtttaagtgtttactccatcttgaattaatttttgtctaaggtgtaaggaagggatccagtttcagctttctacatacggctagccagttttcccagcaccatttattaaatagggaatcctttccccattgttgtttttctcaggtttgtcaaagatcagatagttgtagatatgtggcattatttctgagtgctctgttctgttccattgatctatatctctgttttggtaccagtaccatgctgttttggtaactgtagccttgtagtatagtttgaagtcaggtagtgtgatgcctccagctttgttcttttggcttaggattgacttggtgatgcaggctcttttttggttccatatgaactttaaagtagttatttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgaacagtggtttgtagttctccttgaagaggtccttcatgtcccttgtaagttggatccctaggtatttcattctctttgaagcaattgtgaatgggagttcactcatgatttggctctctgtctgttattggtgtataagaatgcttgtgatttttgtacattgattttgtatcctgagactttcctgaagttgcttatcagcttacagagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgacttgtggcagttttcaaagggaatgcttccagtttttgcccattcagtatgatattggctgtgggtttgtcatagatagctcttattattttgagatatgtcccatcaatacctaatttattgagagtttttagcatgaaggctgttgaattttgtcaaaggccttttctgcatctattgagataatcatgtagtttttgtctttggttctgtttatatgctggattatatttattgatttgcgtatattgaaccagccttgcatcccagggatagagcccacttgatcatgatggataagctttttgatgtgctgctggattcggtttgctagtattttattgaggatttttgcatcaatgttcatcaaggatattggtctaaaattctcttttttggttgtgtctctgccaggctttggtatcaggatgatgctggcctcataaaatgagttagggagcattccctctttttctgttgattggaatagtttcagaaggaatggtaccagttcctccttgtacctctggtagaatttggctgtgaatccatctggtcctggactctttttggttggtaagctattgattactgccacaatttcagagcctgttattggtctattcagagattcaatttcttcctggtttagccttgggagggtgtatgtgtagaggaatttttccatttcttctagattttctagtttatttgcgtagaggtgtttgtagtattctctgatggaagtttgtatttctgtgggattggtggtgatatcccctttatcattttttattgcgtctatttgattcttctctctttttttctttattagtcttgctagtggtctatcagttttgttgatcctttcaaaaaaccaactcctgcattctttagttttctgaagggttttttgtgtccctatttccttcagttctgctctgattttagttatttcttgccttctgctagcttttgaatgtgtttgctcttgcttttctagttcttttaattgtgatgttagggtgtcaatcttggatccttcctgctttctcttgtgggcatttagtgctatgaatttccctctacacactgctttgaatgtgtcacagaaattctggtatgttgtgtctttgttcgcgttggtttcaaagaacatctttatttctgccttcatttcgttatgtacccagtagtcattcaggagcaggttgttcagtttccatgtaggtgagcggttttgagtgagtttcttaatcctgagttctagtttgtttgcactgtggtctaagagacagtttgttataatttctgttattttcaatttgctgaggagagctttacttccaactatgtggtcaattttggaataggtgtggtgtggtgctgaaaaaaatgtatattctcttgatttggggtggagagttctgtagatgtctattaggtccacttggtgcagagctgagttcaattcctgggtatccttgttaactttctgtttcattgacctatctaatgttgacagtgaggtgttaaagtctcccattattattgtgtgggagtctaagtctctttgtaggtcactcaggtcttgctttatgaatctgggtgctcctgtattgggtgcatatatatttaggatagttagctcctcttgttgaattgatccctttaccattatgtaatggccttctttgtctcttgtgatctttgttggtttaaagtctgttttatcagagactaggattgcaacccttgcctttttttgttttccatttgcttggtagatcttcttccatccttttattttgagcctatgtgtgtctctgcatgtgagatgggtttcctgaatacagtacactgacgggtcttgactctatccaatttgccagtctgtgtctttttattggggcatttagtccatttacatttaaagttcatattgttatgtgtgaatttgtcctgtcattatagtgttagctggttattttgctcgttagttgatgcagtttcttcctagtctcgatggtttttacattttggcatgattttgtagtggctggtactggttgttcctttccatgtttagtgcttccttcaggagctcttttagggcaggcctggtggtgacaaaatctctcagcatttgcttgtctgtaaagtattttatgtcttcttcgtttatgaagcttagtttggctggctatgaaattctgggttgaaaattcttttctttaagaatgttgaatattggcctccccctctcttctgacttgtagagtttctgccaagagatctgctgttagtctgatgggcttccctttgtgggtaacccgacctttctctctggctgcccttaacattttttccttcatttcaactttggtgaatctgacaattatgtgtcttggtgttgatcttctcgaggagtatctttgtggcgttctctgtatttcctgaatctgaatgttggcctgccttgctagattggggaagttctcctggataatatcctgcagagtgttttccaacttggttccattctccctgtcactttcaggtacaccaatcagatgtagattttgtcttttcatatagtcccatatttcttggaggctttgttcatttgtttttactgttttttctctaaacttcccttctcgcttcatttcattcatttcatcttccatcactgataacctttcttccactttattgcatctgctcctgaagcttctgcattcttcaaatagttctcgagccttggctttgagctccgtcagctcctttaagcacttctctgtattggttattctagttatacatttgtctaaatttttttcaaagtttttaacttctttgcctttggtttgaatttcctcctgtagctcggagtagtttgatcatctgaagccttcttctctcaactcgtcaaagtcattctccatccagctttgtcccgttgctggtgaggagctgcattcctttgcaggaggagagtcactctgtttttagagtttccagtttttctgctctgttttttccccatctttgtggttttatctccttttggtctttgatgatggtgatgtacacatgggtttttggtgtggatgtcctgtttgttagttttccttctaacagacatgaccctcagctgcaggtctgttggagtttgctagaggtccactccagacctgtttgcctgggtatcagcagcagtggccgcagaacagaggattttcatgaaccgcgaatgctgctgtctgattgttcctctggaagttttgtctcagaggagtacctggccgtgtgaggtgtcagtctgcccctactggggggtgcctcccagtcaggggcagggacccacttgaggaggcagtctgctccttctcagatctccagctgcatgctgggagaaccactgctctcttcaaagcagtcagacagggacatttaagtctgcagaggttactgctgtctttttgtctgtgccctgcccccagaggtggagcctacaaaggcaggcaggcctccttttgctgtggtgagctccacccagttcgagcttcctggctgctttgttgacctgagcaagcctgggcaatggcgggtgtccctcccccagcttagctgccaccttgcagtttgatatgagactgctgtgctagcaatcagtgagactccgtgggtgtacgaccctccaagccaggtgcaggctataatctcctggtgtgccattttttaagcccattggaaaagtgcagtattagggtgggagtgacccgattttccaggtgccatctgtcacccctttctttgactaggaaatggaactccctgaccccttgcacttcccgagtgaggcaatgcctcgtcctgctttggctcgcgcatggtgcgctgctcccagtgccctgcgcccactgtctggcactccctagtgagatgaaccccgtacctcagatggaaatgcagaaatcactcatcttctgtgtcactcaggctgggagctgtggaccggagctgtttgtattcggccatcttggctgccctcgtctctccttatgataaatattctgtgctgtacttaaaggtatgtactgtggcttatttatctttgtattcccagaacccaaggatccaaattatttcttcaaattcatgatcactctacacagttttggaatttctttacaggtggtatactgaggggaaaacatgcttcatggacacaagatttagaaaatattatactttttttaaccacataattttcagtaccatttatcaggcaatgtgcacagaacagttgctagattctagattgagatgtaaactcattttacaagttataactttttttgtacctatttaggtaccctgaaatagtattctgtaaaatacatttagaaacaacaaatatacagaatcattctagcttaaagggcataaattttcatggattatttatgaattttccaaaaaatgaaattagaaattattttatttatgatgatttatataatagaaattctagattctattagaaagtctttcttttgaactcaactgactgttagaccttgtattagtctgtttacacactgctataaggaatgatctgagactggataatttataaagaaaagaggtttaattgactcacagttcctcatggttggcgagggctcaggaaacatggtggaaggcaaagaagaagcaaggcacatcttacatagaggcagtaaagagagagagagggaggcagaaactgtcaaacacttttaaaccatcagatctcatgagaactcacttgctatcatgagaagagcatgagggaaactgcccccatgatccaataacctctcaccatgttcctccctcaatatgtggggattacaattcaagatgacatttatttggggacacagagccaaaccatatcattctgcccctgacccctcccaaatctcatgttcttttctcatttcaaaaccaatcatgttttcccaacagtcccccaaagtcctaatgcattccaacattaactcaaaaatccaagttcaaagtcatctgagacaactcaagtcccttccacctatgagcctgtaaaacaaaaaacaagcatattggctaacatggtgaaaccccatctttactgaaaaaatacaaaaaaattagctgggcatggctgcaggtgcctgtagtcccagctactcgggagactgtggcaggagaatggcatgaacctgggaggcagagcctgcagtgagatgagatcgcatcactgcattccagcctgggtgacagagcgagactccatctcaaaaaaataaataaaataaaataaaaaaaaaagctagttatttccaagatacaattggggtacaggcattgggtaaatgttctcattccaaatgggagaaattggccaaaacaaagaggccacaggtcccatgcaagaacaaaacccagctggcatttattaaatcttaaagctccaaaataatctcctttgactacatgtctaatatccagggcatgctgatgcaagaggtgagttctcaaggccttgggcagctctgcctgtgtggccctgcagggtagtccccgcggctggtttcacaggctggtgttgagtgcctgcagcttttccaggtgcacaatgcaagttgtcagtggctctaccattctggggtctggagaacagtggtccgcttctcacagctccaccaggcactgccccaatgggactctgtgtgggagccccaatcccatatttttctctgcatttctctagcagaggttctccatgactccatcactgcagcagacttctgcctgggctttcaggagtttccatacatcctctgagatctaggtggaggctcccaaactgaactcttatcttctgcgcacctgcagacccaacaccacatggaagctgccaaagcttggggcttgcatcctctgaagcaacaggctgaggggcctatacgttggccccttttagtcatggctgaagctggagtggcagggatgcagcgtgccatgtcctgagactgcacagaacagcagggccctgggcttggcccacaaaaccatttttccctcctaggtccctgagcctgtgatgggaggggttgctgtgaagatctctgacatgctctggagacattttctacattgtcttggctattaacgttctgctccgcattacttatgcaaatttctgcagccagcttgaatttctccccagaaaatgggtttttattttctaccacatggtcagtgtgcaaattttccaaattttacactctgcttcccttttaaacataagttccaatttaataccatctcttcatgaacacataggactgtatgcttccagaaaaggccaggtcacatctcaaaggctttgctgtttagaaatttcttctgctagataccctaaatattctctctcaatttaaaagtttctacagatctctagggcaggggcaaaatgccaccagtctctttgctaaagcatagcaagagtgacctttactccagttcccaataaattcctcctctccatctgagaccatctcagcctggacttcattgtccattatcactatcagcattttggtcaaaactattcaaaaagtctctaagaagttccaaactttcccacatcttcctgtcttcttctgagccctccaaccattccaacttctgcctgttagccagttccaaagtcacttccacatttttaggtatcattatagcagtgcccccaaactcccagtaccaattttctgttttcatactgctgtctgttttcatactgctataaagagtgacctgagactgggtaatttataaaagaaagaggtttaattgactcatatttcttcatggttagggatgcctcaggaaacatcatcatggtggaaggtgaaggagaagcaaggcacatcttacatggcaccagcagggagagagagggtgaggcagaaactgtcaaatacttttaaaccatcagatctcatgagaactcacttgctatcatgagaacagcatgagagaaactgcccgcatgatccaataacctcctaccggattcctccctcaacgtgtggggattacaattcaagatgacatttaggtggggacatagagtcaaatcatatcagaccttcttccactctcttctattcagcttgccaaaatttgccacgctattcaattctaacagggtttgttttgaaaaactgattaaacaattaatttaaatactaattatgaacacccattctataacttctgagtattaatataactagaaaaagattgctttacattcaaggcatactcaagaatgttaggggatttatttagtacactgatgatttctgattttctcacattcaggaaataactttaaaagatacctgaagattgatgagagagagggatagagagagaaggagaaagagagtgagaatgagatatatatatatatcataaatatatatttcctcttcctcttccttctttttcttctttgttgagaattgacttcctcgggatatttttgtttcccaaaggtgctattcactttcaaagtcacatctgactgtagtgacagaatgtctatctgatttaattcacagggcaccagaaagaacttggagattagctgccccaggatgcaggtgcctctctggagaaatggaaattctccttgagttgatgtgttcttagtctcctcttggtgtctgagcagtgtggatggtgtgaagcatcaagggagccatggtttactgccttgcatgacacttttacaaatggtgactattctcacgccccctctcacccccacacatgcaacaacaggacctcataggccagcacctcttcatcacctgaagccaaataaattattcagcacagtttgtacaacatgaatattcattgcattttgcacagtcttgtgtggaaaataacataaaaatctgtaaaccaaatagagtttggatcatggagtatccttgaagcacatattaaatgaatcgaacataaatgttaaaaaccattaatgctaccccctattcagccagatcttgaagatgaagaaaaaatatatcttaaagtggagccaccatatttagctagggagtcaaaagcatacaatgattattttgatgaaagagatgtattgcatgagaagacggaaagatgtatttattatagaaacaaactttagagcataaaaaaaaggcttttttcctttttttttttctcaaactccattaaaacacaactattttccctgtttattactgtggctcatactacttaacttgagattaataaatagctcctctacattgagcacttgcaaatttgccaggtaataagttcagcactttataaatgtcatatttcaaatcctggaagtaatttttactttgagcagtacaaatgtagcctaagtatgactcctccatgggaagcagtcgctattaatatcacttttccaatctggaagcaggatttagttcttctctctgttccccaaagaaaacccattctattagaatgtttcatgtgagcttaagacgaatgtgtattcagatgttgttataagaaacagtctgtagaaatcaattatatccagttgattgaatagcgctgctgaattcaactatatttttactgattcttgcctgcttgatgggtccatttatcatagaagggtattgaaatctccaactataatagtgtgaatttgtctttttctccttgtagttctatcagttttgcctcatctattttgatactctgtttttaggttgcatgcatgttaataattgttgtgtcttcctagagatttgatccctttatcattatgtagtgtcttctctttttttgttttttttttgagacagagtcttgctctgtcacccaggctggagtgcagtggcgcgatcttggctcactgcaagctccagctcctgggttcacgccgttctcctgcctcagcctcctgagtagctgggactccagtcgccagccaccacactcagctaatttttttgtatttttagtagagacggggtttcactatgttagctagaatgttctcgatctcctgacctcaggatctgcccacctcagcctcccaatgtagtgccttctctttatctcaagtaacttcctttgctctgaagtctgatctgtctgaaattaatactgctactcctgctttcttttgattatttttagctgatatatctttctccaggaatttactttcagcctatatctatatctcactacctatcaatctatatctgggtatagattgatagatctttatattcaaagtgggtttcttataaacaacacataattgagtcttattttttgaaccactctgacaatgtctgtttttcaactagtacatttcaattggtacatttaaaccaggggtgtccaatgttttagcttccctgggccacactggaaaaagaagaattatctaaggccacacataaaatatactaacattaatgatagctgataagctaaaagaaaaaaattcgcaaaaaaatctcataatgttttaagaaagtttacgagttttgtgttaggctgcattcaaagccatcctgggcctcatgcagcccatgggccatgggttggacaagcttgatttaaaccattgatattcaaatgttggtatcattggattaagaaatatcatatttgttactgttttttatttgttgctcttgttccttgttcttatttttgtcttccactctttgtatgccttacacggtttaacttgagcattttatgttatttcattttcattcctattttagtattttagttataattcttttaaaaattttttagttgttgtcctagcatttgccatatacatttacaactaatgcaagtctactttcaaataacactatgcctcttcacagatagtgcaaaataatatcatagcaaaataatactaattccaatctatcatcccttgtatcattgttgtcacttatttcgtttgcatatcactcattttccttctctctgaggaacttattttacaatttattgcaagggaggtctactggtaataaattaccttagtttttgattgtcttaaggaagtctgtgtttcttctttattttttaaggataatttcatcaggtacagatttctacatttttttttctatcaacacttaaataattcattccactttcttcttgcttccacggtttctgcaaagtcagatataagtcttatctttgctcttatgtaggcaaagtggcatttccctctggctctttgcaagattttttccttatcttggattttctgtagttagaaaatatgtgtaggtgtagatttttggcatttatattgcttggtgttctttgagcttcctggatctgtgacttggtatctaaagttaatttggggaaattttcagtcctcactgtttcatttatttcttttgtttcttttcccctttcttctgctatttgcattagacatatgttacaccttttgtagctgtccccaagttttgaaatattctgttctggctttttttcagtctttgttctatttgcttttcagctttataggtttgtattgacatctttcaagctcataattagctgattaataagacccttaaaattattctttatttctgttacaatgcttttgatatctagcattactttttagttcttccctaatgtttccatccctctgcttacatggcccatctgttcttgcatgttgcctacattattttagtgtccttaccatattaatcacatatgtttttaaattgcgggtctaatcattccaaaatccttgccatgttctgatgtttgttctgtcttcaaattctgtttattgccatttattatttgttctgtaacattttcttgatagccaaaaataacgtacttggtacaagaagctgctataaataggtctttagtaatggggtgataaagagtaaagagaaaggaaccattctatggtcctgtgtttaagtctcagtcttttagtgagcttatacctctggactgtgaattcataggtgcttttcagtttttattttctctaataggtggtacagaaagccaagaaggtccaggatttgggtattttcctgcctccaggttatttaggctctgtgaataacctagcagaataggctctggttaacttgtttctcctgaggacagatgcttttttttaaattttattattattgttattttgagatggagtttcgttcttgttgcccaggctggagtgtaatggcgtggtcttggctcactgcaacctctgcctcctgggttcaagtgattctcctgcctcagcctcccaagcagctgggattacaggcacccaccacaacacccagtatttttagtaaagtggaggtttcacaatgttggcaaggctggtctcgaactactgacctcaggtgatccgcctgcctcagccccccaaagtgctgggattacaggcacgagccaccgtgcctggctggtctggcatatatttaaatggtttcttttcctcttcccttgccatagcacaaagggatttttcttcagcgtttataatgggaatctttttgagttcctggaggtaaatctcaaagtactgtggggtccctcccccatgactggggcacggaaatttcaaccctcaaaattgcccacaccaagcctctattcatcaatcacacttcatattttcctactctgcattggttcttgcaccaatttctttgcttgttttcttttctttctttgtttcttcctctttttttttttttttgaggcaaattatcaccctgtcacccaggctgaagtgcagtgttgtgatcatagctcactgcagccttgaactcctgagctcaagttgacttccaaagtggttcacgtctaaacttctaaaggaattctgaaggaatttagaattttagaggtgaaccactggacccagccttctgctgtgattcctgatcatgattctcccctccagtaagctgtgactctctgtatgcggttgcctctctctccagtcttgggggaggtgatgtgccctgcactccccactctcttacagattcaagtagagttgttgattttccagtctgttcagcattctatttgttaggatggagtgaagggcttctaagctctttatatgcagaattggaaactggaagttcctctgtgtatttttaaaaattatatttgattctgatgcgaggcatacacagcagttattcaatacatgcgtttctgtataaatgctaacacaaaactccattgccatgttcagctttatacatgaaaaggggacaagaactttgctaggccttagcagatgtctcaagacaaggctaatgtgccaagtcattcctggagctgagatgttagattttctgttgaggctgaaatgaagaagacgatgatagtcccaggcagtatgcagaatcaaactcttcaaccatagaattttaactcctctgtgacaagctagagtgattaaacatcttttaaaaagtatccttaggaagactttttccagtagcatattaattatcaaagtagatgatatatccttttgttgactcagtttatattcagtgttagaacttgcagtttagtcatttgaacataaagagttaactaacatagcaatgtaagaccacatgacctagaattgccatgattttaaaaagagcactttagcataaattgttgcttgggataccatatgctctcagcagccagcatgcacacaaagtaaagagaaaattatgaataatgtgacaggttggaggcaaaagataatgatcttcttcccttaaattcatagtttcaaagtatggcagcatcatttcttgatttgttctttcaaattctcaaaaaagcaaagtaacccatgcacaaatgtatgattaaaaaatgtatctatgcccaatatgggttgtactctgattattttgttgttgttgttctgtctcttttctagtgtgggcaaatataaagaaaactcaaccagtattcactggttttccagaaagaaatggatatagatagaataatttcaaagaaactaggcagaaatgaacaaagtgctgtttcatttccacatttaagaaggtatatactgtttgcaaaatcctaaattcaaagaacaaaattgagttggttgttgtttaccaaagataacaatcgttagctgtgtaatcaggtaaaatccactttgctttgctagacttgcatcaagtaatgattttaacattgacttattatttggtggccttattacacagccttattacatggtgatcatttctccattaaaagctaataattccatatatagaaatagtattggctgggtgcagtggatcacgcctataatcccaacactttgtggggctgagttgggaggatggcttgaggcctagagttggagaccagtttggacaacataaagagacctcgtttctacacacacacaaaataagaaaattagctggacatgttgatgtaaacctgttgtcccagctacttggatggctgagatggaacataacttgagcccaggagtttgaagttacagcgagctatgattatgctaccacactctgcactccaaactgggctaaagggggttgagttcttgatttgattctcagcttggtcattgttggtgtatagcagtgatactaatttgtgaatttgtgttcattgattttgtatcctgagactttactgaattcatttatcaggtctaggagatattttggattagtctttaaggctttctaggttcacaatcacatccttgatgaacattgacaattagagtttctcttttccaatttgggtgacctttgtttctttctcatgtctgattgctctggctggaacttctaatactatgctgagtagaagtagtgaaaatgggcatccttgtcttgttccagttctcagggagaatgttttcaacttttccccattcagtatgatgttggctctgggtttgtcatagatggcttttattactttgaggtaagttccttctatgcctgttttgttgaaggttttaatcataaaggaatgctggatttcttcaagtgctttttctgcatctactgagataatcatacagttttcttttttaattctgtttatgtcatgtatcacattttttgatctgggtatgttaaatcatctctgcatccctggtatgaaacccatttgaacaagatgtataatctctctgatatgcttttggagccacttagctagtattttgttgagaatttttatgtctatgttcatcagggatattggtctgtagtgttctctttttttatcctttcctggttttgatattagggtgatactggcttcatagaatgatttagtaaagattccctctttctctatcttttggaatagtttcagtagaattggtaccaattctttaaaggcgtggtagaattcatctgtgaatctgtctaattctgaatttttctgttggcgattttttttaaattaccaattcaatctcattgcttgttattgatctgttcagggtttctatttcttcctgatttaatctaggagggttgcatatttcctggaatttatccatttcctctagattttctagtttgtgcattaaaggtgttctagtagcctaaattaggtttgtgtttctgtggtattgtttgtcatatttccggtttcatttctaattgagtttatttgggtcttttcccttcttttcttggctaatcccactaatgattatcaattttgtttcttttcagaaaaacagctttttaatgtttatcttttctactttttggttgttgtttatttgttatttcttttattctcctgggtttgggtttagttttttcttgtttctctagtaccatgaggtatgaaactaggttgcctaactaggttgtcaaaaaatccttcagtctttttttttttttttttttttgagacagagtcttgctctgtcacccaggctggagtgcagtggcgcaatctcagatcactgcaacctccacctcctgggttcaagcaatttcctgcctcagcctcctgagtagttaggattacaggtgcccacaaccatgcctggctaatttttgtatttttagtagagacggggtttcaccatcttggccaggctggtcttgaactcctgacctcatgatccacccacctcagcttcccaaagtgctcagactttttgatgtaggcatttaatgctatgaactttcctcttatcaccacttttgctgtatcccagaggttttcatcagttgtgtcactgttattcatttcaaagaatttttaatttccattttcattttgttgttaaccccaaaatcactcaagagtatgtcatttaatttccatgtatttgtatacttttgagagtttcttttggagtggatttctagttttattccactgtggtctgagaagatacttggtatgattccaattttcttaaatttatcaagacttgtttggtggcatatcatatggaatcttggagaatttaccatgtgttgaagagaagaatatatattccgtcataatgaagcagaattttctgtaaatatctgttaagtccatttgttctagggtataggttacgtccattatttctttgttgactttctgtcttgatgatctgtctattgctgtcagtggagtattgaggttccccactactattgggttgcatctatctaatttcttaggtctagttgtaattgttttataaatctggaactccaatgttaggtgcatataaatttagcattgtaatatcttcctattggactaatcttttatcattatataatatccttctttgtcttttttcttttacagttgttgctttaaggtctgttttgtctggtataagaataggtactctggtcttgtttagtttccatttgcgtggaatatcttttttccactcctttaccttaagtttatgtgagttattatgtgctaggtgagtctcttgaagacacaggagatacttggttggtggcttttaatccattctgccattctacatcatttaagtggaaatttaggccactaacattcaacatttatattgagatgtgaggtactgttctattcatcatggtagtgttacctagatacttttttacattgtggtattattttataggtcctgtgagatttatgctttgaagaggttctattttggtgcatattaagctcttgtttccagatagaactctttttggccttttatttatttatttatttatttatttatttatttatttattatactttaagttctgggatacatgtgcagaacgtgcaggcttgttacataggtatacacgtgccatggtggtttgctgtgcccatcaacccatcatctacattaggtatttctcctgattctatccctcccctagcccctcaccccccaacaggccccagtgtgtgatgttcccctccctgtgtctatgtgttctcattgttcaactcccacttatgaatgagaacatgtggtgttcggttttctgttcctgtgttagtttgctgagaatgatggtttccagcttcatccatgtccctgcaaaggacgtggactcttcctttttatggctgcatagtattccatggtgtatatatgccacattttctttatccagtctatcattgatgggcatttgggttggttccaagtctttgctattgagaatagtgctgcaataaacataagtgtgcatgtgttttatagtagaatgatttataatcctttgggtatatacttagtaatgggattgctgggtcaaatggtatttctggttctaggtccttgagcaatcgccacactgacttccacaatggttgaactaatttacacttccaccaacagtgtaaaagcattcctatttctccatatcctctccagcatctgttgtttcctgactttttaatgattgccattctaactggtgtgagatggtatctaattgtggttttgattagcatttctctaatgactagtgatgatgagctttttttcatatgtttgttggctgcataaatgtcttcttttgagacgtgtctgttgatatcctttgcccactgtttgatgaagttttttgttttttttgtcttgtaaatttgtttaagttctttgtagattctggatatcagccctttgtcagatggatagattacaaaaattttctcccattttgtaggttgcctgttcactctgatgatagtttcttttgctgtgcaggagctctttagtttaattagattctatttgtcaatttgggcttctttgccattgcttttggtgttttagttttttagttatgacgtctttgcccatgccattgtccgagtggtattgcctaggttttcttctaggattgttattgttttaggtcttacgtttaagtctttaacccatcttgagttaatttttatataaggtgtaaggaaggggtccagtttcagttttctgcatatggctagccagttttcccagcaccatttattaaatggggaatcctttccccattgcttctttttgtcaggtttgtcaaagatcaggtggttgtggatgtgtggcattatttctgaggcctctgttttgttccattcttctatatacctgttttggtaccagtaccatcctcttagcatttcttgtagtgctggtttggtagtggcaaaatccctcagcatttgtttgtctgaaaaagactttatctctctcttatttaggaagcttagttttgctggactttggctgacaattattttgtttaaggaggctaaagactggacctcaatcccttctggcttgtacggtacctgctgagaaatctgctgttagtctaataggtgtccctttataggttagctgaggcttttgtctcacagccctgaaaattctttcctttgtgttgactttaggtatcataataactgtttgccttagtgattatcttttgcaattaatttcctaggagttctttgagcttcttatatttgtatatgtagatctctagaaaggccagggaagttttactcaatttttccctcaaataactgtttcaaacttttggacttctcttctccctcaaacactaattatttttaggttttactgttttaaataatcttatatttcttggaaacttctgttgttatattatggtatgtttttgatagtaaacatgatgttagtaaatatgatgttcattttttattgttctttctttgtctttgtctgattgggttaattcaaaagccttgtctgtaagctctgaaattctttctcctacttgttctagcctattgttgaaacttttcaatgcaatttgtatttacctaagtgtgtttttcatttccagaagttctgattgtttttttctttatgatatctatctttctaaacaatttttgcactcatatcctggatttgttttttttttttcagttgtttttcacctttctctggtatctccttgagtagattaataatcaaccttctgaattctttatcttgcatttcaaatattttatcttgttttggattcattgctggagaactagtgtgatcttttgtggggatatagaaccctgttttagtgttatagaattctgttttgtcatattaccagaattacttttctgattccttctcattgagtagactatttcttcaaatttttcttgaatttatttttgattggactgtatttttttattttttccctcttaaggatctaattattatagtttattatagcctaatttgattcttaatgcttttaggtgtgaagaatctgtatgagtttctctgtgtgctggtatcccagatgctggttgtagtagttatgtatttggtgtgtgggtgagttcactgtctcctgtggggttggaatggcagggatctcttgaaacttatctcattgtgtacactttatttatttgttcaaattttccccagtattttatttattgaattgatgattcaggctttaggtcaataagggaggtatccctgggtaggcactcattgtagctagagcaggtggttagatgtaatacctaatggcgagcagaggtcccagccttgaagaaggtggctggggtagctctcaatttgatgtgctgaggctttatcacgatggaggatgggagcttcctcagctcccctcctaggcaagcaggacatctgtccacctcacagcctcacttctgtcccagtgttctagctatttgtattagacaggtacctcttttcatttgcaggaatgttagcgaggatttgtaactgcctctcatacaggctgaatctgaagagtgctcctcctgtgaggctgcaatgtcactgaattgttccaggaagactgtctataggtgcatccattctgtgttcccatgggagaagccccagctgtgtttgcagttgtgtatcggagggaacaaagactccttctccaagactcttcatgatcacaaggcgcctgcttattggggtggaagtgcaaactttctctactgcacccagcactgtaattgtgtttctgctgaaagaaacttcccatcactggaaaaatctgagacttatgatttgccattcagatttttttgtcccacaggatgtccctttgatatagtgtcctcctccttcccttaggaatagaacttcctgaaagctagactgcagtgattgttatggctcttctgggtctagccacccagtaggactaccagactcagttctggttctgaggaatatctgtaagagatccattgatgtgacctgtcttcatgtctcccaacagtggatcctagcacctgctcttatggaggtggcaggagagggacatagactgagattccttggttgtaagtaggcttactgtgctggcttattctagtattgaatctctcctgtggatggactcaggacctctggttagccattgcgtcatgggcagtggtgataaccgatatcacacagccatttttctccttccagggtacagtgttattctacctagaggtgctgtaatggcctatgttggctggcctccagccaggcagtggtgtttgcagaagagcaccagcagcagtagtagtagtgggatttgagcttggcttaagtttcccaggagaagtattctagtttttcagagaataggcagggtcataaagctcccaaaagtttatgtcctttgtgttaagctaccagggtggtggagaaatattaccaggtgggggcaggtttaagtgggtctaagctcagactatccttgggcagggcaggccgcagcccctgtggtagacaggctggttctcaggctgctggggtaatgttccagagaggagtataactgccactaatgcttagaagagtttgcaaagggagtggggagtagtgggaagcagcaagcctcactcagcccccacacagtcggtgaggccagtctcactcccacagtgctctgctaaaagcactaggtttagatccaggcagcctgagcacagaactcagattgccctggccataagcttccctgcagagaaagcaagcatgactctcaggccacgtccctccttgtctgctgcaaggctgggtgcccacctcctatgctcctgtctgtaacacactttccactctttcccaggttctgttcaagggagtttgtcaccacttgagattatatcacaaaatccagttgggggcatctttcaccctgggacctctcctggagctcattggctgagggcccctgtgaaatacagtcagagatggcttcccttggtccactctggagactgggaatgcctatgaggcacttcctattgctgctgctgcttttatatttcatgccactccctaaatccattgcagcttttggtagaattaagggtttcttaaaccatggcctggattttcagattccctggtagggatgtgtgcttggaggtagggatgcttgtgtttttgggatgtgtgcttgtgtgcttgggatgtgtgcttccctctcacactctggatacttacggtttttcacctgtctcacaaagcaggctgcagtctgccacttctttcaaagagtctgtggattcttctggttttccttttaagctcctgtggtggttctcaggggaagaaaaatctctacccactattctgttcttccaagtgtgagaggcaaactaacactgccttctatctgccatctcggaaaagaaaaacaatctttatgcattaagccaagatttttcctaagcaacatcacaaaatgttcttcagctacagtggcctgaaataatactgtattatggcattagtcacaattttaaatggattacattggataaccaggaacagcggcaacaaatgcaacagttgttcaaaaaagcagtcaagtctggaactctctggcctgtaaaacactcttttgtctaaactccttctctgttcatgaggatggaatgggttacctggttgtctttgtgttccccccttggatacagaaacattggttataatattttgtaggtatgtagacaaagaagatggtatttactttcactttcacctttattaggtcctcaaaagagattaaaagaatgacaccagttagtactaacataaattatttgaaactttccagtgctttccatcactgacgaagatctgactttatggaagaagccaacttaacctttaaaattggcattctgaatccttaatcataactaattcacaccactaacatcatgtttactatcaagaacatgccataatgtaacaacagaagtaaggaatatattttaaaaattaaatagtttagttttttcttttattgattatcctacttttgactgttaaaaatcagaaatgcaaaagcagatataagtttaactgacataatggtaggatcatatctcatatgcaactcagttttctaaggttttacttaagatgtttataactcaaacagttaccagtaaacctgtaggactatttcactagcttgataaacctatgcatagtatttcaaaaaagagctagaagttttctttgtggtttagtcacttcaggaagagggagaagtttgggtttgggatcagaaagccacctgtaaggaatgtggaattccttacaatcattggtccccaaactaaaaggataataatttcagaacataatataataaaatggacttacatatatctgaaaatggttttagtgcagtggacatttctattgtttgaaaatatgactgcattaattctaatgatttctaaaattacattttctggcaaatatagcatttgaattgcctggattcaaagggagaaaaagagttttcaatttgttcatggcagaaaggctatcaaaatattcatagtatgcttatgaatattatggcatcaagctcctctattttgttcagttcttaagctggaatctcagctaaatgtgtgaaattatttgactatatctgagtttcatgcactgatgcttacgttcttttatagtacaaaaaggttttgaggcatggaaaggattaataaagccagttatgtttaaattaattatggtttatagcttggtaatgtgtatatatccatgctctttagaaacaaagagggagctcaaaaagtgcatcttgaatcaaacgaaacaattttacagctgaaatagcaatttcctacctctaaatgtatatagctattatatccaagatgttttctttttagagttccaaagtaatattttgcacaatccctgggagtttcagtcaaaatagcacagtggagtttcatctggccaacaaatggtcagagcagttataatcagagctaacagccctcttgaatttgaactgtccccgatatgtttcagttgttgtcattttaaatgtggtgtgaatctttacgttgatacttacatatataagcatatttcttacgaaccagggttttggcaagatgtgagaaaaaaagagaagagaggggacgtgaaaaataactaaagaatagacaaaaataaatatataatatctttatcctttcaaaatgcgtgagcatacacaaatttgtgcaaatacacctatgcacacactcatatatacacatatatacattgatttttttgatacttctctaaagaaaagtatgggggggaaaacaaaaaccaaaatgcatgatttacagcaaatactcctgttttctccttgaaattcaacttcttactcgtttgtgcttccttaacccactcatgttttcccccccaccatgtaaacttctcaattcactgggagaaattactttacaaccctaaatttgttgaacattctctctatacactaacagttttgttcccataatagaaacctcttaaagcgtgacaggaaagctcatcatatcatgcataatttcatagtcagccagatatttaaattggaagagaaaatatgagttatttcacattatccaaacctacccttgccaagtgataagacattatagtacaaaataataccacttttaatagcatcaattttttgaggatgacctgtgtcaggcattacattattactcaccactacgttattagaaatgtattattattgacattttgcagacaagaaaaccaacacttaggaggttaattacatgattctgaccctgatccaaactctaaccctgatgccaggataaagaagtccatcatggaattgagatttgaattttattgtattttactccaaatccctaactttccccactactgcctgtcctacattttcatgcatcagctactattttaattatatggcaggtatacatttatgaagagaagagcagcagtacatttatgagagaataacaacatttaggaaataagacacagaaatccaattacagaacattttactgcgtggaaaatataaacagcacatgcgtatctaaattttctgggctcactgagatgaattctaaccataactcaaatatttacaccagaggcatttcacactttttctatctcccagttaccaggtcatttacactttcccacaaacaaggaataagaatgttgttaattggccaggcactggtgactgatgctaaatgctatgaaatctactttatgcctgatctcaataatgtgtcaagatacagaaaagctgaagattcttttgtgtgtgtgtgtgtgtgtgtgtgcgtgtgtgtgtatgtgtatgtataggtccaaatttattaagttactttaagtgtatacggtttatcgcatgtcaattataccccaataaagcagtttttgaaaagtttagaagcataaaaggtgtgcttcatggagaaaagaagcaactaaaatattggcaaaaacaaaattgtccattatacaaccaaaatgacaaaagtaacaggccaacttacttgagggagctgaaaaaagcaggaatctgggtcctgtggagaatactgaacagatacaccaactccggacctattaactcctgacatcttctagtggaggaaaatacatgactaacaactaattagttaagaaattttatattggtttctctgttatacgcagctgcttgcaatacagactgataaaaatgttaagttattatggatagaagtcagctgagaaatgtcaagacagaatcaatttgcttcagaaatatgggctgataaaaacaaattggaagaattaacatagcatagcagtacaagggaaagacaaatgataccaggaaccaagagtgattaatagttattttaagatagttgggtcccctaaaaatcctagatatttgggttcaatgggtgatgaatggatagcatggagctaaaaccagaaaagttacaaccaggaaggatacagaagagaaggagatgtccataagcatgaataatggcactcatgtgttacccataggtgatctgatgatcatggcaaaatgcaaggcactttggtcaccaaagcaaatataggaacccaaatctagtcatcaagacaaagttctgcataagagcttactttaaaagaatcaccaattcttagcaaagctggttaaacaatattaaggaaatgaacagagtgcaagaattggaaaaggcctagtaagaaacaaataccagaataccagtccaggtaaatgttaggaattcaaagtgacaagaccagagctaacagtatcaagggaaaccacataagagctgggccaagaaagcatcattttcatagcagaatgcagccaaaatatttattaattttgattaaaagctgagtaagatgatatatgcagaaacgaaggcaaacaaattgcttaacacaaaattctgataatgataattctgatatgataaaaggaaataattagctatgtaattgtttcagttgctttttgtataggaatagtaacttaaaacaatgcagatatataaagagcatttttcaaaagttgctaataccctcatctttacagcaggatttaattaattaataatatgtattattatttgtataatattattatacaaattattattagcagtataatagtatgaatgtatttattccaatttatctgtgaaaatttggcaaaaataatttgagacttttgtttcacccattttaaaaaatatggtataactgaatccatgagaaattactttatattaaaggccaagtaacctaacacaagtatccaagttacaaccataactttaattatctggacacacagaataagctatcctattcagtgggatcaaaattaatatgctggctattttaaaaaatagttcatgggagatttcataaaataaagtttgcagtattgtcaggttattctcagtcaataaatgacttaaatgcttaatgtaaaattttgaattttaagttaataaatagatatcattcctctaaggctcagttttatgacttttttctcacaagtttcaaaccaactaagaaatgctttactaataatcttttgacatagggccaatgtcttttctttgaacatgtgtgggctgactgaagtaacctgttacctttccttaattagccacgcccatgataagctatctccaattgatttcaaattttgctttctttaaagtggaataaagacctaacctaaaaaccacttgagaagcaatctaactgcaaagtctttttttagtttaatgatttttccgcccacacttaatagaattttaaaaagcaactcaccctcatcaagttattccaaagtattcagcaaagttttaagagaaacaattttctttttatttattttgtataggtttatataaaatgtgtttaaattatgtaattgcaaaatgtgtgcaactgacctaaatggctttggaaaaaaaacacaattaaccctaagtctagtgtacagagagtatgtctttggggcaatgcagcaatattcaacaatcttcctgggtttgaggaatttccaacattatgagtttagtcttccctgaagtagcagctagaaattttcttggtcaacctgccttgcttataagatgtgggcacattaggaaggagataaatgacctagatttgctttctgttcagaagtgttagctacaggaattgattttttagtgggagtggtggtgaagctttccagcatttaagcagcagagacagtggttctgaaattaggttgtcagttactaactttgactttcaatagctcgaagatgcctgagtgcataaactcgaagcaactgttgaactgtttacgccatatcctttcccatgaaacaaggatccctaggacaaaagggaagtgccaacctgaagcatgtgcttctaaaacatatgtggcaactcaaaaccccaacatttcttggctaatggacttttttgttgggcctctttaagcttcttgttgggtcagtcctcccaaaggcagactgcaccacaaatatgtgtatctcctaggtcacagagatataggtgtagataatgtttatgaggccctacttaggtaaaatggagtcaaatgtaggaagagagtgaaggtcatgttcagaattgtgcattttgctccagcccccaacaaatgttagggcaatactgcctgaaagccagctattctagccttccaagaggtgctgtgagctatctggtattttggataaataatttttctacttaaactgaggcagataagtagtcaaggaagtgatcatgtcctcaggacgcagcaaccatggtgagcatacaatcaacacaataagccttagcattcacatagttgggcccattcaagcaaagctatcttcagtagggaatttcccctgtagacagcatgtgcactttgattttacctgtccttaaagtaacctcctaaaaaacacacccttaggtggagatttaagatgctaatgagacctgcgatgtatgaacaagcatgtacagctactgtgcaagggcacccaaaggaacacgcagaacatgcttactagcaacacctcttttcacctccttaagaataatcacgtaagactcctaaaaagggagtctccctagtgccagtctttgctgtctcatccttatgagcagccgccctgaattctctctcagggcatgctgtctattctgcacttaactttcaaaacattcttttctttttgcaatagattattctgtgttacatctcctttgctctcgtttaaattcttttaaactaagaagacaagaattgaggtctcacatcagcaaccaacaaaactagctgcttcagtatagggaactaacaaccctgactgactgttgtaagcctgtaagcaacaaataagggtgaagcctgcaggtttactagagggataattctttgttgtgaatattcagtttctgaaacatggtctatttgctttcaaggtcaaaagagagacaaaacaaaccagtgggtaaattatgtgatggttggtcaagagagcttctactgtatttcttatgaccaaatatttggactttagttgtaatttatgtccaagggtgacccagagagatagatggagatgctacagtacttttgtaggcagatttgtagaatgagaagagaaattgttggactaaaatattaaatgataatattctctgtcattctgtcgagtaggctccaaaataacttcaaatcacgtaacaaaaactagcatcctggagttttattctaaaagattagttcattataaaagccaaaaatttacataattggacaataacaagtgcaagataaatagtaacaataccaacatagtagctattgcatttactattgtcaacatataataaataaatattattctagattttctaaaagtccaagtcaatagcaagaaaaaagagctttaccatgtcattttaaagcacactaaaatttcttaattagggctagtgtaagacatttcttccttttgctgatcaagcaaacacatgaatttttttcttatttctttttttttctttttttctggatatagtataagaattctcaataattaaattaatgggaatgtatttttattataactttatttcagttaaagattgcatgtgaaaaataatgaatcacttgtatttagtaaattaagtttgtaatttttctgttgaaatttatgaattatgattttacaaaagattatctatcatacacactattactgaattatgtctaggtattgaaaaataagtgaattaaaactctacattagtcaaatttactctcagtcctttgagcccaaaagttttttgacatacttaaaattgagaacaattaaaaatattggacatttttaaaggcattggtgtctacagaaaaaaatgagttgaggttaatttccacattaataaagctggaaatagcatgttatgagcaggaaatttacttactgtgctgcatcttcaatagacctgtactatctaaatttccagtaatgcactttagtaacaataacaatttaatggatattaaacgagaatctatgcagaatagagatctgttttaactgagataggcatgcaagcctgtaaatgagtttcctatattggatgctattttctaactcaggcatgtaagaataattatttttatttctaaacaattttcaaattgaacataggtaagcctaagattttctgtacttagttttttggaaagttgtaaagatggcaaaagattcaggtatttaacattatatttattttcttcagtggaaaacaatgacctccaaacaaggcatggctatttactttctaatattgtttagctagctttttctgttcaccagtcttactaaagtcattaattatctatgttaacacagatttaatgcaaataataaaaatactatcgttaactttaggtaacatcaactcatagtttataactttacatagaaaataatgaaaacaccatacatgtgctacctcccagtggttattgataggaactgctctattaattgcaaaatagagattgaagctggtcatttttattttgtattcttgaaaatagttattcaaaagtaaatgttcaaaaaagtcctaaggtggattgtagttgatgtaataaacttttctgggcaggggaatcgagataatgggaccagaaataatttttaaagtaaactgatatttatagtccagataatagtgtacttctctaaatgtattataatgaatgttttatctttattatagcattgaggttttgttaataaatctttgcaataaatctttgtttccagtacacaaatacttataaaatttttatagcatccaatattattaagtagatcatgctaggaaagagaaaatggaaaaaaaaaagacaaaaggaaagacttgaaacatttaaaagaaattgaagaaataggccaggttcagtggcttacgcctgtaatcccagcaccttgggaggccgaggtgggtgaatcacctgaggtctggagttcaagaccagcctgaccaatatggtgaaaccccatctctactaaaaatacaaaaaattagccggctgtggtggcgggcacctgtaatcccagctactcgggaggctgaggcaggagaatcacttgaacccaggaggcagaggttgcagagagccgagattgtgccattgcacaccaacctgggtgacaagggcaaaactcagtctcaaaaaaaagacaaaaaaaacttccctgatgttttattgaaaaaaaaacacaaacaatctctctcttttttaagcccttcctttatctattttaaagattatgcaataaatttttggaaagttgctttcttattattatgaaaatatcaatggctatgaataaacattaagacataacattgtgttagtaaagacttgaaactctgacaagatccttatctgtagacaaggaagatggctagaaatatgcatacccatatacatgtactcacagagacacacaaactcacaaatacatatgggcaacatcacaaaagaatgagagtcctttatcaaactgagttccaacttgaaaatatgaccaaggttattgaaataagcctgcatcctaaattcacctatagcttccagaaagctattctacctctgcccccaatcctctccattacattgagctggatctcttcatgccaccctaattctatctgactttgaatttactcttctgatttgagctatatatcagtcatctgttctgattcataggatagtaatttcttaatccctcttaagagtttagcttaaattctttcaggtcttcccttcactaacacttaaaccagtttcttgctgtaactcatttttatcacattttgatcctgtctaaattgtgtttctcaaatttttttacgcaaaagaatcacctgagctacttattttataatgtaatttcctggttgctacctcttcccctccaccttctggagattcccagaggaattaggtctgaggaggggcccaaaattctggattttaataaaactacaacatggctcttgcaagtttgataaatatttgcctatcaatgacctatctagagccaactatattctagcaccctgtgattcagttacagtttctatagtatttttatctttccccacatacaaataaagctaccaaaaactgagactgatctatagaggtagaaaattggattgaactcataaaataagagtgtctttgcccactaggggttattttatacatgtgtctttatgcttctgagatctaccatgcaacatatcaatctgcagatttggaacctctcaatattttagtttagttaagtccccaggcaagagaatatcttaagaacattcttattcaaacagcttgtagctctgtaagaaattctatttacttattcaaagtaattaccttatgaattcctattgcctattttagcctgggttcatggctctttgttctcttagcctttatcttgatcatctttttccttcttctcaacacccaaaatttgatcaattgcctgccaagacttatactatctcattgttctctgtcttaattgatcccactggagtggtgcacttattctacaataattgctatatttctctactgtatagatgaattccaagtcctggtctatgtcagttatcccagttcagtggttgccaaagttttagtttgccatcaaacatttctatcataaataatcatgacctttgccttctagtcccttctgctcctccccccatatagggaaatagttctagaaattcaaaaaagaggctctgattgcctcctgtatcctttaaccccaatcattactctcttaaatgatatgccaccaattatttgataagcctctttcatggaatcttatgtgattctacttaatcccacacagggaatcagactattagaacccctgaatcaatattttcccaacctgaagggtggaaaacaacattttgaactttctgtaattcaaactaaaatatcagggtcttcaacagtatttcttaaataactcaaggagtactgttttagttaatgttgccataaaaaaaaccctgaaactggataatttataaagaacaaatatttatatctcacagttctagaggatgggaagtccaagatcaaggcaaaaggcaaaggcattgtgagagggcattcttgctgtgcccttacatggcaaaggcagaaaggggcaaacccactcctgcaagtgctttttatagcagcattaatccatttgtgaaggcaaagctctcattagctaaacaccacccattaggccccaactcacaacaccgttgcattggggattaagtctccagcacattaatcgggttgggaggatgcacattgagaccatagcaaataccaaaatctttttttatgagtcaagcgtcaaccaatgccaacatgagagtagaattcaatgagagtgacctgtaggccaagaaaaaatttccccgaaatcaacaaagtaaaaaaacctctacactagtgttaaagtccttattgactaactatatcaaaatagtggctatgatgaaattttagatcactaaaaaaaatactatctgtgataataagaatcagaagctatacactgaaaaattaacactgtccagatcatgaagtaactcacatgccagatataaaacttcagttttatacagggaatctgtaaaaggttttcaggcaattgaagatgtgatgaaaattgtgttttgtacagattgctttgtgaaaattggtcaaaatggatgatagtgataaatagagtcataaagaccagtttgggggctgctttattagtcccaactaaatattatctgagcttgaatttgggaagcgacagtacatttgaagagggtatattgatgaaatatttagaaaatgaaatcaatagtgtttgactaaacaattccaattctaggtgtacatttttttgtgtttacatacaatcttcaaaagtcatgtataaaatgaatatggtaacattatcaaaaaactaaaaaactggaaacaatccatgccaataaagcagataaattatagtacttttatataatggattactatgtagtgattaaaatttagaaaacattgctaaaatgcaacaatgtgagcaaatctcaaaaacacaatattcaacaaaagaagctgaatataaattgtacattctgtatgatttcatttatgtcaggtttaccaacaagcaatgtgatctatgccattagaagtcaggttaatggttacctttgatgagaaatataatgggaaggggccatgaggctgcttctgggctgctggtcatgtgctgtttctagatatatcaatatgttcactatgaaaattcatctaagtgcatatttatgtttagcatacttttccctacctagttttacttcattaaatattacatttaaaaatcaaaatggctgaatgatcaatcggatatgaggagaaaatgagtcatagaaattggagttaatcttgtaaccatgtttcacttattaggtgttttgagcatctattatgtacagtatgcatcacagacatgtacataaatgctatggaagtgttcagatttagaatattagaaattgccacaatggaggagatagtatttgaattaaagattagaggatggagtaagaatgtatcaggtagagattgcaaaggatgacattccaagcaaaaggaagattatagcataacagtgaacattcaggacaagtttgaatcataaaggggcttgaacaaaagctttgaacttcacttcatagaaatttaaaatgtttttgaatggaccagtgtcatgaaacaaggaggtatatcatacatgaaatgttttaggagggaaatcattcgttaaatgttttgaaaggatgagactagagtcaagaggattggggatgctggtacaatggtcaaggtgaagaactttgaatgtgcatgctgtctttatatcagcagaaatcaaaaaagcattgggaatgaacatcattgaaaagtcagtgtccatagaacttgacgggtgattggatgtggaggtcaaaggagatgtgacgcaaaagcccatgttaatgctagtaatcttgttaagtgaatgtgctgagatatagatcctaaagtgttatcaaacaactattgacatgaatgtcagccatgtgcctgcttaaaaataactgtcagatcctacctcagaaatcaggctctctgagggtaaggttcaaatatcatacttatttaagtctttcctgtgatttttatgaaaatttaatttaaagatttgtgctcttataagatatactaaaagggagagagttggtaaacctgttgtggaagttactaacctacaaatgaagtttaaaataacaaattcccacactagtttttagtatagcacaggaagttctgaaaatgtgtacaatggaattagaatgactgaatgctttgaatgagaatataataggacttcagtaagtgcatttccactagcaaagaactctgagagtaaaaatctcttgtttcttcagagcaggcaactgactttaatttcagctgcaaatatgctgtgagtccttttacatcctgtgccaacatgaattatttgccaactgtgaacccttatgaagagtctcattttatgcaagaaaaagaaatatgggcagttcactgggcttgtatccctactacatctcagagaaaatttcagcttccctggtgagaaagtgaacaaactgtatccaggcatggggccaaactttgcaattacaatcatgaaagaaaaatatcagcacaactgctggtaaaagtctgaagaattatcagaaactgccttagctcctgattattgatggcttttaattttacggtgtccaagctaacctgaaacatttatttaaagcaattacctaaatctcccaattagcccactaaactctatcagatattagtagtttgccatgtctgaagtaaatattacaggatatttaggcaataactcttgagtgaaggaagtttgcataggttgttctaaaagctttaaaaggaacatgtaaacattgaaagtcaccatccctggcaacatagtgagaccctgactctatcaaaaaaacctgtctacagtcatagcgactcaagaggctaaagtggaaggagagcttgagcccaggaattcaaggttacagtgaactatgatcaggccactgcactccagcctggatgacaaagcgagattctgtctcaaataaataagtaaataaataaataaactggaactcacctcagaaattatccatagtacactttgttataattctacagtaattcagattctagaagtctcagatatggtctattatttaaaaaaaatccaggacttgatcccaggcatccttgtttctggaaatatgtgcttttctctatagcaaattgactatctaatggcaggaaactacttatctcctttcatgccaagcattgaagtttctaataagcatgtcaagtcatataaagacaaaaacatttaactgaactttaagctaatattttttataaagggataatcaaaatgcagtaaaatttacctttctaaagtataaaattcacctttctaaagtataaaattcaatgagtttgacaaatacgtgtggctctatgatcaccatcacagtcatgttatatgacatttcatcacccaaaaatgttcctttgtacccctttgcagtcatttctcatacaccacccctcaatcccttgccactactgagatatttttgtctctgatgttttgcctttcccagaatgaaatataaatggaattatctatgatgtgtgtagactttgtatatggcttctttaacttagcataatgcttttgagattcatcatgttgaagtgtcattagttggttccttttcattgctgaatagtattctttggatgcaccacagtatttgcattcattcaaagctaatgggcatttagattgttttcggtttggagtgcttttgaatgaacctgctacaaaggtttctgtaaggtcttgtctggaccttagttttcagttcccttcaataaatgtgtaaaagtggaattgctgtataataaaataagtgtatgcttaatatttttaaaaaactgctatcagatctaagagtaatgttacccaacttataatataataaatcagcacattactgtttcacagacgttcatagaggactgaggtctctgggtcagacaaataactttattacacagcaagcagcatgagcgtctgcatgttcataccacttctccttgcaccgtagtagacttatgaagaacttaggaggattcctacatgggtggtggattaaattacaggagaagaacattgcagttgaggaatccacctccattatagcaagcaataagtaggtctgttctttatcccggaaaatatgttacttcatctctcagggttgctcactgtacacacaagacatgaacagtgaactattaaaaaaatgtaaagagtggtcatggctttgcatttttggcatactcagcaagaacgtgcaaagagcctatggttgatttcatcatccaacaatggccaaactagtctcaaaaattactttaatttcttacatcctaccattggtatatgaggctccaattgctccgtatccattttgagacttatttttattgtacttttccattttaccaatctagtgggattctagtggtatctcattgtggttttacttaatgaccaaagatggtgagcttgttatcatgtgcttatttgacatccatatgtcttatttgctgaagtgtctgcttatttacttggcacatttttattgggttgttttctttatattcaattgtaaaagttcttcaggtaatctggatacaagtcctttgtaacacatgtgttttaaaatattttatccctatttgtgacttacttcttttcttaatccatttgaaagaacttaagattttaatttgaggaaattcaattcatcaattttcttttatagttcggggtttttctgccttatgaaaaaaagctctgtcttacccaatacaacacagacttatccattgcttctgtatggctttacaattttagcttttatacatatgaccttttttgagttaattttacatacttttataaagtaagggttaatattaacttttgtatatatgaatatctaatggttccactgcaatttgtgagaaagactatccttttcaccacagtaaggaaaaatacaagtgggtctcaagatgggtaggaatggagaatttgtgtgaaagttgtggggggaaaactgtactatttcatctcacctccctttctcagacgagattcatgatttccaattaaattatcttggcagctttgttttccatgcatgggtagttctacttctatgtcttgttaggccaatagtacatagtcttgactacaggtagactaagtccttcacatttatttctctctttttacttacatttaattttataataagtttgtcaatttctgacacacaaaaaaagaaagaaacacataggttttgattgggtttgcactaaacctgtaggtaagtttggagaaattgacatcttaataatattgatctcatcatgatctccctatttacttaggattctgttaattttctcagagatctttttgtttattaaagttcaaattttatatatctcttattagatttattcctaagtattttgtatatattaattatattttaaatggtatggatttaattcaatttccaattgattgctggttatatgtatatgtatataatataatatatttaatatattatatttacttataaacagcatattttataatatatattatatataatatatactgtattactaagtaatacagtatatattatatataatataattatatatagtatatataaaattatatatagtatattatctataatatactatgtataatatactatattatatatacacacatacacacaaatgaattttgtatattagtgttgtagtctgtgaccttgaagtgaactcttttgtagactatgagatacttaatggaactagtgtctttcttagtagatgcttttaaatttttctatgtagatggttatgtaatctgtgaataaagatatttttatttcttcttttctaattttttgacttttttgtcacccttgatttgttcaaagttgtaagcagaaatcactctgtatttgatcattagacataatagctttttgttttacagtgtactttgtcagtttgaagaaattttcttgtattgttagatttctgtgggtgtttgcataaatggatgttaaattttgtcaaatgcttttttctgtatttatttagattttttttccattttagtctgtttatatggtgaattaaaattgacatgtgtttgaatgtttctccaatcttgcatagctagctttaactccatttgaccacaatataaagattaacctctttatatattgttgaatttaatttgctaatattttcctgaggatttttccctctatgtacaggaggaatattgatctataattttcttttcttgttatgaccttgcctggttgtggtatcagggcagtgcaggttttctaaaataagtttagaaatgattgcttctctctcatttttttgaaaatgtatggaattgatattatattttcctttattacctagtacaaattatccatgaagccatctagatacgtcactttcttggggaaagtttttaactaaaatttcaatttatttaatactgttttaaaattttaattgggaggacattaggcctacagcactttggattcctacataagctaacaaatcaaatcccactgtaaacagtaaaacaaaacttaagcttcaccatcagaaaccaccaactaacatataactgttaccagtggcaaatattggagtctcaccgcaccaaatatattaccagtggaaggcatgtgagttatcagcagcaaatccatgtgggtctgcagcaacttcaattcttacctcctcgggaaaaaaaaaaaaattgccccctcagaaaaaaagaatttttcttccagaagaacataaggcagaaaaagagtctgaagcaagtttcagagaagtagaagtttatttaaaaagaacggagagtacacttggaagagatccaagcaggcaagtgaaattcaagtgcagtgtttaattgtgaatctaggaatttataggaccggcccccttccggagtcttgcaaccctttcccatgattcttcccttagggtgagctgctcacatgtgcagttccctccttacccttaggagatgagcaggcacagtgtgtttaggaagttgtaggcacgcccatctgaggcttttcctccctttcctggtgaagtacccctggaaggtcatattccaccattttgtctcttaatgcacatacccaggaagttgcttctccctggcatctgcattcaattaacactttagtgcaactggtgtggaccatcaagaaatagcctctccctggtgctagctgccaacttatcacatttagagaggcaatgtggtaattgccaagccatcacccaacattcctagtaggtgggggagagtcttcttctgtcctgctcatacatgtctaactacctgtaacatatctaggggtatttcactttaagcaagcaaatatattttcattttcttgcttctgtgaacatgttatacaagtttcccctcataccccctcagtggagtgctaagctgcttgaggtctagtgctgcctgattcatgactgtctgcctgctccaataaactccttaaaattttaatgtgtctaagtttcttttaacaatacatatagggatattcaagaaattcatttctttttaagtgaactgtttcagcttgtgtattttgaggagtttgtacattttatctaattgattgaatgtattgtcacaaggttttttgtaatattcttttttaaaatttatttctgatattgataaattgtttcttaatcagcattggtagagttttgtcaaacagcacttatattatttgaggtctttgacaatagaaaattgcctgtgcctcttctagtgatagcagatctctgctttttgtctgtgcaagatcctggacacatttctcattttccatatctctctctagtgcaggtggctttgcttctgttcctccttcaatggtagtgtacttctacttggatgtttgggcaggaggatttcttgccccttaaccagcattaaaattctgttacatagtacaaagttcgtggtgtgtcccagggttttcctccccctccctcagaggcatacaacatttgttttatcctccatcaagatgtttgcagttgcttaaacctggatgctggagggttcttcccctctcctaaaaggtaaatgacttgctgattctattctaccccagagggaagattgggtttttgaagagctattaagtgtgggagagttttctgccccttgtccagtttcttaatgcttttggtttgtaagaggcaagagcccaaaaagtggaaggagatttttatctgtatgccactggctgtgaggactggggacaagggtgggttctttcaggtgacctgatctgccccctccgtttctcgtaagtacacatactagaagcctgtgaagaaaatgtttgttcgtatgcccaagattctaagctgatcactacaaactggtgttttaataaaatgttgaggaggtggagccaagatggccaaataggaacagctccactctacagctcccagcgtaagtgatgcagaagacggtgttttctacatttccaactgaggtaccaggttcatctcactggggagtgctggacagtgggtgcaggacagtgggtgcagcacatcgtgcatgagccaaagcagggcaagtcattgcctcccccaggaagtgcaaggggtcagggaattccctttcctagtcaaagaaaggggtgatagacggaacctggaaaattgggtcactcctaccctaatactgagcttttccaatgggcttaaaaaatggcacaccaggagattaaagcctgcacctggctcagagggtcctatgccctcggagcctagttcattgctagcacagcagtctgagatcaaactgcaaggtggcagtgaggctgggggaggggtgccagccattgcccaggcttgagtaggtaaacaaaggggccaggaacctcgaacaaggtggagcccaccgcagctcaaggaggccttcctgcctctgtaagctcgatctctgggggcagggcaaagacaaaaaaaagacagcaataacctctgcagacttaaatgtccctgtctgacagctttgaagagagtagtggttctcccagcacacagcttgagatctgagaacaggcagacagcctcctcaagtgggtccctaaccccaagtagcctaactgggaggcaccccccagcaggggcagactgacacctcacacgactgggtactcctctgagacaaaacttccagaggaatgatcaggcagcagcatttgctgttgaccaatatccgctgttctgcagccaccactgctggtacccaggcaaacagggtctggagtggacttccagcaaactccaacacacctgcagctgaggttcctgactgttagaaggaaaattaacaaagagaaaggacatccacaccaaaaacccatctgtacatcactatcatcaaagaccaaaggtagataaaaccacaaagatggggaaaaaacagagaagaaaaaccagcaactctaaaaatccgagtgcctttcctctgccaaaggaatgcagctcctcaccagcaacagaacaaagctggaaggagaaagattttgatgagttgagagaggaagtcttcagaagatcaaactactccaagctaaaggaggaagttcaaacaaatggcagagaagttaaaaactttgaaaaaaattagatgaatggataactagaataaccaatgcagagaagtccttaaaggacctgaaggagctgaaaaccatggcacaagaactacgtgatgaatgcacaagcctcagtagatgatgcaatcaactggaagaaagggtatcagtgatggaagatgaagtgaatgaagtgaagcacgaagagaagtttagagaaaaaagaataaaaacaaatgaacaaagtctccaagaaatatgggaatatgtgaaaagaataaatctatgtctgattggtgtacccaaaagtgacggggagaatggaaccaagttggaaaatgctctgcaggatattatccaggagaacttccccaatctagcaaggcagtcgaacattcaaaaccaggaaatacagagaatgccacaaagatactccttgagaagagcaactccaagacacataattgtcagattcaccaaagttgaaatgaaggaaaaaatgttaacggcagccagagagaaatgttgggttaaccacaaagggaagcccatcagactaacagctgatctctcagcagaaactccacaagccagaagagagtgggggccaatattccacattcttaaagaaaagaattttcaacccagaatttcatatccagccaaactaagcctcataagtgaaggagaaaggaaatactttacagacaagcaaatgctgagagattttgtcaccaccaggcctgccctaaaagagctcctgaaggaaggaataaacatggaaaggaacagtcagtacaagccattgcaaaaacgtgccaaattgtaaagaccttcaaggctaggaagaaactgcatcaactaacgagcaaaataaccagctaacatcataatgacaggatcaaattcacacataaaaatgttaacgttaaatggaaatgggctaaatgctccaattaaaaggcacagactggcaaattggataaagagtcaagacccatcagtgtgctgtattcaggaaacccatctcatgtgcagagacacacataggctcaaaataaagggatggaggaagatctaccaagcaaatggaaaatgaaaaaaggcaggggttgcaatcctaggctctgataaaacagactttaaaccaacaaagatcaaaagagacaaagaaggccattacataatggtaaagggatcaattcaacaagaagaactaactatcctaaatatatatgcacccaatacaggagaatccagattcataaagcaagtccttagtgatctaaaaagagacttagactcccacacaataataatgggagactttaacaccccactgtcaacattaggcagatcaagagacagaaagttaacaaggatatccaggaattgaactcagctctgcaccaagctgacctaatagacatgtagagaactctccaccccaaatcaagagaatatacatttttttcagcatcacaccacacctattccaaaattgaccacatagttggaagtaaagctctcctcagcaaatgtaaaagaacagaaattatacaaacggtctctcagaccacagtgcaatcaaactagaactcaggattaagaaactcactcaaaactgctcaactacatgaaaactgaacaacctgctcctgaatgactactgggtacataacaaaatgaaggcagaaataaagatcttctttgaaaccaacgagaacaaagacacaacgtaaccggaatctctgggacacattcagagcagtgtgtatagggaaatttatggcactaaatgcccacaagagaaagcaggaaagatctaaaattgacacccgaacatcacaattaaaataactagaaaagcaagagcaaacacattcaaaagctagcagaaggcaagaaataactaagatcagagcagaactgaaggaaatagagacacaaaaaacccttcaaaaatcaatgaatccaggagctggtttttgaaaagatcaacaaaattgatggaccgctagcaagactaatgaagaagaaaagaaagaagaatcaaatagatgcaataaaaaatgacaaaggggatatcaccactgatcctacagaaatacaaactaccatcagagaatactataaacacatatacgcaaataaactagaaaacctacaagaaaaggataaattcctggacacatacaccctcccaagactaaatcaggaaaaagttgaatctctgaatagaccaataacaggctctgacactgaggcaataatcaatagcttaccaaccaaaaaaagtccaggaccagatggattcacagctgaattctaccagaggtacaaggaagagctggtaccattgattctgaaactattccaatcaatagaaacaaagggaatcctccctaactcattttatgaggccagcatcatcctgataccaatgcctagcagagacacaacaaaaaaagagaattttagaccaatatccttgatgaacattgatgcaaaaatcctcaataaaatactggcaaactgaatccagcaacacatcaaaaagcttatccaccatgatcaagtgggcttcatccctgggatgcaacgttggttcaacatacaaaaatcaatatacgtaatccagcatataagcagaaccaaagacaaaagccacatgattatctcaatagatgcagaacatgcctttgacaaaattcaacaacccttcatgccaaaaactctcaataaattaggtattgatgggacttatctcaaaataataagagctatctatgacaaacccacagccaatatcatactgaatggacaaaaactggaagcattccctttgaaaactggcacaagacaaggatgccctctctcaccactcctgttcaacacagtgttggaagttctggccagggcaatcaggcaagagaaagaaagaaaggggattcaattaggaaaagaggaagtcaaattgtccctgtttgcagatgacatgattgtatatctagaaaaccccatcgtctcagcccaaaatctccttaagctgataagcaacttcagcaaagtctcaggatacaaaattaatgtacaaaaatcacaagcattcttatacaccaataacagacaaacaaagagccaaatcatgactgaactcccattcacaattgcttcacagagaataaaatacctaggaatccaatgtacaagggatgtgaaggacctcttcaaggagaactacaaaccactgctcaatgaaataaaacaggatacaaaccaattgaagaacattccatgctcatgggtaggaagaataatatattgtgaaaatggccatactgcccaaggtaatttacagattcaatgccaccctcatcaagctatcaatgactttcttcacagaattggaaaaaactactttaaaattcgtatggaaccataaaagagcccacattgccaagtcaatcctatgccaaaagaacaaagctggaggcatcacgctgcctgatttcaaactatactacaaggctacagttaccaaaacagcatggtactagtaccaaaacagagatatagaacaatggaacagaacagagccctcagaaataatgccacatatctacaactatctgatctttgacaaacctgacaaaaacaagcaatggggaaaggattccttatttaataaatggtgctgggaaagctggctagccataagcagaaagctgaaactggatcccttccttacaccttttacaaaaattaattcaagatggattaaagaattacatgttagacctaaaaccataaaaactctagaagaaaacctaggcaataccattcaggacataggcatgggcaaggacttcatgtctaaaacaccaaaagcaatggcagcaaaagccaaaactgacaaatgggatctaattaaactcaagagcttctgcatagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagtgggcgaaggatatgaacagacttctctaaagaagacatttatgcagccaaaaaacacatgaaaaaatgctcacatcactggccatcagagaaatgcaaatcaaaaccacaataagataccatctcaaaccagttagaatggcaatcattaaaaagtcaggaaacaacagttgctggagaggatgtggagaaataggaacacttttacactgttggtgggactgtaaactagttcaaccattgtggaagtcagtgtggtgattcctcagggatctagaactagaaataccatttgacccagccatcccattactgagtatatacccaaaggattataaatcatgctactataaagacacatgcactgcacatgtatgtttattgctgcactattcacaatagcaaagacttggaaccaacccaaatgtccaacaataatagagtggattaagaaaatgtggcacatatacaccatggaatactatgcagccatacaaaatgatgagttcatgtcctttgtagggacatggatgaagctggaaaccatcattcttagtaaactatcacaaggacaaaaaaccaaacactgcatattctcacttataggtgggaactgaacaacgagaacacatggacacaggaagaggaacatcatactccggggactgttgtggggtggggcgaggggggagggatagcattaggagatatacctaatgctaaatgacgagttaatgggtgcagcacaccaaaatggcacatgtataaatatgtaacaaacctgcacgttgttcacatgtaccctaaaacttaaagtataataataataaaataataaaagaaaagaaaatgttgaaatttcagttgttttgtcttaccaactagtagggcagcttctttatttctcttgtgttctgctcaagatgaaatggttcataggcccttttaagggatgtgtctccctttggcctttagttcaacacatcggcttgaatacccatgtctctgatgagtttcagaaaagttagggttttgtagatatttgtatattttttctttgttgtcaggataagaacgatgtactcctgcagctttctgcaacctagaaagctccagcaacattttgtaaattatccattactaaactatattatatcgtcactggaagactggtcaacaatttgtcaatatgacatttaattacatttttatactatcaaatcaatcatttaaaagtaacttgatctataatattgattttataagaagaatgacttcttatgtactcaaagaagacaataagaatatatacatatgtatgtgtgtgtatatatatatatgtaaagttgtgaaatgtttgtaatgagacactgcattttggggagtgagaataaaatagtaaatatccacaaattctacaacattggaactagaaaaaactattaaagttaatgagcagaaagtcagagttaaacaagatagaaaagattcaaccatttacaaaagaaaaggtatcaaaagcatgtaaagcaattctagtggaaagggagaatatgagtgattgggctatttacataattatgtaccactgtgctcagtatggaatttcaaatttaagtacatattagcaaaaataggcatgtgaaataactaaacagtttcaaatatctcaagcaaaatatatatgctatcatatgcacacaaacaaacgtaagtaaaattaattttttttgttaattaaatacttactgtatttggtttcttatcattttcagtctctatttctgatatgtcctatggcagcagaaatggggttagaggtggggatttatatcaaaaatcttaagaggcttacttgataagcagtaaagcacacagaaattgcaaataacttttagatttctggttcaagtgatttgcctaaaaactggtgtaactcatagatgggaaatgtagattcaatgacactttcaaggattgtattggcatgatcatttcctgtagttgttagggtcatgtcaagtttgagtaatctccgtatggtcattccattaaaaaaaatttattgaatgttaatgttctcttgaatttcttgcattgcgattgaccaacaactgcaaaataaaataagggaaggggatcctgaaaacaacatgtgaagaaaatgaagttctattaagctttatacactgttttttttttttaatttattgagagactgttgagctcagatgacttcagcgcctaaggttcctccataaacagatcaaaacgcaacccgaaaacaaataaaacgaaacttaggcttaaccaatacaaaactgccaactaacctctaactagggactttccactttaaccaaccaagtatcattttttgtcttgtttccacaaacaccttataaaagttttccccttgagacctctcaatgaaggcctgaaccccttggggtctagcactgcttgattcatgagtcactgtctgctctaacaaactctaacattttcatgtgccctaggttttattttaaatacctagtaccttaaatcagcacaatgcagtagaacgcatttattaaacaaactaattgttctctggggtttttctgaggctcagaagaggaaaggaggacaaccattgccattgtttccttcttttatggacaaagcacttttgctggcagtggaacatgtctgagtcactcaagcaccaaagtatgttatcagcagcgaatctgtatgagaccacagtaacctcaattcttgcctcctcagaagaaaaaattcaactgaagggcataaggcagaaggagagaccaaggcaagttttagagtgggagtgaatgttaattgaaagctttagagcaaaaatgaaaaggaggaaaatacacttgaaagcgagctgagtaggcgacttgagagatgaagtgcaggtctgaccttttgacttcgggctttatatgttgtcatgcttctggagtcttgacttccttcttccctgattgttctcttggagtggggtgtccatgtgcagtggcctgccagcactttgaaggggctgcatgtgctgtgtatttactggagttgtacgcaggctcacttgaggctttcttctcttacccgtagaatgtccctagaaggtcatattccagttaaactctgccatttcacctcttaataaacatgcctgagcccactcacccaggtgctgcaatcttattggattaattcatatactccattcttcattgctgaaaaaaacctgatcaccagttttaggtttttttctgtctattgggagacagcctttccctggtgcctgctgtcatcaattattattttagaagaacagtttaataactgcctatgcatcacttgatggttgtctgacattcctggtggtgggttgtggggagagccctctcctaccctgctcatttctgactagctatctactgtaacactttaagtgaaaaaaaaatgcacaaatctctgtggttggaattttctgttatttgaattaaaaaaaccagagatgttttccaatattcatgtgagtcaaatatttcactgagtgtgatgaaaacaggctttatttcctctctaactggtaaaaatattaaaacaaaatttgatagaatgaaatctataaacaaattataaaaacaaaatttgatagaataaaagctctctctttcttttgtattagatgaagaaaccaaaaatatgtgctttaactgccgatatataccctcttttcagatgggtaaccaatcttcagcctgcactcttcttgagtgcatcctgaatccctgagacccccttggtcctcagattctggagagaggaaaaaatgccttttcctcctctgtcctctcttccagatggttaagcaatcatcttcagcatacactcctctagagtgtatcctgaatcactgggactcctttgaccatcagactcttgagaaaaagtgcctcatatttctttgcacatagccatggccgaattatgttctgcagaaaggagaagcatggcctcaagaaggaagcataaatttcaataccatcctgaagctggaccctctctgtaaacatgaaggcaaatgatctgaggttccatatgtgcaggctttcattgtcttgcagggtaatccagacctttgccaacactgtaggattgattcagtcctcctagtggccatctcaggagaggcttcagggaactagggaagcaaaccccagaggtacttccagcaggagattcaactcccttcactcctccctatccaggtcctctctcaagcttgccccagcctagaaatctttgttttaggcaggtcccagtcttactccttcccccacaacatatgcctagtgaatgtggccccattaagatctaggtccccttttctctacaggatttaaggaaaattaagggagatcctggcaaatttttagaccattctgacaggtatatagaggctttccagaatttaaccaaagtatttgaactctcttggaaggatgttatgttacttttgaatcagaccatgactaccacggaaaggcaggctgccctgcaagcagcagagactttcaggaatgagctttgtatctcataaagtgccagggaaggggatgagcctcatccaattggaagacaagaggtatcattggaggaccataaatgggaccacaatgatgaagtgaaagaacagaagaggcaacactttcaggtgtgcatgctggagggctaattgaagaactagaactaagtctctcagttaccccaaactatccatgatacaccagggattgggtgagaatcccactaccctcctggaaaggctaacaggggccttggtaaagcacaccgctctatctcctgattcagtcaagggacaactgatccaaaagaataagtttataactcaggcagaccctgattatcaggaggacacttccaaaacagtctataggagcaaacagtactttagagaacctcctaaaagtggccacctctgtttttacaatagggattaggaggaagtccagaaaagaaaagaaatacaagaataaggcagagtctctaatagctgccatgtaggctcacaaaccccagagtctctgacatgtacctattatcggctacaaatgtggcaagtcagggtactttaggaaggactatccaggcaacatgagaaagccaccttgaccctgtccaatttgtaatgggaaccactggagggtggactatacccagagacacaggtcacttggtccagagccagtctcccaaatggtccagcaggactgactggtcttggagcttttctccctggctttggtggttcagaccaccattaccatccagacgtcccagttaattctgggagttgaagggaggaagacggacctcctcctggacaccagagtgggcctttcagttctcctctccaatccaggctccccttcctctcttagcatgactgtgaggggtgtttcaggaaatcctttaccctgatatttttcccaaccccttagttgtagttggggagactacttgtttactcatgccttttaaatcatgccttaaaggccaactcttttgttgggcagggatattttggcttgtatgagaaccaccatccttatggctccaggacaaactctttgtctccccctagtggagaccgatattagcccagaggtttgggcaactcaagggaaaattggcttagccacaactgccacactggtccagatccatcttaaggattctacctccttccctaagcagagacaatatcccctaaaaccagaagttataaaaggactagaagccatcattgataacttgagaatgcaacatcttctcaaaccctccaacagcccttctaataccctgatattcagggcccaaaaacccaatggggaagggagactgatccaggacttctgcctctttaatgaagctgtggtttcaattcacccagtggttctcaatgcctataccctgctaactcaagtacctgagagaactaaatggttcacagtcctggacctaaaggatgcctttttctgcattctgctacaacccaactcccagtatttgtctgcattcaagaatctctccaacaaggccacccagctaacctagacagtgttacctcagggattccaaggcagcccccatctgtttgggcaggcattgtcaatagatctgagtttctttatcctcaggttaacattttacaatatgtagatgacattctccttcatgcccccactgaggaattatctcggggggacaataaggctcttcttaattttctggctaacagaggatataagttctcaaaagtaaaggctaagctctgtcagacttcagtgaagtacccaggtatagtcttgtcagagggtaccagggcactaggtgaggaaagaatcaggcccatcttctcctttaccctcccccaaccctcaagcatctgaggggattcttggacattacaggattctccagactaagaatacctgggtacagtaaaatagctcatcccttatgtcacctaataaaggaaactcagccaagacacattccctaacttgggaaccagaggcttaaacgacctttgaccaattaaaacaagtcttgcttgaagcaccagccctcagtcttctcattgggtagatgttcaatctttatgtctcagaagggaagggaatggccctgggagttctaagccaggtctgaggtccagcccagcagcctgtaggctaagtaagtaaggagcttgatttggtagctaaaggatgatcagcctgcctccaagcagttgcagtggtaccagaggctactaagttaaccatggggaataacttaacaatttataccccacataatttggccggactgctgtcttctaaggagagtctctggctaatggacaactgcctccacaaatatcagaaggatcttcaatccagttaagaactaatccctttctaaacccagccatcttcctccaagaggaagctggggatcttaaatgtgagtatgaacaaatagtagtacaaacctatgccatcatacaggacctaaaaaaaaaccttagagaactcagactggactctttttatggacagaaattccttcgtagagcaagggatccataaaacatagtatgcaatagtcaccctgaatgacgctattgagagtgcagctctctcctcggcacaaatgttcaactagctgagctaatcgtcctcatgagagtgcttgaattaagcaaggggaaagcagttaacatttatcctgattcttattatgctttcctagtcctccatgcccatgtcattatctggaaagagagggacttcctcacagctaatgggtctcccattaaataccatcagaaaattaacagactattattctcagtcttctttccacaggaagtggcagtaatacactgtaaaagccaccaaaaaaggatggatgaaatagctgagggaaatatgttggcagacaaagcatataaatcagcagtgaaagggccccagatttctgatgcacttgagacccctctgatctgagagggctccttaaaagaaataaaacctcagcattaccctgtggagatagaatgggctgcctcttggggatacacccttcagtgttcaggatggctgtaatcagaggatggcaagcttcatctaccagcttccagccaatggaaagttcttaaaatcttccaccaagccttccatgtaggaacagaatgggagggaccttacactgcacttctttctactcctatggcagtaaaggtcactggaataggttcttggattcattgtgcttgaaaaaaaggcataggaaactgacaaaattacctctgctgattcaggagtgcagtaaataaatcatggacctcaaactaaacattataaaagataagtgctaacaattaaccctccatggatatcctatacttactgatttcacttttgttctgttcatcaccataagacatctttgtcaagaaccccttaatcctgaactccccggggattatctactcccctaaacagttatttctcttttaatgtttaactgcccccacacaagattgagcttatttcaccagggtgaaacagctccaaccacaacattgttttcagaatgattagtttattttaattcttatttctgttatctttggcactagattttttttccttcacatacttaacctcctgtaaattgtgtttatcttcttgcatagaggtcattaagctccaagtggtcatgagactagagcctcaaacaatggcttccttcttaccagggactattatataggcctctgagagagatctgactgcccccttccccaaaacaatgtgctctgtcagcaggaagcagttaagaacagtcttcatttctatcttaatggcagttaggtgtacatcttcagtggggggtttgatggcagtggctggagtggctgctgtgaagacaccagttgcagaaggggacatgtggctggcattgcatgctctgcagagccggcaggggtcaagaaaatgtgaagccctgccccctactgactaggtggggcaggagacccatgctcctgggtacagctgcagccacccagcacaactctggacctgggcatccctgttctctcagggacccaggaagaccctgctacccccacaggttctgaagtacctgttcccactccctggcctccccctgctcctggtgtctgctccaataagagcaaagttgtagctgagcccaatctggcaaggtgtgcacacacccagggtggtgctgacatgccagacccctgctgcctcagactcctccagacttcaggcactgacaagcatggaagggagaccaggggtgctgagggcagctcggagtgggcctgaaagcatcccttggcccagacagccagggccctgcagacaacatgttgatgatgacaggaggcagtcacattcctggatggaaaggggcggctccccagtgaaacccctccttcaagctaggaacagcctgaagcctggaggccaggctgccacttccaggtggagtctgaggcccagagtgagaacttatggtcctttttccaggcccactcatggctgcctatggaccagtcagcatgcactttctcttttctgagcccataaaaaccccagactcagccagattcacacagatgtcagaagttccagctgcagaaaggagctagccaatttggatctccttgactcattgggacaacctgcttggggaaaggagctactcacaacaggtctcctctcttctgagagctggacatttgttgggagaacctgcctgcgaaaaggagctacccactccaggcctcctctccgctgagggctgcactcgtcaggaccacctgtctgcagaaaggagctacccactttggatctcatgagacctgttctgttgtttaataaaactcctctccaccttgctcaacctccagttgtgcacatacctcattcttcctggacacagaacaagaactcgggacctgctgaatggtgggactgataaagagctgtaacacaaacagggctgaaacaggcatgctcacccccgctcaccaaattctgggtgacaaaaaggagagaagagctgtggcccttcaggaagcccagacctaggggctccccaagccagggctttgacaccctctttggggctctgtgttttctggcatctccaatattctgggttccattgcattccccttttccacatgtgggtgcccacagcagaagctgcttgtgggtgcatctgatccagcttcaggcttgcacagagctggtgcctctgccagcacctggagctgcctgccccatcacagcagccagcacgcctggctctgtgtagtgggtggactctgcacttgttgctcatgtttcttcactgttccacaccttgcttgaccttggcgggtgtggaatccaggccagtagtgtgagccaaacacagcctgccaggttgagtgggtgaaacatgcacagtggcccctagcaaaacttgggcaaaggtgtcactggccacagaggtttccagctggaaaatgacacccgaaggatctggtgatactatctcctatcattcctaatgtatctagaatatattctgttttttcattccaaatttatgattgattttagtccaaatctcattattttttgctaggactatgacaacggctttctaaatggtctatctctgttttggtttttccagttttatgtactctaatcatggtcttcatcacttctctgctaagaacatcaatggttacacactgcctgagtatactattttaagttatttagtctgtcaaaatgctccacaatctattgttaatctacttttcttagccattacttttttccttcaaatatcttattccttgtccaccctacaatatttcccatgtatacctcaccttgttttctgtgtttctttgcccactcactttccttttctgagaaaggaatttgccaagtcactctattaaaaaaatcctctatattttatgagtagcataggtactctgttgatatggtttggctgtgcccccacccaaatctcatctggaattcccatgtgttgtaagagagacccagtgggaggtaattgaatcatgggggcaggtcttttctgtgctgttctcatgatagtgaataagtcttatgagatctgatggttttacaagggagagtttccctgcacaagttctctcttcttttgtctgctaccatgtgagacatgactttcaccttccaccataattgtgaggcctccctagccacatggaactctaactccaataaacctttttcttttgtaaattgccccatctcaggtatgtcttaatcagtagcatgaaaacagactaatatatctgtaatttatatcattccctgagtatgccaaatcatttcatgattccatatattgataatgcttattatgattgaatgttctttctataattttctagccctgtgtaagaaacaggtcaactgtttcttctgcaaggaattgtgttttacccaggtgaaactagcgtcattcttttctgtattcctaatgaaagattgttttgttttttgttttgtctttctttttcctgcttattagttttatttatttttcttggcctcatgcattgtcccagatctccatgacaatattgacagaagtaagaacaacagaaaattatgtctcatttactactgtcaggaaaaatatttcaatattttatcacttgatatcatattggctgtagacgttctaaagatatccttttatcagattaagcagttttccacttatttatagattgctaagtgtttatttaaagtacattaaaatttatcagatactttttccgtctctattgaggtgattaattaatataattttctcctttattctgttcaggtagaggattatattgatttattttcacatgttaaaacaattagatatttctagagtgagacttcgcactgggttcacttagataatattttggtaagatttttgtatctttgtttgtgagagaaactaacatataattttcatttttgtaatgtcctgttcagattttaaattttaggttatactgtttatataaaaaatatgaagcagtcttaatctgttatgctctgtaagggtttattaaagttgaatgttttccttccttggaagtttggaagattcaacaatgacactctctgagtttaaacttttctggtaaataaatgaatttagacatttagtttgtctttgatgtaatactatttatatcttttattttgtttttgatagttttggtaagatgcatttttccaggaattctccattttatttatatttttaactttaagagaataagtacataatatattttagaagttttaaaaatgtccataaaatttataatgtctactttttccactcccaatattagttatttattggctttttattgctcttttcagataattttgtattttattgatatttcaatgaacaaaattttggctttgttgaaacactgtattttaattagttgtctataactttgattatttctaatttttaatatttcatgcttctgcattctttgggtttgactttttctgtttcttagctttgaaatgaatatttagattattgatttttctctactagtattttttaatataaacatttcagaatgtatctatctgactaaccatggttttaactacatctcacatggttaaaattgttttatactcttttttatattttgtttttaaatgacacataataattgcacatatttatggggtacagtgtgatgtttcaatacatgcatacattgtgttatcaaattaggttattgaaaatatacattgcctcatatatttatcatttatttatggtaagaacactcaaaatcctcccttctagttattttgaaatatacaatacaatgttgttaaccatagtgcaccctactgtgtaatagaacaccagaacttactcctcctgtctaactgtaactatacctgttgaccaatctttctccatgttgtctcctccctaccttccccagcctctggtaaccttattctagtctctacttttatgagatcaatctttttagatttcatatatgagtgatatgctgtgacttttgcctttctttgtctggcttattacacttaaaataatgtcttctaggttcatccatgtggctgcaaatgacagcatgacattcttctgtatgacagacagcattttattatttatatagaccattttttctttatccattcatttggtgatggacacttaagttgattctatatcatcacggtgtggatagtgctgcaaaaacatgggagtgcaggtatctttttaacatactgattttattttctgtggatatatatgcccagtagtgggatttctggatcacatggtagtcctatttttaattttatgaggaacttctgtactgtttttcacaatggctgtgctaatatacagtcccactaacagtatatgaattcctctctttacatttacgcactaacatttgttatcttttgtctttatgataatagccattctaattggggtgaggtgaaatttcattgtggttttgtttttcatttcctttatgattagtgatgtcgagcttttttttatatgcatcggctatttgtatgtcttcttttgagaaatgtccattcagatcttttgcctattttttatttttttttttaacttttaacttttattttaagttcaggggtacatgtgcaggtttgttaaataggtaaacttgcttcatgggggtttgttatacagactatttcatcacccaggtattaagcctagtacccattagttattattcccgatcctctccctcctcccaccccccgaccctccaataagtcccagcgtgtgttgttcccttctattgtgtccatgtgttcttatcatttgcttccacttgcaagtgacaacatgtgatatttggttttcttttcctgtgttaatttgctacagataatggcctccagctccattcatgttcctacgaaggacatgatctcattcttttttatgtgcccatttttaattaaattatttgctttttaaaattgagttatttgagcttcttatgtattctgtatgttaactccttgtcagatacatagtttgcaaatattttcttccattatgcatgttgtatgttcactctgttgactgtttcctttgctgtgcagaagttttttagtgtgatgtaattttatttgtctattttttctttcgttgactgtgagtttgtgatcttattcaaaaacttcttgcccagatcctaatgtcatgaagcgttttctctgttttttttttttttttttttttggtagttttattgcttcaggtctgacatttaagtctttaatccatcttgcttgtgttgatttttatatatggtaagagatagggatgtagtttcattcttccacatatatccagttttcccagcatcatttactgaagcaactctcctttcttcaatatgtgttcttggtacttttatcaaaaatctgttggctgtaatgcatggactcatttctttgttttccattgtgttctattaatcaatgtgtctatttttatggtagtaccattctgttttggttactatagctttgtagtaacatattgtaaatctcggctttgttctacttgctcaaaattgctttggttatttgggatcttttgtgattccatacaaattttaggattactttttccatttatgagaagaaagtcattagtatttttacaagcaattcgtcgaatctatagatcattttggatactatgagcattttaacaatgttaattcttcaaatccataaacacaggatatttctccattaatatgtgtcctcttcaatttccttcatcagttttatagttttaattgtagagctctttcacctccttgattaaacttattcctagcatcttaattttttatacctattgtaaatgagatttttttttcagattgtttactactgtatatagaaatgctattaattttgcatgttgactttgtatcctgcaacttcactgaatttgtttgttaattctaatcagagtctctaggacttttaggagtcctttgagttttttatgtataagatcatgtggtgggcaagcaggaaaaatttaactttattcttttcaatttgcatgtcctttatctctttcttttgtctaatttctcttgtctcattactctggcaggaattccagtactattttgaataaatagtgacagtggacatcctttaagtttggtctgataattccaaggcttgttcaatctcttcaaactgtgtttattgcatttcagtatgcttggtagttttttgtttttgaaaggcagaaataatatactgtgtaaaacgaactacagtatataggtctttattaatacagagttaagaagttgtggggagagataaaacattctatcatcctatattaggactcaggcttttggtgagcctgtgcacttggactgtgaacttaacaaggacttgaatattttccacccctaggtgatgcagcatgagtggagggagttggaggtgagtacttcctaactcctgaggagattaggctctgatgtagccccagcaagttaggctctagcaaaatagtgtctcctaagagcaggctttttaaagaagagcacgatggtgtgctgtatttcaaaccgcagattcaggaaacaaaagaacatgaagcaggataaacgcaaaaaaaaaaaaaaaaattaaaaaaactacacctaggcataatatattcaaatttcagaaaatcaaagctgaaggaaaaatattgaaaagagccagagggaaaaaaatgccttccctgtaatggagtaaggataataattaaatctgacttgtcaaagcatacaatgaagagaagagtggagtgaaatatttaaaatgtagagagagaccaaaacaacaacaaaaaaatcacacacacatacacataaaaaaaaaaactaacagaatttgtatcttgaaaaattatccttcaaaagtgatgtgtgtgtgtgtgtgtgtgtgtgtgtgtgtgtatatatatatatatatatatatatatatatatatatatatatatttttttttttttttttttgtgagagagattctcactcttttgcccaggctggaatgcagaggcatgattatacatcatcatactctcaaattcctgggcacaaatgatccttctgcctcagcttcctgagtagctaggactacaggcacataccaccacacccagctaatttgttttttggtagagacagggtcttgctatgttgcccaggctgctcttggacacctggcctcaaccaattctcctgccttggcatcccaaagtgcttgtataacaggcataagcccaccatacctggcctcaataatgtgtatatacttaatatatgtaagtatagtatatacatatgtgtatgtgcacacttaaatataagtgaaaagaataacagaaatgatacaagtggcaggaggaaagaactaggaatatcttattattataagatacttgcactagatgttaaatggtatagtgtgatttgaaagtggaagtgaattggttgaatatgtatattgcaaattccaggaataccactgaataaaagtaatttaaaaagagtgtagttgatatatgatagaataggaaattggaacattaaaaatgctcaattaggctgggtgtggtggctcatgcctgtaatgccagcactttgggaggccaaggcgggtggatcacttgaggtcaggagttcgagaccaacctggccaacatggcaaaaccctgtctctgctaaaaatacaagaattagcctggcatggtggcatgcacctgtgatcccagctactccggaaggtgaggcaggagactcacttgaacccgggagtcagaggttgccgtgagtggagatctcgccactgcactccagcctgggcaacagagcaagactctatcaaagaaaaaaaaaagctcaactaaaactaataagtacagaaaaaaatgtgaaagaacaaaaaaggcaacaaacaaaaaacaataacaaatacagtagatattataatatttatgccacaataccaataattaccttaaacatcaattttacttttttttttttttttttgagatggagtcttgctctgtcacccaggctggagcacaatggtgcgatcttggctcactgcaagctccacctccttggttcacaccattctcctgcctcagcctcccgagtagctgggactacagatgcctgccaccacgcctggctaatttattgtatttttagtagagatggggtttcaccgtgttggccaggatggtctcgatctcttgaccccgtgattcacccacctcggcctcacaaagtgctgagattacaggcttgagccaccctgcccggccaacatcaatgttttaaatccaccaattaaaagctagggattgtcaaagttcatcaaaaaacgataaccaattatgtgatatttatgagaaatccactttaaatataaatacatgtatagtttaaaagtaaaggagtggaaatgaattaggttggtgcaaatgtaattgcgatttttgccattcaaaataatgccattacttttgccattgccattacttttaatggcaaaaatcgcaattacttttgcaccatcataataatatgttaacattaaacaaaacagtagaagtggctatattaatttcagacagaactgactcaagagcaagggaagctattagggctaaagaagggcattacacaataacaaaggggaaaatactccaagaagacataacaatcctttatacgtatgttcccagcagaagggcatcatgtaaagcaaaaacttatagaacgacaggtagaaatagataaattaatgatagcacttggacaccttaacactcctctatgagaaatagatcccacaggcagaaaatcaattaggacataggagaactcaatagcactatcaataaactggctataatggacatctatagactatttatacaaaaacagtggattacacatttttcttaagcttacatgaaacatttaccaggatagacctcatttggggccatgaaactcaccctaacaaatttaaaagaataaaaatcatacaatgtgtgctctcaggctacaatggaattaaactagaaattaatatcaagaagacaattgtaacccctcaaatacttacatattaaaaaacacatgtctaaaaacacattggtacattttaagtgaaaacagaaactcaacatgtcaaaatttgtgggatgcagggaaagcagtgtttaatgggaaatttatactattgaatgtatacattagtaaagaagatctaaaatcaataatctaagctctcaccttagaaaaactagaaaattaaagcaaattaaatccaaagtaaggaaaagaataggtaataataaaaattagagtagaaatcaataaagtagaaacaggaaatgacagaaaatcaataaaaccaaaagctggttctttgaaaaaatcaataaaattgaagagaatctagccaagctcatgaagaataaaaacagaagacacaaattactagtatcagaaataaaagagagagcatcactacagatcttatggacattaacatgataataaatgaatattatgaacaattctatgcccacaaatttcataacctagacaaaatggacaaattccttgaaagacacaatctgccaaaaccgatgcaagaaatagacaatctgaataggcttatacttaaaaattgaatcaacaattgattatcttccaaagcaggaagtagtaggcccaactgggttggctggtaaattctaccaaaaacatgtgaagaagaaattatacaaattctctacaattattttgcagaagatagaatcagaggggctactttctcactcattctatgaggacagcattaccctgataccaaaatcagacagccattagaagaaaagaaaagtataattcaataactctcatgaacattgatagaaaaatcttcaacaaaacattagcgaatataatacaacaatgtattaaaataattataccccaactgggatgtatatcagatatataaaactgattgaattttttaaaatcaattaatttagtcatcacattagtgggctaaatgagaaaaataaaactcaacaataagaaatttaacaacctgattgaaaaatgggcaaaagacctgaatagacacctcactaaagatatgtaaatggcaaattatcattaagaaaagacattcaacattacatatcatttggaatttcaaattaaaactataatgagataccattacatacctatacaaatgaccaaaatccaaaatactgacaacaccaaataccagtgaggatatgtggcagcaggagctcttgtttatggctggtgagaatgtaaaatggtacagccactttagaagatacatggtagtgttttacaaaaccatactgttaccatataatccagcaattgcactttttcgtattaagtcaaatgaattgaaaatttggtattttcccaaatgaatccaaataaattgaaaaatctgtatttaaagtagctgtacacatagttgccaaagcttggaaggaaacaaaatatcctccagtggccaagtagataaattatggtacatctagacaatggaatattatttagtgctgaaaagaaatgagctatcaagccatgtaaagacatggagggaacatgaaggcatattactatgtgaaagaagccaatctgaaaaggaaacatacagtatgatatcaactatatgacattctggagaaggtaaaactatgaagaccgtaaagaaatcagtggttgcagggattagggggaggaaggaatgaataggtaggcagagcatagaggatttttagagcagtgaagctgttctgcacatactgcaaagatggatacatgtaattatacatatttcaaatcccattcaatgtacaccaagaatgaatcctaacataaactattgactttagatgacaataacttgtcaatgtatattcatcaatcataaaaatgtacccctctgatgtaggatgttggtaatgggaaaggtcatgaatgggtgggtacaggatatatgaaaacactctgtgctttttgctgaattttgctgtaacctaatattactctaaaacataaagtttattagttaaaaaaattaacagtcacttcattgctttgtttttactatctcaaccatattgcttttaaatggttgaatttaaaaatattcagttgattcaattaactcattaatcagatattttcctctccactttcttccctttctttcatatgcatgatatttagttttatagacttacaaaaggatacatattcaactatttgttgacattttctcctattacttcaccaagataaagatatacttgtttatacttcctcatctggtcttttcaaataatttatttttattgtctgtactgacagataccttcaagttcgttataacatggtaaggaggggcctttttaaccaagtgaggaatcttaacccttacctttgtgcttcctactagaaacagcctagaaggtgctgaaatgcagactcacagctataaactggcaaccatattttatcactgaagtgactagattttgtcattctaaagttactcaccagtaccagtagagataaatttgaaaggttatgtgtcctacatgtaggttacattaaaaaacagattttggaatcaaaaatagacttcagaatcaaattaagtgtctatcacacactaaatgtgtgacataagcaaattacttaacatgtataacttccccatttgtggatgaaaatagccctaaagagttcacttatatttggtacatagacagtgtatgtaaaactctttccattaaaaaatagcaccttataagtacctgataaattgtaaccatatctccctagataaaagaaatagacccttcaaatccttttgttagaggtaggaattgcaccagaattggggtgaatttctgttgtgtttattaaaagtaaatcctggtataattgccgtataaatggtttgactttaaaaatattcagttgattcaaatccttaaaaagaaaagaaggtaaagtccataaataggttgagagggtatcactctatgttacacacaataatctcttgagtgaacttctgagatagcataagataacaaacactaaatggaagcatccatttctactccaaggtaatgtctcatttgacagcagtgctagagattgggactttggcagaacagctgtgaatcttgaggtgaaatcccaagagccctctttctatacaggatgctcagggtaacacatgttctacatggatgagagattagcatgccacaaaccaccccatgaaaaacaataccagcagagcacacagtcagtactaagcagttatcaatgtaaccacaacacgaaagcagacctggatagctcaactgttagacagcacccacaaattactacaacagatttcaagaagaggctccgaaaactcaactatagaaacaatcatcaaaggattggaaattttccttgcagagggacactgggagtctgtggcacatgtggggtttcgattcactgtaattttcctgttccagggaacaattatatattgaatatttttaataatgttgtgctgtgttattgtgaatatatttgtaagctgagattcaggatgctgccatactataaggctgtcaagtggtgagactagaccaagtttctgggtaaggaagtaatctgagatagtcaccttttaaaaataatctagttttgtttttttctttcttgtttgttgtttttagtttttgtaataacatatttcataaagaggattcgtaagtatgactgtagttctctcaaaatatgaatcccttttaataaacgattttagctatactagcagactagttacaatttatattatactctgtatccaaattcattttgacagtgcccaacaaattgctcagttatctgacttcctacccaaggaaaacatattaatctaaaaagttgaaatccatttccaaaatggctaaaataatttgggagtgggctggcattagaataatttgtctaaagagatttaatttatgctatatttttcattgtctgtttataaacctgatttatgagaaacatcatctagaaaacactattagccttcccattttacagatataaaactggaattgtgaggaataagatgttttgtcataattcatcttgcaaaatgatgacaaaattgaatagcaaatgtagatgtccaaattctattttaattttcattgtgccaggctccctttttgcttgtatattacaataaatatctcagaactgctagcttagggaagctattgcagaaacttaatatcctcaaagaaaattaatattgctatcctactaaaaggatttgaaagtgaaaagacttagcagacatgtattgagctaaacacttaaagactaaataaaaaataatagaagtgattatgtgggacatatatttattcattcaacataatcaatttaaaatttttataagaactcaaactgtcttcacagaaactgactttgtcatgaaacatttgtttcctttataaataaatcgttattttatcaaaagaactgtcaatatagtttatgtaaatggaatatttataagaatgaaagttgcattttctaaactgtgaactaggcaaaagtgatcttctggagtgaccttgtgtattagctccgattcccatctttcttaaagagagactttcgtgtgattggctgtaggtttcttgagggcttataggcagctctgtgatatagaagtagaaaataaatactgtacttgtccacacaaagttgttcagcaaaatcggatttaaaatagatgaaataaggttaaaaagatgagaggacatacaattggatgataaatataacatgaaaaaagacgaaaagaaaaagcttttgcattagttatctttcctgatcctctcctaatgcaaaagctttttcttttcttctcttttcattcatttctcctccaatcttacctctgctcatccttttatctttatttcattttacattcattattgctaaacagatttgtgtggacaagtatggcatttattttctacttctatgtcacagagctacccataaagtaggcttaatacctgggtgatgaaataatctgtacaacaaatccccatgacacatgtttacctatgtaacaaacctgcacatcctgcacatgtacccctgaacttaaaagttaaaaaaaaaaaagaaaaagcccttgccatatgtctaatataatatgaagtggcaaaaagaaggcaaaatatattagtgggacactgagttaaatagattggggaaaatatagaaccttttcaataaaatgcattttaatttatgtaactaataaaaaaatggaagccccaggacagtttaatgcatttttcccataaagaatttcaacttacagctactgagggtccaagtttctgtttagaattttaattataagtttttatacatgatattttcaaacataacacacattgttaaatctgattattaaaaaaatcaatacatctgaaattcataaaatattaaacctaaaaatattatatttttaaaacatttcacatcaaatttaaagtattcactgaggacattagactttaaggtagtgtgcccagtcgctaaaaagaaaaaatatctttttccattctcaacaccgattaaaaatttcagtttataaaaggaggttgagcgcaaaagcaaaaacaaaaaattataaaaccaggagaaggaaaattttttaaaaatccaacagtacaagaaaggttcataatttgtaagaggagtttgacaaaaagagaacagtaggaagacaggaatagaagatggaaaaaacaagaacaaatgtggagaaccaagggataccaatatatagattgagaagcattctgagtgtccagaaaaaaaattgttaaaaaattatctgcatttataagataaaaagttaatataaaacatcaatggcttttctatatgtcatcaatgaacaattagaatttgaaataaaaatactatttacattaccgccaaaaatgcaataggtataaataatctaggaaaatgtatatactatctatatatagaaaactataagattttggtaaaatacataaaataaaatgtaaataagtacacacatatttgatgttaagatgtcagttgtgcccaacttgctctatggtttccacacaactccaataaaaatccctaacacatatgtcttaaatgcttcaataatttatatgagaaggcaaaataactagaacaatgaacagaatactaaagaggaagaacaaagttggtgaacttgcatgacacaattttaaaacttactataatgttgtaatcaagacaacaaggtattggtgaaagcatgggcacatagattaacagaccagaatagagagcccagaaatagacccatgtaaggggattcaatagatctttgcccaagaagcaaaggcaattcagtagagtaaaggatagtttcttcaacaaataatgcagaagcaattggacattctatgcaaaaaataaacatgtatcttatacttttaacaaaaataaaatggattatgggcttaaatgtataataaaaagcttctagaaccttgatttggagatgagttcataaatacatcagaagcataataccataaaaagataagttggacttcattaaaattaaaaatttctgttctgccaaagacactgtaataaaatgaaaagacgagccacagacttggaaaaaaatttgcaaaatacatatctaatatactggattgtatccaaaatatacaaagaactttcaaaactcaatagtaaggaaaccagtcaattaaaaagtgtaaaaagacctgaacgtataccttacaaaagaagatatacagatggcaagtaattgtacaaaaatatatcccacatcatttgtcactagtgaattgcaaagtaaaacaatgagataccatttgatatggtttggctgcatccccaccaaaaatctcattttgaattgtaatccccataatccccaagtgtcaagggcaggaccaggtggaagtaattgggtcatggaggtggcttccctcatgctgttctcgtgatagtgagtgagttctcatgagagctgatggttttataaatgtctggcatttcccctcctggcactcactctctcctgccacctgtgaaaaggtgacttatacaaagattgtaagtttcctgaggctgccccagcaacgcaaaactgtgagtcaattaaacctcttttctttataaattatcaagtctcagatatttccttatagcaatgtgagaatggacgaatacaccattacatacatgctagagtggctaaaaccgaaaaatctggctgggcgcagtggctcatgcctgtagtcccagcactttgggaggccgaggcaggcggatcatgaggtcaggagatcaagaccatcctggctaacatggtgaaaccccatctctactaaaaatacaaaaaattagccgggcatggtggtgggcacctgtagtcccagctactcaggaggctgaggcgggagaatggtgtgaacccgggaggcggagcaatggtgtgaacccgggaggcggagcttgcagtgcgctgagatagcaccactgcactccagcctgggtgacagagcgagactccatctcaaaaaaaaaaaaataaaaacaaaatctgacaatgctagatgctggcaaggctatagagcaacaggatctctcgttcattgccagtggaaagtcaaaatagtatagttactttggaagactgttttcagattcttacaatgctgaacagagtcttatggtttgctaataggttttatccaactgatttaaacagttatcttcacacaaacacttgcatacagatgtttataggagctttattcataatcaccaaaaacttagagcaaccaagatgtcctttaataggtgactgaataagcaaaacgtacatccacataattaaatattactaagcaataaaatatatgagttatcaagctacaaaaaggcatgaatgaattttatatacacaatgctaaacaaaagataacagtctgaaaaggctatacgttatattattccaattacatgacattctgggaaaggcaaaactatatggatagtaaaaagaagatgcttgcaatgggttagagtaagaagattgaacgggtaaagcacaaggcatttttttagaaggtttagttattctgtataatattgtaatggtggatatgtgatactatgtatttgtcagaactcacagaagtttatagcacaaaggaggaattatatgcagactttgaaaaaataatttagaaggttggaggatcccaatatgtaatgcacaaaataatataacagtctaactatattacaaaaatatgaaaaaagtcatgagaatggggagggtaaagctactgatctaagtaactttagaaatgagttgcatatggaagactaaaggcaaaataaattgtatttgagtactatactctagttagtaaagttgtgttccatgagactataggttaacagttctgatatcactatactttttttaattaaataattaagcaaatgagtggaatacagtgggagccaggtttctaattgttggagtgggaagttgcagataaagaagtggaggaagctagaactatctacgtggtaatgcattagagtcagagacatccgttgatacaaactcatgtttagcttaacgtaaacatggtttcaagtagaaaaaatctacatatgggtatatacatgagttagtatatgcgtatatgacaaacaatatcaccccagtagcactgagcacacctagtacccacaccttgatttcaataaatcaagccactctcaataaaaggaataaggctgcctgaagaaatgactaattattgaactagaaaagaaaatatacccaaatgtccatcaatgatagactggattaagaaaatgtggcacatatacaccatggaatactatgcagccataaaaaaggatgaattcatgtcctttgtagggacatggatgaagctggaaaccatcattctcagtaaactatcacaaggacagaaaaccaaacactgcatattctcacttataggtgggaattgaacaatgagaacacttggacacagggtggggaacatcacaaactgaggcctgtcatggggtagggggaagggggagggagagcattaggagatatacctaatataaatggtgagttaacgggtgcggcacaccaacatggcacatgtatacatatataacaaagctgcacgttgtgcacatgtaccctagaacttaaagtataataaaaaaaagaaaatgtacaagatgagcctggaacatcttatagtgtcagaaagtaataaagtgctccaaaaaatccataattataaggtatgtgaaaatgacacaagagtcaactaaaatgtttccaataacaaatggtttaaaaaaagtggggaggggagcaataaaataaatactgtagtatttaattataagctaaagcataacataaatatttattagtacataatgatttaaataaatgaacaattcaacaaatacatgggagacaggaaacaaatttcccatgtatattaactccaaacaatttttgtcaatactctgtcctcaagtaaggggagcataactctccactccttaagtgtggaatgtgcatagtgacttccttctaaagggtacagcatgaaacgctaaaaaagaatgactttatagcagataaacctgacaagcactacctcagccacatcaagagtgataagtcatattaatagtatgttcccttgatatgatttgatttaaaacactgcatagtgctgcaataaacatatgtgtgcatgtgtctttatagtaaaatgatttataatctttcgagtatatatccagtaatgggattgctgggtcaaatggtatttctggttctagatccttgagaaatttccacaatgtcttcacaatggttgaactaatttacactcccaccaacagtgtaaaagtggtcctatttctccacatcctctacagcatctgtggtttcctgactttttaatgatctccattctaactggcatgagatgagctggataaagaaaatgtggcacaaatacaccatggaatactatgcagccatagaaaagaatgagttcatgtcctttgcagggacatggatgaagctggaaaccatcattctcagcaaactaacacagggacagaaaaccaaacactgcctgttctcactcataagtgggagttgaacaatgagcacccatggaaactgggaggggaacatcacacactggggtctgttggggtatagggggcaagaggggggagagcattagggcaaatacctaatgcacgcagggttttaaacctagatgatgggttgatgggtgcggccatccaccatgcctcatgtatacctatgtaacaaacctgcacgttctgcacgtgtatcccagaacttaaagtaaaattgtgtatacatatatatagatatatatataatcagaatggattcattacttgtaacaaatgtaacatacagtaccaatataaaatgttaataatggagggcttaaaagtgaagtatatgagaaatctctccgctatcatcaaacttctttgtaaatgtaaaacagttttaaaataaagtttattttctaagtaatgaaaagccacctgcatctcattatattacagtgacattttagaattttgggtacaattagatgatacactaggatcttccagaatgaaaaaaaaagtcaatagacattgaaacaataaagaggcagaatggcaatggatttctctacctgcaacattaggaattagaatcaatgaaacaatgcttccacaattctgaagtaaaaggattcccaaaccagaattacataaataactatactgtcatttacttataagcatagaatgagtattttattagacgtgcaagttctcaaaaagttatttcccccaagtcctttgtcaggaatcatgatcaaaacaaggaagaaacttcatttagtgcaaggcattagctccaggatacaagggctctgatccatgagaaagatgaaggaaattctaggttggcaattgtgcagcaagctcaaagatcatttatactagaccaaaccaagaggacagagggctttggaaggaatgtccttgagaaaaaaaaaatgatgtgttatattaatttccaaattcgttgttatattttaagaggggatatatactattgcagataatttggtgactaattagtgatatagagaactgagcagatgaaaaagaggcaattattaactcctggaataccaaagggttgcaagaaatgaaatgaaactatcacacactataattcaaccatgaataatatttacacagtcttaataaggtaaatttagacttgagatctaacaatgattatgatataaaactcaagggaaaaaaatattaaaaaagaaaatgtgtttggggtggttgaagttgtggtataaaagaactacatgcacatctccaatactgagaagccaaaataatgggtaccattttgagctgtaaaaaatcaaaatacctttataaacatgtgattttgaaatgtagggtatgtatttaaagaaagagataggtggaaagtatttttcaatgaatagttacatttagaatgggagtaatggagtaggaacctgcatttagggctgtattttttttttcagagctacttaatttctgacacaagaaacatgagattttcattaagaagtctaaataaagatgggtatgttgagattcaatgacctagaattgtgtcagtctttagagaacagattgaaattgggacaaagatgtttaatgtaattaggaaactagtttattatatttatcagtaagatataaaaaattaaaaagaatgatatatatttattacttcatataactaaggaaaatattgggtgagtggcattttattattgagtagtcagggaacaattacttaagtgatgagaactctgtttagcatcaagtcttgatgaaacagattgtgaaaaacctcccataattagagaggagatatagatcacaagatatgcagcatataattctaaatagtgataagtgatctttttcctctaaattgaaagagtagaggagaagagcaaggaaaatggcaactgaagattttatttattgcttttgtttctcccacctctgagaacggtaagctgtgtgagttctgacctcacaatataacaaaatcacctattaaaagttccctttgtctcctcaaacctcatgcagaaatttcagcctacttgcatttccattatcctccaacacaatatacaataactagagacaagtgctatttaagataattatatttgaaagctaaggaggaggtagaagtaagtaatcagaaattcaaggaaccatgaagatatgtgagccagcaaaatatccggagagagatgatgtttactatgatgtaacctatgtatatgcatacattaccttttggaaaattgtatattctctgcatccccttttggaatcatgaaactacttcttaggaagtatccttgcatacttcattactctaaaatttgtcacattacttcttgcacaattgaaaacataagttatactagacaattcttatttcataatggataaacgtatcttttctttttaaatctccaggatttaaattttgttttggaaagtatcactaagtacgtgcaattttattatgcattatcgaactggagtagttaaactgttttgacatttatggcacaattatggcccagatgttttctattctgtctctgaactgtctcaaataccacttttctaaaattcaatcctttttatattatatcaatataatggaaatgaaatttctgatacatgatctgtcttcttttcatgatagattcctcttcttaaatataaatatccagaagcagaaaaggagacagagcacaagtcaaaagtctcatgctactaagtatttatggttgagtcagaggactccacattcacagaaacaaataggtttcagtatgtttttccctggaatatccttctcatccacccactttactgttactgaccacttcattacttgacaagtcttttttatgaccctactcctgggtcttttccttgtcttttctcaatattttattaatatctttgtaatatacacttctgtatctaacgaagtgacagtgtattcctcaagaaaaagaaactcattatagccacctccatgcccacagtgccgaccatattactcaataaaatatttgtcaatagaatgaaaaattaagtaaagagaacacaaacattataggtgtctattcatgtcgttttctcactttatctgtgggttattggtgttcttattgtttgtatgagctcatattaaagtgctactgttagtcggaaggatttgttgtaactatttcccagatagcagtatattaatttcccaggtagtagtatactaactctatttatgaagttttaatgtgtatttatgacttgtgagagtttatactttattacttttgttaccaaattgaatttcaaacagcaaaatgtgtagtatttgtttcctgggctattggtcctgtaaattggtaaacaaatcatagtatctagcaagttaactcttctaatcattgctctctgatcttcatggtcttccccttttggtctttcctttcttcttccctgtttttcctctgtcttgtattaataacatctgtcatcgtttcctatctctattgttggtagtcatggctaacaccatcgggtacaattagaaggtggcagtattaaatcataaaatagtattagaggaagatgtaatgaactgtagcaagaatatagagtacacttttagatgcctaatgggaaaacttattttgacatgttcaatttcattctaagctcaattccttttgaatgaactacatgagcctcttatatttgaatacattgaataccctgcatttattcaggagaatttatattttgtgaaaacttaaaggctgatgcaggagaatggcatgaacccagaaggcggagcttgcagtgagccgagatcgcgccactgcactccagcctgggcgacagagcgagactccatctcaaaacaaaaacaaaaacaaaaacaaaaacaaacaaacaaaaccaaataagcaaaacagatatccactcgttttcttctcttacatagaaaataaaaaccctctgtgcaatggtatattgaattatattatcttaaatttattttaaaaactattttaaataatgctgtaacaattttagccacttctacataaggaaaatcaatccaaattgtatacaaatatgctccaactctcatcactactccatttaatcttcctgtagggatccaatgagttgtaaagaaagtaaacaaatgggattaagataattgctttctctagttcactaatgatttcttcgctgtaactttacacagtttctggctccactgttattttgggctgtggcatggagtgttttttatatgcttgaggttcgacaaaatgttttcttttcagagacatacatatgtgttaactcacagttaaaagatactaagatcttatattttactatgactggaaagagactgtcaccatagcttactgttcatatagtctgtcttgtctttgtcaactctaatagcagggaaatttatgtaaacacacaatacagaatgggaatcagaactaattgggccactcactggccatttagttctattacaaagtcaacaattactaaaaatgaagtcaacaatgactaaaaaccaatacatctttgctctcttaaacagccaattggtcattttccttaccatttgcattgtgaagctaacaggctccgttaaacatcaaagatgtttagtagatccctgtgggtgtaatgctcatgaaagaagcaagattcattcttcacaggcaatatgctgtgactttaaatgtcccctacctgcaggctgccttttggttcttctatcttcccttgctcttctgatctcggggctgggctggagtaatatttaagagtggcctcagagtacctaatttagaatattgagagtggccacttccatactcaacccacactcagcacttcctttcacacctgccttttcatgatttgtgcatacatctgtgatgccccctcccccactacagtataagctccttttaaagagattattcatcttttcttcaccagagccttgaaaaatcattcatatataatatacactgaaactatatatgtatatattccaagcaattttaattgatcctagattccccgaaagtaattatctcttttaaagtatttccccacttaattttatacttcccttagcatatctttgctttgaacatcatgtcataattatgatgttctttaaagtgttgttaatatttcctgtattaattctgtcttgttagctatgttggcaaaagctacctgttttcctgtgattcttttaaatgagcacagaggctaaaatgtaattggcagattcaataaaatgcttaaatattgttaacttgtgtttccatggcacaaagaaaggggtcctcttttgggatttcctgctcacatgtacagcttcctcacatgtcatttcttatgtttcaaaatattaatgcacccctaaactaaaattgatttgtaaattcaattcatattaaaaatatcaggaagtgaaagccaaggcacagaattagggaggcagatgtaatagaaatataaaatataagaaattttgttcttgtcatcctgatcttcacactttttatctacgtttatctcattatttcagttaagcacatttgaaaataacttaagcaacagagaaggattttatgctaagaaatcataaaagcaagaagtggagacatgacaactaaatgtaatatagcctggttgggatcctggaatagaaaaagaacaatgggttaaaaactaaggaaaactgaaaaatgtatagtctgtaaaacgttcgtaaatgaagatgagaacttcctgaatcaaacattctaactcatcttacaattctgcattatagagcactaggatgttattaaacaccacttcagtttttagtaaaagttatgccaatgacttagtgaaaataggagagcagtgctttctcttgtagatgcaggaaaatgttataaaaagatttattcctatattatatacagcctccttttccactttcatgaacattaacctatggtcccagttaagttacagtgtggactttatggtataaataatttccttgcttattatctacaatcactaggaaataagacattgctttcaatacttgtcaaaaccctgccatgtatggaacatacatttcccatccaagagcaatattaaattgtgtattttatgcttctttgtgttaccacttctataatatgcaattctttattttccttttgaaaggtttggtttgtctattcagccctaaatcctattcttcattcacagtatctctagacttgagattttcaatctacaagaagattgaaaatatactttccggcggaaacatgtttggaatctgaacagattatgcttttgtattaagagacaaggcaggactgtagatttattcttgtcatctctctgaaacatttacttcctctattccctgcagtgtcagcactttcagcacctttattctcagtttccttaaggttaactgaacatctccatcaaagacagtgtgcaggcaacatgaaccttgatcagtggggcaaaagatctggcttctaatcaaaactagacttgaattggctatttattttggggccagtgctgttccctagatagcacattcatcaccactgagttgaactaggttcctcttaagtctgacagtctatgaatctgaggtgctggaagtaaatagaaatatgacctcaggagaagcagagtagaacaagaagggtggatcaccttgtttgtctctacagatggttgggttagtcacaaccacctcaaaaggcctctgtttgtacactcctcagcacaactaccaagaaagcctttcttcatgcccccaataataaataagctttcccttctgattttacgtagtatactgtatccccttatagacacttaataagtcccatatttgattataattatttatgaatatctcacattaaagtatgtatcaaatgagtaaaaaaaacttaatatgtgaaaaaagtactatgttaatcttatttatgcataggatgtaaatcaaaattagaatgcatctgactgtcttccatgcctgagaaaattaaaaggttgaacaaattgtttgagaggcattaaaaaatgttttcgtaaaacatagaagaaaacattagtatctaagcaatccagataaagtgctttttagtcaggagagcttcaaagcaaaaaaaaaaaaataaagaaagaaagaataaagatggatatgtcctttaagaaaaaattactggtaattatactccacattaaaataggcaaaatcaaattctcagagccctcagtctgttactcaaactcttattgaagtgttgggaaagagttacactgtataaaacaaagcctctccattttgtctaaggcatttcttcttaactaataaagaagctaaaactgtataaaaataattatttgcataaggctgaagggcaaatcaagttgcatagtagctcaactcaaagtacagagaatgccatttcagtgtaaagcctgtaactacagctggggcagggcatcaagaaggacttcctaaaaagagaggcaacttgaattctacgttgagtaaatgatactcaggacttgactgaagcaagaaaagtggtgtgtgtgtgtgtgtgtgtgtacatgctttcttgcttgttttgctagatatattctgcgtgccccttaggatctaggcttaactcgctttagcttttgggaagtgacctgaataggccacagctgatgattctctcatgcttcacgctgacctccaccggccaatggggagaccatgcaggaagtcaaagcgtctgagcgggaagacaggggatttattctaatagaccccagactgagtgattgtctcagcatggaagtgttctgggaccaaagccatagatatttttgagtattatatctatgatctgaacccaggtattttgcctgggttcaggttatttagttaaatgacccttaattgatcctttgatcaattaagattgtttccacgcaactcttctactgccaaactaataattactccaccctttcactcccccaagatccaaggttagtaatagctcactgttactaacccttagatactgcactattctttgtggattttctatactctgtccaaaactttttaagagggtccggtaagatacttcttgagttttcctaatgtgagcatgccactggtttcttcctggaacactgaatgactcatatgtctttgatgattggaggagacacggggaaatgtggacacacaatagaataatcagaatacagaaattctagacattgggaaaatcaaaataccttcagtttgagaaactaaaagattatgagcagcttatcccccaaaattttaagacagaatgtgcagagacacccttgaacacaaatgaccatgagactcaagctttggtgccctcctaccactttctacagctcctctccttcctaagctccagcttcctcacagctgtgcaccatatggctaagcctcctcaagcatttgtgtcccacttatcctattctaagatgtccatacttgaagggttttataaaatggggttattaatcttgggagacatgaaagaggtcatgaaattaattgaaaccacgtgtgaataatatgtatatacgtgaattttcctgggaggggaaatcattggctttcattagattttcaactgagtttataatctccaaccccccaacacacacacacaaacacacactgttttaatgtgaattatttgttaatttctgataaaaggtgcatgaaggtatatagaagtgcattgaacatagtgtgtacataggacacatattttatagcattggttcacaatgtaatagattctattatggtgttcttgaatcaaaatacttaggtttgaatcaggttctaattaactggttgacatggaacattttcttaatatttttgatcctagacatttacatgttacaaacaagaacaataaaaatgcctatatcagagggttattataggaatagcggagatattactcatgaaaactccttgtaaactaatatctcatccaagagtatttttattttaaacaagacccttaccctttaacccaggatggtcaatattcaatggtgggccctggtatcatggttttatatattttaatatatttgcttgcattataccaaaaaagtttttgctagcttaaaccaatcctgtaactaaagatatttgaaattcttctcatgacaatttctacataattaaatgtagttatctcatgttatttcatttggagagattttaaaaatggatttaatgtctctgaaaacgttttgtcaggagtgatatgtattaggtcatatattatcgctttctcacctattatatgaaagttttgaggtatttaaaaaaccacatttattttagagcctggaatcaatgtgtttttgggaattagatataccattatcattgttaagaatttaaaaattattgatatttgacctctgacctttattagtgtgtgaatttttaaaaaatcgctaaactttttttagtttattcacttaatttaattgcctaaatcacatatgtgattaccttcctccctgcaaacagctttttgagagaaagggatatgtggattagtatcttgaccaactagatgcttaatgtcatgcccttggtaatcttcatagaaactctctaacatctggtgaatccaacacaatcttaaaattcaagtgactctttctctttaaattaatatatttatagctttgcctacagagtaatcagataatccaactttgggaacatttctgtgcagaaaacaaaaccacaaaagtatctttatgtaattaaagacacaagataaagtattattggagggttgaataaaagaaccatgtattaggactcctcagttctcttccaactattgacttcatatgctctgaggcctattacttaatctaatttgcccattattttacaagttgaactctgccctttgtttcaaaggataaatgcatttcaattaaatacatttgcaaattacattgttctgaagaactgcaagttgtatctgatttattgtattaattctgataaggaatgttgaaacttgaattatatggggtttactttgggttcacagcaaggggcttgtgccataagtgctttatttgatattttcttatatattaatagttcagcagtgagaacaattgaaaacttctactatcaagcatttccctatctgacctctcagttatataatttgcaccccaatgaaatacgccaaatagaaggagtttttgaattacataaacgatggtcaaagttagactagaaacatccattgccttgtaataatttaaatatgcatcatgacattgataaagtatatttaagtttgtaagactcaaattttctcttccctatgttatgccaagttcaaaaaaggccggcggtgggagtaagatttctgaaacttgtaacagatttcacttatttccttcctttacaaatatgtctttattttgctatcattaatgcattatcaaaactttaattgttctatgacctgcatttttattgattgccttgacatttaaaaaggcacataagttcttactatattcctcaaagaagctgcaactccaaatatattgacgtgtcactgtgtccgtactgggatggagttccaatattttcttttttgctttttgctgtttttgtcttttattcgttttgttacatttgtattttagtgaaagaaactactaaagattgctatgagatataaaaagaaattacataggaaaccaagaagtagcctatgagaaaaggaatgaaattaaacatcagactattgcatcttaaaatggaatagggaatatctctgatcaattgaagtgaccaaatctaaggtcaggggcagaagaaactaggagctacagaagttcctagtatcttcacgagtgaggggattctgaacaagtgactcacactcaaaagcaggacctactttgtccctagaagcctggttaacaccaatacaaattcctcctgttgcagccacgctagcactctggggatattgcctgggtctataaatgaaataattgtttaagaaaagtgcttagatatagagtccaggtctgcagtgtcggagtggcatgaatggtcatagctgatcatggcaataagaaaggttttccttctcacctgcaaattaagctgaaattggatcagcaattagagctcatgactttgtcaccaaataacattttttagaatatgacagcactaggttaccaaattgatttgaggaaggagggaaaaatgttatttccgaagagatgggttggtggagttcacagtttcacagttacttaatttactaagatagatgtgattttacttttataccccaacctgataaaggagacgcatacattacattagtgagaacagtgtatacttaagttacatgtgaggcattggactaggagcctgaagtcttgggtttgagtttgagcactacactaagagcccagttgtaccatagttcagacacacttgctgccctgccatcaatgcctaaggacaaaaactcataaaagcaaagaagaggtctgttccatcctttataccggcttttccactattaggattgccaaatgaaaattagacaagctgaaaatgttaaggaaactcacagaatgggggtaaggggatggttatacataaaatctgagctaatccaaattaaaatgcctgcaatattcttttaatgacaaatttaagatttctctgtactttatatcagttattactccaaaaataattatttgcattgttccacagaggaaaactcaatttacaataattttgttatttgaattattcagtcaaggaaatgtagacagtcagctaatggagttacgtcttaaaccaggttaagagcagtaacaaatttgtgtaacaagaaacttctttattatagaagaaaatgaagtttaatagtagttatgacctatgcaactcgccaatagtttccagcttgccttaagagaattccatttttaatggcctcatgctccactgaatggcaacatttcaaaggttacttctagctggtataatcagcccaacagatcaagcatatagctttcacaacagcaaagctaggaaagctactgtgtcctgaaaacatggagtcagcagaaataaaggttacatattcaaagtagtaaattaaaggatgtttctacatgttcataatgaaacaaatcttaagaaaaattcaacaaaaatagccaggtttttcatgtctgtgtgctaataactatctatttggactaaacagcacacattacagtacataatgttctcagtagtctcttggctctttactctctcctttaaaacatgtttgggactctcttgacctagaaatttccagccatgggggagatagccaattatgtctctccttgattgagctgtgaatgccttgaagatatgagctttcttttatttattcaatgcttagcagagtacctgacagccaggcaatgtttcaataactcgatgaactcaaaggctttacctctcctcttacctttttcttttcctacaattttaattatacacacttctgaagattctaacttaacactctatttctctcatatatgatgtcttttatcaatgtcattcataactatggatcaaatttgaaatgccatttattctaagagatctttctgtatcttccttaattagatgattttttctctctctctcttctttaacacacattattttgcaccacaatcatgccacttagtttacttggcccttgatactagttactgagggatttgacacatatttaagtcaagagtgactgctatcagaaattagaacaaaagttatctattgatccaaaataacataagacacactgtttcctgaatctcaaaagaaaatccaatttttttttatttttttcctttttttatttttatttttatttttttattattatactttaagttttagggtacatgtgcacattgtacaggttagttacatatgctggtgcgctgcacccactaactcgtcatctagcattagatatatctcccaatgctatccctcccccatcctcccccccacaacagtccccagagtgtgatgttccccttcttgtgtccatgtgttctcattgttcaattcccacctatgagggagaatatgcggtgtttggtgttttgttcttgcaatagtttactgagaatgatgatttccaatttcatccatgtccctacaaagacatgaactcatcattttgtatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaaccagtttacagtcccatcaacagtgtaaaagtgttcctatttctccacatcctctccagcacctgttgtttcctgacttttgaatgattgccattctaactggtgtgagatggtatctcattgtggttttgatttgcatttctctgatggccagtgacggtgagcattttttcatgtgttttttggctgcataaatgtcttcttttgagaagtgtctgttcatgtcctttgcccactttttgatggggttgttttttttttcttgtaaatttgtttgagttcattgtagattctggatattagccctttgtcagatgagtaggttgcgaaaattttctcccattttgtaggttgcctgttcactctgatggtggtttcttttgctgtgcagaagctctatagtttgatgagatcccatttgtcaattttgtcttttgttgccattgcttttggtgttttagacatgaagtccttgcccatgcctatgtcctgaatggtaatgcctaggttttcttctagggtttttatgggtttaggtctaacgtttaagtctttaatccatcttgaattgatttttgtataaggtgtaaggaagggatccagtttcagctttctacacatggctagccaggtttcccagcaccatttattaaatagggaatcatttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgtctccagctttgttcttttggcttaggattgacttggcgatgtgggctctttttaggttccatatgaactttaaagtagttttttccaattctgtgaagaaaggcattggtagcttgatgaggatggcattgaatctgtaaattaccttgggcagtatggccatttttgcgatattgattcttcctacccatgagcatggaatgttctttcatttgtttgtatcctcttttatttccttgaggaacggtttgtagctctccttgaagaggtcctttacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcacctgcaaacagggacaatttgacttcctcttttcctaaatgaataccctttatttccttctcctgccgaattgccctggtcagaacttccaacactatgttgaataggagtggtgagagagggcatccctgtcttgtgccagttttcaaagggaatgcttccagtttttgcccattcagtatgatattggctgtgggtttgtcatagatagttcttattatttggaaatacatcccatcaatacctaatttattgagagtttttagcatgaagggttgttgaattttgtcaaaggccttttctgcatctattgagataatcatgtggtttttgtctttggctctgtttatatgctgggttacatttattgatttgcgtatattgaaccagccttgtatcccagggatgaagcccacttgatcatggtggataagctttttgatgtgctgctggatttggtttgccagtattttattgaggatttttgcatcaatgttcatcaaggatattggtttaaaattctcttttttgattgtgtctctgcccggctttggtatcagaatgatgctgacctcataaaataagttagggaggattccctctttttctattgattggaatagtttcagaaggaatggtaccagttcctccttgtacctctggtagaattcagctgtgaatccatctgctcctggactctttggttggtaagctattgattattgccacaatttcagagcctgttattggtctattcagagattcaacttcttcctgatttagtcttgggagagtgtatgtgtcaaggaatttatccatttcttctaggttttctagtttctttgcgtagaggtgtttgtagtattctctgatggtagtttgtatttctgtgggatcagtggtgatatcccctttaccattttttattgcatctatttgaatcttctctctttttttctttattagtcttgctagcggtctatcagttctgttgatcctttcaaaaaaccagctcctggattcattaattttttgaagggttttttgtgtctctatttccttcagttctgctctgatcttagttatttcttgccttctgctagcttttgaatgtgtttgctcttgcttttcaagttcttttaattgtgatgttagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttatgtatccagtagtcattcaggagcaggttgttcagtttccatgtagttgagcggttttgagtgagattcttaatcctgagttctagtttgattgcactgtggtctgagagatagtttgttataatttctgttcttttacatttgctgaggagtgctttacttccaactatgtggtcaattttggaataggtgtggtgtggtgctgaaagaaatgtgtattctgttgatttggggtggagagttctgtagatgtctattaggtccacttggtgcagagctgagttcaattcctgggtatccttgttgactttctgtctcattgatctgtctaatgttgacagtggggtgttaaaatctcccagtattattgtgtgggagtctaagtctctttgtaggtcactcaggatttgctattgggtgcatatatatttaggatagttagctcttcttgttgaattgatcactttaccattatgtaatggccttctttgtctcttttgatctttgttggtttaaagtctgttttatcacagactaggattgcaactcctgcctttttttgttttccatttgcttggtagatcttcctccatccttttattttgagcctatgtgtgtctctgcatgtgagatgggtttcctgaatacagcacactgacgggtcttgactttttatccaatttgccagtctgtgtcttttaattggagcatttagtccatgtacatttaaagttaatagtgttatgtgtgaatttgatcctgttattatgatgttagctggttattttgctcattagttgatgcagtttcttcctagtctcgatggtctttacattttggcatgattttgcagcggctggtgccggttgttcctttccatgtttagcgcttccttcaggagcttttttagggcaggcctggtggtgacaaaatctctcagcatttgcttgtctgtaaagtattttatttctgcttcacttatgaagcttagtttggctggatatgaaattctgtgttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcatctttggtgaatctgacaattatgtgtcttggagttgctcttgtcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgttgatttggtcttttcacatattcccatatttcttggaggctttgctcatctctttttattcttttttctctaatcttcccttctcgcttcatttcatttatttcatcttccattgctgataccctttcttccagttgattgcatcggttcctgaggcttctgcattcttcacgtagttctcgagccttggttttcagctccatcagctcctttaagcacttctctgtattggttattctagttatacattcttctaaattttttccaaagttttcaacttctttgcctttggtttgaatgttctcctgtagctcagagtaatttgataatctgaatccttcttctctcagatcatcaaagtcattcttcgtctagctttgttccgttgctggtgaggagctgcgttcctttggaggaggagaggcgctctcctttttagagtttccagtttttctgttctgttttttccccatctttgtggttttatctacttttgctctttgatgatggtgatgtacagatgggtttttggtgtggatgtcctttctgtttgttagttttccttctaacagacaggaccctcaactgcaggtctgttggagtaccctgcagtgtgaggtgtccgtgtgcccctgctggagggtgcctcccagttatgctgcccgggggtcaggggtcagggacccactggaggaggcagtctgccctttctcagatctccagctgcatgctgggagaaccactgctctcttcagtgctgtcagacagggatatttaagtctgcagaggttactgctgtctttttgtttgtctgtgccctgcccccagaggtggagcctacagaggcatgcaggcctccttgagctgtggtgggctccacccagttcgagcttcctggctgctttatttacctaagcaagcctgggcaatggtgggcgcccctcccccagcctcactgccgccttgcagtttgatctcagactgctgtgctggcaatcagtgagactccgtggggtaggaccctccgagccaggtgcgggatataatctcgtggtgcgccgtttttttaagctcgtcagaaaagtgcagcattcgggtgggagtgacccgattttccaggtgccatctgtcacccctttctttgattaggaaagggaactccctgaccctttgcacttcccgagtgaggcaatgcctcaccctgcttcagctcatgcatggtgtgcgcacccactgacctgcacctactgtctggcactccgtagtgagatgaacccggtacctcagatggaaatgcagaaatcacctgtcttctgcgttgctcaggctgggagctgtagactggagctgttcctatttggccatcttggctcctcctgaaaatccaatttttttaactaaggaatcatttcaaatcagaataaaacttatatagtcctaatcattgaataagaacaaaataggaatggaaaatcactctctgcaagtagacatttaattttatttgattaccagcttcctaaagtttccatattccaatctctcttccttcttctcaatcccaggtgacaacattttttcccatttgactgagaaaacaaaagcaatcaacaaagaatttccacaggatgacctgaccaagcctaccaaacaatctgccttggtgcactttactgtctttactcaagttattattgaaaagttctcagtgttcctgtcaggaaccagctcctctactgtcctgcttgaccttatctccttttatctattcagagacattactttagtagttgtccacacttcctcctgaattaccagttcctcactctctaatacattcttctcatcacaaacagataagctgaactacctgttataaaaaagaaagaaggaaagaaggaagggaggaaaattcgacagtatttcatgtgtttttgtattagtgttctccaaagaaacaataccaatgggacacataaacatgtgtaagaggagatttattatgagaattgactcacatgattatggaggccaagaagccccaggatatgctgcctgaaactggaggatcaggaaagctggtggtgtaattcaatcttagtctggtggccaagaaccaggggagctgatgatgtaactccccatccaagactgaaggcctgagaaccagtaggtagagggtaaggggtgaggaggtggtggggtgaagtttgtgttagtcctggagtctgaggccagcgaaccaggaactctgatgtccaaggccaggagaaggtggatatctcagctcaagaagagagagggcacacttgctcttcttccatcttttagttctattcagatcctcatggattggatgatgtctgctcacattgatgagggcgttcttctttactcagtcttttgattcaaatgctaaactctcctgatggacaactcacagttacaccctcagagacatacccagaaatatgcacaatgtattatcagctatctaagaatctcttatcctagttgacacataaaattaaccattacagcactttcacaaataaattcctccaaatagtttctctactgtttttttccacttcttgtccctccatcctctccaactggcttcaaccagctttgacttcactacttcactgaaatagctcattttgaggtgacaaatgacctcatattgttaaattccataattattctcagtccttttttttttaatttatagactacatttgacacagttgaaacactttctttaaccaggtttcagatctcagcatagatttgtataagtctagtcatttgatgacttgtctttttgggaggaagatggcctcctgcaaaatgtccaatgaaatgtactgtagccaagtgtttaacactgtcaattcagacgctccttcaggtgttaatttgagggagcagaacagactgtaggctaaggttctaccatatcatacaattgcaacaataagtatgaactccagcttcaccttctgattgtgctgagggaggttagcgctctcttattatacaacttgaaagccccacactctgttccaggattcttctcaccaaacctaatatctacctactaggtccttatgccctcctgagagggatatttttttcaatttttttaaattttctttccaatgtctattttagattaaaggagtaatatgcaggttttctacatggctaaattgcatgttatgggggtttagtgtacagataattttgtcaaccaggtgatcggcataatgtccaataggtagtttttcaatcctcaccctcctcccactctctaccttcaagtaggtccaggaatctgtttttctctttgtgtccatatgtattcaatgtttagctcccactgagaacatgcaatatttagttttttgttcctgcattaatttgtttaggattaatttgcctctaatttcatccatgttgctacaaaaagaggatttccttttttatggctgtgtagtagtccagtgtgtaggtaccacattttctttatccagtccactgttggtgggcacctaggtttattctatgtaattgctagtgtgaatagtgctgcaatgaacatccgtgtgcatgtgtccacatggttaaataatttatattcctttggatatatatccagtaatgggattgctgagtggaatgctagtactattttacattctttaagaaagctccagagtgatatccacagtggcttaactaatttacattctcaccaacagtgtgtaagtgctcctttgctttttgactttttaataatagccattctgactagtgtgagatgttatctcattgttgttttgatttgtgttcccctaattaatgattagtgatactgagcatttattttcatattcttgttgaaaatgtgtgtgtcttcttttgagaagtgtttgttcatgtcttttttcatttttaatggggttgtttgttttctgcttgttgatttaagttccttgtagatgctggatattagacttttgttggatgcatagtttgcaaatatttgctcccattccttaggtcatcttttcactctgttgatagtttcttctactgtgcagaagctctttagttaattggtgccacttgtcaatttttgtttgtgttgaaattgctcttggagtcatcatgaagtctttgccagggtccttttccagaatggcatttcctaggttttcttctaacatttttatagttttacgttttgagtttaagtctttaattcatcttcagatgatttttgtatatggtgaaagttaggcatcaagtttcaatcttctgcatatggctagccagttgtcccagtaccatttattgaacgcagagtcccttccccattgattgttattgtcagttttgtcaaagatcagatggctgtagttgtgtgactttatttctgtgtttctaacctgttccattggtctatgtgtctgttttgtgcccgtgtcatgctgttttaattcctgtagccttgtcgtataatttgaagtcaggtagtgtgatgccttcagctttgttctctctgcttagaatttctttggctactcaggctctttttggttccatatgaatttttaaaaagttttttctaattctgtaaaaaatgacattgatagtttgataggaatagcattgaatctgtaaattgctttgggtagtatgatcattttaacaatattgattctgcagatccatgagcatggaatgcttttccatctgtgtcatctctaatttctttcagcagtgttttgtaattctcattgtagagatctttcacatccttggttagctgcattcctaggtattttattctttcggtggctattgtaaatgagattgagtacttgatttgtctctctgcttgggtgttactggtgtatggaaatgctactaatttttgtacattgattttgtgtcctgaaattttgctgaagttgttatcagatctaggagcctttgggcagagactacaaggatttctaggtatagagtcatattgactgcaaagagagatagtttgacttcctctcttcctatttggatgccttttatttatttctcttgctttttcaattttatttgataagcttttatgtaaatgttgtgtctatattccagggaactggtatatggttttaaaaatattttgtattgctttatcatgttttgatagaagataagttggcaagataaaatctattatggagcttactatcatttttgtcagggatgaatgagaattggtattgatgatttggtagttattttcccagaactctgcgtaaaaattctaataatgttaatacttactcaaaaccatgttctttattataatcagaagttttctcaaggcaaaactattctttagaatgttatgttgttccttaataagcccaaactcttgctctcatctttcatgtctttttaatgagtaactagtacaaattatatttcattaatatttcctactttaaaatccttatagctgtgaaaatgtcctgagaataaagaggtttaaattattattttccttgtctagttagtatagctttctgtctttggtacttttggtgtctgccaaatatttcacctaatactttgtaactgtttatcagtgtatattttggactcaagaaaggagaacccaattccatctttaggtattgtatttaccctggtgaaaagaagcaacacgagtagttggttgatacatttgcactgccaaattaaaaccatgaatactacttttcctttcaataaaagagttttgctcttaatagcacaaaaatatttgtcactgtccctaagtggaaaattattatataaaaattattttcatttaatgtttttattccaactgcaacacactttaaaatttataataaccaaatgttcacaaaataatttaaaaagaatttttgtgtaatttaagaaaaagcactttccctgtattcttgcctatgcattttccttcagaaagttgagatttcaagagagaagaaattgtagatttaattttctgtgcaaataaaatatagtgtatcaattttgggacactttaagttgctctaataagacttcttgaatcattgaattcaatctcagcataatttactttaggaaatgctaagcaaatgttattaatcactcagtatattatgtcatgtgccttcaatcatgtttttattttatttaaaatgtttggaataaaattgcattatgagctcattcaagacttgggggaaaacatgaatttctcaaaaatactatgagccaaatttaaatacgtattaatgcaaatattctttcgctgttattgagtgaaatgcaaagtcattgctttcctatacttattgagatgacaaccaggccagctgtaagttttgattacatatttagaataaagttatttgataattaatactagattaatttactcatcaagatgaaataggaatgtttactcttaatggggtaatattgttttgtcttgatttaagttagacttttctcagtattatgggaaatctcataatgggacacacaaatataatgggaaatgggagttacccgatcttacttcctgtggagatgagagcagagaacagaagttaacaatgttccacgaatgacaacaaaatcaaaaagaggaagataatgagctaagtaggggagtgagaggcaaaagtgaatctggaaaatgaggccaatggatcagtagtacaacaacaagaatgacacgaagcatacactgtgatggaaccatgagatcagaagaatgatggaaaatcctagcatataagataaaactatagttttaggaatttaagagactgttgagtctcttaaatatagccacctaaggtgggctatattggtctctattaagttgtgtgaatgactcagatgtatttacaggttatggcataggaaaaggcaaaaacaacttttctaccattaagattcactgacaccaatggtgattaggcacactgacgaattgccattttattaacagtaactctctgcatatcttgcacacagcacagcctaaaactgttgaaaattttatatcccagggaatgctctcaatcatagattgaccctaatgacagataaatactgtagcataactgcaggttgggggccaagtctaaggtcaattctacatagttctttaaatagttcccaaaaagatgaaatccttgttcaataactaagctgcttatcaatgtgctcttgaaggctttcctccatttcctctctaactttcccattgcctcacttgtgcttccaatgaccaccttccaaataaacacaaatctttgagttcctgtatgttttaggagtatttaagctatgtactgacaaataaaagacaaagtaaaaatgtcaaaactaattaattttttattaattccagtatttaatataattattactataagataaagagtgattggctttgaccattttacctttagaaaatgaattcagatcacttgccttgatctagtttctttttagtatatccaaatacaaaaaaaaaatctttttttttgctacaactattagaatgggaaaaaaatacatattcttttaggtttccattatttcgaggagaagggattcctctgcattcaaaaaataaggttgctcttggttttacatagcatcaacaaaatgtcaatggtagcttcatatagaatcaatgaaacattagcaaggcctccaaaaagtaggttagtctgaaagcatactctcaatagctgtataaatatgacaccaggttagagaaaaatgatcaaaatatttttaagttaaacatttttaaagtgttaaaaatgatacaaaggaaagtttaaattacaaatgatgagtcttaagtaacattattagatatttaattttcttctaaaagtatatgcctatgaaatagataatgtcaatattatactcattgaaagtcttcaaacataattttttatttgcttttttcttttcacttgaaaatttttacttatgagaactataatttgttgctctttttaagattataactaaagttatttcctagccacatagcctgtccaacagtaggcttaaatctcttccaggcattgttggtataaactgtttgcctacagaaacccaatcattgtcgaaaaaaacctccaatacatctataatcttatcttgaatagtgtcgttcatatttcctttatcaagtatagtttacctgatataacgtaactattgaacttttaaatcatagataatcctttcacactcacactctttcaaaaaattctaaggttttcttgtgaattaaggaaaataaagtataggaactcattggcaacagtagtctattaatgtattacaaagctgcaaattaatgaaatttgaatcatcttcattttacatgcaaccaactcattgaatcttttttggaagttaagaatcaagatgtgggagattgtaatgtttcaaatgcaattatgaaatgtttgttttaaacccactaattaattaatgagcctatcctttgatgtttatgagcattattttgtaaatcaatttttgactatttttccttgcaagttgtttcatttgttataagccaagtcataatttattgttaacgcactttgcaaaaagcaggaaagaatttgttcccatttgaaatcaacttaaaataagtaacaacagtctataattaaagatgaggtaagaatacatatttggaaattttaaaaaaataatagataaaataaagattccaattgagatggtgcaagaatcagaaatggttacaataatacaatattttgatcttccaaaataatgattttttattgccaatgccattttacaaagaggcaacatcattaggcagctatttttgcatatgtgagatgaaacattatgccttttcttttcttcaaaactttattttcaaaagaatgctttatatgttgaaaagggtagtgttgcaaagcgtggtgaagaaaaacactttttgtttcctaatttacaaatgaaagtatggagttttaatcagaagtttaatatctcctatgcaagctaaacacataatttttatattccattatataagtttgtatttctgtttcaaagactaaagttatcagcatgaaaatatgttctcaatagtcgtaataagtcattcttttactcaagaaatttgagtacttatataatgccagacatttttcaaagtactggggatactgcaaataaaactaagtgaacactatctctgcattctggaatttatactgtagttaaaagagacatacaataaacaaatatatgatatcagatggagatgagagttacagattgaaataaagtaaaataatgggcataaggcatgctgggcataaaggaggctgctacaagatctgtaaggtgacaaaaaaagactccattaatgccacaaaaatgttcccattcatattcattctagtaatttaatttttataccctttactagctttaattattttaatttacctttgctaatgaaataaaagtttatttcccaaagagctgttactcaacaccgtacattgaataagctatcttttctgtatttatatcaattactgacttcaccacaggctaaatctcaaaagtacatagagatgcacttttgattttttttcagtatctacttgtctatttttgtgccaaaaccatactctttcaataactctaactttataatataaattgatttcttgtaggataacactaaccaaatttataaacattgaatactatttttctttcaaatgaacctgagaatcagattttcaaattttgtaaactgccttgttagaattagaattgaaattgtactatatttacatagtaattagaggaaaaactgtgtaaaaatgatatgatactatttcctaagtttttttaactcacacttagaattctggtaacagggtggctggcaagatggccaaatagggacagctccagtctgcagctcccagcaagattaacgcagaaggtgggtaatgtctgcatttccaactgaggcacccagcttatctcactgggactggttagacaatgggtgcagcccacagagggagaacagaagcagggtggggtgttgcctcaccatgaaagcacaagtgatcagggaactccctcccctagccaaaggaagccatgagggactgtgccatgaggaatggtgcactccagcccagatactatgcttttcccatggtctttgcaacctgcagaccaggagattctctaaggtatgtacaccaccagggccctggatttcaagcacaaagcttggcggccatatgggcagacaccgagctagctgcagttttttttttccataccctaagggcgcctggaacaccagtgagacagaaccattcactctcctgggaagtgggctgaagtcagggagccaaggggcctagctcagcagatcccaccctgacggagcccagcaagctaaaatccactggtttgaaattctcactgccagcacagcagtctgaagtcaagctaggatactggagctaggtggggggaggggcttgagtaggctgttttcccctcacagtgtaaacaaagcagccaggaagttcttactgtgcagagcccactgcagcaccacaaatcctctgtagtcagactgcctctagattcctcctctctgagcagggtatctctgaaagaaaggcagcaaccctagtcaggggcttatagataaaactcccatctccctgggacagagcatctgggggaaggggtggctgtgggtgcgggttcagcagacttagatgttcctgcctgccagctctatggatctcccagcacaatgcttgatctctgctaagggacagactgcctcctcaagtgggtccctgaatcctgtgtctcctgactgggagacacctcccagcaggggtcaacagacaccttatacaggagagctccagccagcatcttgtgggtgcctctctgggacaaagactccagaggaaggaacaggccgcaatctttgctgttctgcagcctccactggtgatacaggaaaacatggtctggagtggacctccagcaaactccagcagacatgcagcagagaggcctgttagaaggaaaactaataaacagaaagaaataacagcaatatcaaccaaaaggacatccacacaaaaactccatccaaagctcaccaacatcaaaaaccaaaggtagataaatccatgaaaatgagaaaaaaccagcgcaaaagagttgaaaattccaaaaacccgaatgtctcttctcctccaatggatcacaactccatgccagcaagggaacaaaactggacagagaatgagtttgacgaattgacagaagtaggcttcagaaggtgggtaataacaaactcctctgagctaaagcagcacgttctaactcaatgcaaggaagctaagaaccttgaaaaaaggttagagaattgctaactaaaataaccagtttagagaagaacataaatgacctgatggagctgaaaagcacagcacaacaactttctgaagtatacacaagtatcaatagctgaatcaatcaagtggaagaaaggatatcagagattgaagatcaacttaacgaaataaagggtgaagacaaaattagagaaaaaagaataaaaaggaacaaacaaagcctccaagaaatatgggactatgtgaaaaggccaaatctacattttattggtgcacctgaaagtgatgggaaaaatggaaacaattttgaaaacagttgtcagggtattattcaggggaacttccacaacctcacaaggcaagccaacattcaaattcaggacatacagagaacaccacaaagaaactcctcgagaagagcaaccctaaaacacataattatcagattcaccaaggttgaaatgaaggaaaaaatgttaagggcagccagagacaaaggtctggttacccacaaagggaagcccatcagactaacagctaatctctctgctgaaaccataaaagccagaagagattgaaggccaatgttcaaaattattaaagaaaagattttcaacccagaatttcatatccagtcaaactaagcttcataattgaagaagaaataaaatcctttacaaacaagcaaatactgagagattctgtcaccactaggcctgccttacaagagctcctgaaggaagcactaaatatggaaaggaaaaaggggtaccagccgccacaaaaacataccaaattgcaaagtccattgacactatgaagaaactgcatcaactaatgggcaaaataaccactagaatcataatgataggatcaaattcacacataacaatattaagcctaaatgtaagcaggctaaatgccccaattaaaagacacagactggcaaattggataaagagtcaagactcatcggtgtgctgtattcaggagacctgctttatctgcaaagacaaacataggctcaaaataaagggatgggagaatatttaacaagcaaatggaaagcaaaaaaagcaaggtttgtaatcctagtctctgatgaaatggactttaaaccagcaaagaccaaaacagacaaagaaggacattacataatggtaaagggatcaatgcaacaagaagagctagctatcctaaatatatatgcacccaatacagaagcacccccattcataaagcaagttcttagagacctacaaaaaggcttagactcccatacaataatagtgggagactttaacaccccactgtcaatactagacagatcaatgagacagaaagttaacaaggatatttaggatttgaactcagcgccagaacaagtggacctaatagacatctacagaattctccaccccaaatcaacagaatatacattcttctcaacaccacatcacacttattctaaaattgaccacataattggaagtaaaacacttgtcagcaaatgcaaaagaacagaaatcataacagtctctcagaccacagtgcaatcaaattagaactcaggattaagaaactcactaaaaatcacacaactacatggaaactgaacaacctgttcctgaatgactactgggtaaataacgaaaataaggcagaaataaataatttctttgaaaccaatgagaacaaagacacaaagtaccagaatctcagggacccagctaaagcagtgtttagagggaaatttatggcactaaatgcccacaggagaaagtgagaaggatctaaaattgacaccctaacatcacaatgaaaagaactagagaagcaagagcaaacacattcaaaagctagcagaatacaagaaataactaagatcagaacagaactgaaggagatagagacacgagaaaccactcaaaaaatcaatgaatccaggagctgtttttttgaaaagattaacaaaatagatagacagttaactagactaataaagaagaaaagagagaagaatcaaacagacacaataaaaattgataaagggaatatcacctccaatcccacagaaatacaaactaccatcagagaatactataagctcctctatgcaaataaagaagaaaatctagaagaaatggataaattcctggacacatacaccctcccaagactaaaccaggaagaattcgaatccctgaagaggtcaattacaagttctgaaattgaggcagtaattaatagcctaccaaccaagaaaagcccaggactggatgaattttcagccaaattctaccagaggtacaaagaggaacttgtaccattccttctggaactactccaaacaatagaaaaacagagactcctcccaaacttattttatgaagtcagcatcatcctgacaccaaaacctggcagagacacacacacaaaatgcaaaatttcaggccaatatccctgataagcatcggtgcaaaaatccttgataaaatactggcaaactgaatccagcagcacatcgaaaagcttatccatcacgatcgagttggcgccttccctgggatgcaaggctggttcaacaaacacaaatcaataaatgtaatccatcacataaacagaaccaaagacaaaaaccacgtgatcatcccaatatatgccgaaaaggcctttgacaaaattcaactgcccttcattctaaaaactctcaataaactaggtattgatgggacatatttcaaaataataagagctatttatgacaaacccacagccaatatcatactgaatgggcaatatcatactgaataataaaagattattttattatctcaaaataataagagctatttatgacaaacccacagccgatatcatactggatgggcaaaactagaagcactccctttgaaaaccagcacaagatgagaatgccctctctcaccgctcctattcagcataatattggaaattctggacagggcaatcagacaagagaaagaaataaaaggtattcaaataggaagacaataagtcaaattgtctctgtttgcagatgacatgattgtatatttagaaaattccattgtctcagcccaaaatctccttaagctgataagcaacttcggcaaaatctcaggatacaaaatcaatgggcaaaaaatcacaagcattcctatacagcaagaatagacaaacagagagccaaaccatgagtgaactcccatgcacaattgctacaaagaaaataaaatacctaggaatccagctcacaaggggtgtgaagggcctcttccaggagaactacaaaccactgcttgagtaaataagagaggacataaacaaatggagaaaccttccatggtcatgaataggaagaatcaatatcgtgaaaacggccatactgcccaaagtaatttatggattcaatactatgcccatcaagataccattgactttcttcacagaattagaaaaaactactttaaatttcatatggaaccaaaaaagagcccatatatccaagacaatcctgagcaaaaagagcaaagctggaggcatcacactacctgactccaaactatactacaaggctacagtaaccaaaacagcatggcactggtaccaaaacagatatatagaccaatggaacagaacagatgcctcagaaataatgccacacacatctacagtcatctgatctttgacaaacctcacaaaaacaagcaatggggaaaggattccctatttaataaagagtgttgggagaactggctagccatatgcagaaaactgaaactggaccctgtccttacaccttatacaaaaattaattcaagatgtattaaagacttaaatgtaagactgaaaaccataaaaaccctagaagaaaacctaggcattaccattcaggacataggcatgagcaaagacatcatgactaaaacaccaaaagcaatggcaacaaaagccagaattgacaaatgggatttaattaaaggaaagagcttctgcacagcaaaagaaactatcatcccagtgaactggcaaactacagaataggagaaaatttttgcaatctatccatttgacaaagggctaatatccagaatttacaaagaacttaaacaaatttacaagaaagaaacaaacaacctcatcaaaaagtgggcaaaggatatgaacagacacttctcaaaagaagacatttttgcagccaacaaacatgaaaaaatgttcatcatcactggtcattagagaaatgcaaatcaaaaccacaatgagatactatctcatgacagttagaatggtgattattaaaaagtcaggaaacaacagatgctggagaggatgtggagaaataggaacacttttacactgttggtgggagtgtaaattagttcaaccattgtggaagacagtgtgacaattccttaaggatctagaaccagaaataccatttaacccagcaatcccattgctgggtatatacccaaaggattataaaactttctactataaagacacatgcacatatatgtttattgcagcactgttcacaatagcaaagacttggaaccaaccctaatgcccatcaatgatagcctggataaagaaaatgtggcacatacgcactatggaatattatgcagccacaaaaaaggatgagttcatgtcctttgcatggatgaaactggaaaccatcattctcagtaaactatcacaggaacagaaaaccaaacaccacatgttgtcactcataaatggaaattgaacaatgagaacacatggacgcagtgaggggagcttcacataccagggcctgcctgggggtagggggctaggcgagggagagcattaggagaaagacctaatgtagatgacaggttaatgtgtgcagcaaaccaccattgcatgtgtatacctatgtaacaaaccggcacgttctgcacatgtatcccagaacttaaaagtataataataataataataataataataataataataattctggtaacatctcttctttccaaaatcagctggtattgatgaaaaacagatagatgtgtctttcatataaataaataattaaataagtgaataaatatatgcatatgtagatacacacacaactggtataacatcagaaaaaaactgtgaaaaatacctaacatgtcattttaaatgctttatttgttcattttcctttattaaatttttaactctgtaggattgctttttgtttgctttttacttaggagtcattttgtgtgtcctgtgaatttgaagtttcatatctttttctgctctggattattttgttttcttcttccccttctctctcttcctcctttgcattttctgggtcctttctttttataatttttattagacatacattagaatattacctctgtgtcgattaactttttttcacatttttaatctttgttcattttcagtgctctctaaggcaattccttggctccctcttccagttcactctttttatcttcagctgtatctcttctactaattagttcttccattgagattcatttaattataatcaacctatgtttctaaagcaacatttattaatttttttgaataattatttaaatatgatatcttctcaaatatctcaatggatggtaaatagatacatacaacttttttatttttctttattcttttattctgttttggtttttgtttgtttgtttgtttggtttagtttggtgttctttttcattgtgttttacttcctaaaagcattcttgattcttgtttgcctgttcatatttgagacttaaagcctagattaagtattggtatctggaatttatttccccttcctatttgggaattcttggaacttggatatattgtcttatgtctcaggaagggtctggtaccaattctgggaacacatgatatcaagaacatttactttagagggaaatatttttatatttatcttacaggcaaactccactgtcagtcaaggactgtttctcccctacttcatatcatccccagcccacaccattatttgcaattaatttaggctctgatatacttctctatggcccaaaagtcacacttgaagtattaagataatgttttcatattgtttagaacttaatatcaggtctttattacagattacataggccaaaagcttaatagctacaggccagtgctaattatttatctatgaatctatgcgtgtatgtacgtatgtatctatctatctatctatcatctatctgtcatctatctatctatcatctatctatctatctatctatctatctatctatctatctatctatctatctatctatcatctatctataacccaatagttacatagtccagtactctaaatacaaattttttttaattttattattattatactttaagttttagggtacatgtgcataatgtgcatgtttgctacatatgtatacatgtgccatgttaattcactacttctgacgagcagtagagactctttctgctatttgtatttgttgactctgatcaggtagtttttctgaggtttttaaaaagatcaattttccctctctcatctagtctgatgttagtaactttcctatctatgcctgttttttcagtaatagcatatatcacacaacgtgatgcactcagtaaacattgttttaaaagtgaaaacctgaaccttaacccatttttaatccattttattttcacatgtgctctttctagtgtttcaaggcttcttgccacctgacactcatttttactctctgactcttattgatgccatattattttcattcatgtttttatattttacaatgtatttacatatctataagtgatatatgccactttcatgtgttcttgcattttacctaaattgtatcataccaaacttaatgtttctactaaaattttgaaaaattttccatgaggatacatttatacctagttcactcaattcaactatgtgataacttgttctcaactattctactgagcattcaaatgtttcctatttcccccaatataactaagactttaaccacatcatttatgcttttttgtgcacatctgcaagagctacttgaaatcgtcagttctcaaattttgatctgggagttctggaagtacccaagattctttaagggcatccataaggctaaaaaaattataataaaacagataatcctttgcctttttcacttttcattttttcatactatacaactaaaatttcatactatacatttggaagatttgcatgacccagtaagccaatattttccaaatgcccaataggtgaagttataaaattatgcatgagtatagacttattcatagcacaagaaaggttgtttctacatctttgctattgttaataatgctgtagtgagtatgggggcgcagaactctttttgacgttctgatttcaattcattcggatatttactcagtagtaggatttctggatcaatgggcacaaagtttcagttagaaaggtgtaataagttttggtgttctggtacatagtatggtggctgtggctaataatcatgtattacacatttctaaatagttaaaacagaggattttaaatgttctcatcacaaagaaatgataaatatttgaggtgacgaatatgctagcctgatttggtcattccacaatgtatacacatatattaacatcatggtaccaaagaaatacataaaactattattttcaaattaaaaaatttttaaaacaaagtaacggattttagtgtaaaagtgtccaaaatatttattgacatggctacagtttccatgggagtaagcatttttaaggaactatttattgagtcctactaattgggttttgatatagtataatagtacatcgtataaaaagaatatccataattatataaaaatattaaaatactcattcctttagcaaatacatatctatgtgggacccgattttcttcatatagttcaaccagaacaacatattgaatcagaattattgcagaggcagctatgtgaatccaaccatctcctattaaaccagatgaaaagatataaacagtgccactgttctcactattttttttattttggaaaaagtatttttcataaaatatgtcattttaaaaagtaccagatttactatgcgattttaaaataaattaataaatgaagtttatcaggtttaacttctgtatggtaaatgttgacatatataattcacaaaaataaaacttcttaaggccttcaaaaatttttcagagtttaaaggtgtcccgaaacaaaaaaaaagtttgagaattgctcttccaagggtatacacttagcagtggaaatgatgaggtgtaagatatgcaccgattttagcagatattggaaaaatattcttcagtactgttataccaaatataatgccaccattcacaaagattcttagttttttattttcatatcattgccaatattcggaatattgggaagttttatttttcaatatggtgggtgtgaaatgacatataattgttttactttatatttctctgcctgttttggtaccagtgccatagtttactgagaatgatggtttccagcttcatgcatgtccctaaaaaggacatgaagtcatcctttttatggctgcatagtattccatggtgtatatgtgccaaattttcttaatccagtctatcattgttggacatttgggttggttccaagtctttgctattgtgaatcatgctgcaataaacatacgtgtgcatgtgtctttatagcagcatgatttataatcctttgggtatatacccagtaatgggatggctgggtcaaatggtatttctagttctagatccctgaggaatcgccacactgacttccacaatgtttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatggcgagcattttttcatgtgttttctggctgcataaatgtcttcttttgagaagtgtctgttcatgtcctttgcccactttttgatggtgttgtttgtttttttcttgtaaatttgtttgagttcattgtagattctggatattagcctttgtcagatgagtaggttgcaaaaattttctcccattttgtaggttgcctgttgactctgatggtagtttcttttgctgtgcagaagctctttagtttaatgagattccatttgtcaattttgtcttttgttgccattgcttttggtgttttagacatgaagtccttgcccatgcatatgtcctgaatggtaatgcctaggttttcttctaggattaaagacttaaacgttagaaaaggggatgagtttgaaagaacttgatggatcctcttgctgaatgtttcctagcaatcagatgtgctaatcatggttaacccaatgtgttaaatggatgaagattgggaacgaaggctgtgtcagtgctcacttgccacacaaggatgaagcatactcaaagactccccaaaaccccttcacgttccaagagggataatcagtagataaaaactttaaaaccaaaaacgttttataagggacacactctacttactgatatgtgtgaatgcaaacctgaaggtctcatttggaatgtgaaggtgtttgtggaattcctgagcaagcttcactctcactctatatataagcttcactctatatatatttatttgtggaattcctgaacgagcttcactctatatgtagctagttaatacaaatacaaacgaaattaatcacatgaaagcaaaacttattttttaaaagaaaaaaacatggactttttaaaatctagtaatataggcaatgagattcaagaggatgtgacatccattaagttataatgttgcagccataaaaagagtatgcttgttactaagggcacaattgttgaatcataggatatgtttagtttagtaaataaactaaacaaactttctttgcaagtggctatatcattttgcattctgatcagcaaagaatgacagtttcttttcccgcacatccttgctggcagttttcgattttagccaatttaatatgtctgtaatggtacctcattgtttcttagatcattttaatagacagtcagatatttttttgtgtctatatccagtaatgaaattgctaggtcaaatggtatttctgtctttaggtctttcaggaatcgccacactgtcttccacaatggctgaactaacgtacatgcccatcaacagtgtataagctttgctacttctccgctacatcactggcatttttgacttgtcaatggtagccattctgactggtgttagatggtatctcattgtcatcttgttttgcatttctctaatgatcagtgatgttgggctttttacatatgattgttggctgcatgtatgtcttcttttgaaaagtgtctgttcatgttctttgccaaatttttatggggttgcttgggttttattcttgtaaatttgtttaattgcttacagatgctggatattcgatgtttgtcaaatgcatagtttgcaaaaattttctcccagtctgtagagtgtctgtttactttcttgatagtttcttttgtagagcagctctttagtttaattagatcccaatcaacctaaatgcctatcattgatagactgcataaggaaaatgtggtacatatttaccatggaacactatatagccataaaaaagaatgagatattgtcctttttcagaacatggatggagctggaggccattatccttagcaaactaacataggaacagaaaactaaatactgcatattctcacttataagtgagagctaaataatgagaacacatggacacataggagggaacaacatacattggggcctttcagagggtggagggtgggagaagggggaacatcaagaaaaataactaacagatactaggcttaatacctgtgtgatgaaataatctgtgcaaaacccccatgacacaagtttacctgtgtaacaaacccacacttatacccctgaacttaaaataaaagtttaaaaaataaaaaatagagggcagaataaactcaactaaaaataaaaatattcatttagaaggttagctcaaatatttcaattgttgtcaagatcaatagcaaaaagaaatgaaatgaaaaattttaatagctcttgggacataatttacatatcataacattcatgcattttaaatgtacagttttatgacttttataaccatgtttatacatgttttataaccatgatcacaatccagtttttaaaacatattaatcaaccccaaaattctcatcatgacactttgcagtaaatccaggctctcactcctggccttacataaccagggctgtactttctctgtcatatttctaaacatttcatagaaatggaatcttactataagtcgatttttatacctggcttcttttgtttaaaataatgcttttgagattaattaatgttgttgcacatatcatcagtttgttcctttctacctctgggtagtattgtgttatagacatacagctcattttgtttatcctttcactagttgatggacttttggatttttttttaagttcaaggctattataagcaatgatacttatgatcaatcccaagcaacgatttgtatgaacatttatactttattattgttgggtagacacttaggagtgcaatcgctagactttatggtaatatagatgtataactttttaaagaagctgccaagctgttttccaaagtagcttaaacatttccatttttaccagcagcgtatgaagtttccatgtttttccaaatccttgccatcgcttggtattattagtcttttggcttatagtccttctagttggtatgtaatagtatctctttgtggttaaaatggaaattctgagagaaaaccttacagagaaaaaagaaaaattgaagaggtatgactatatttgacaaaattttcaaaaaagaaaatggcatgtaagaaagaaacaataagaaaggtaggatttcaatgacaaatgttgaataatgatctctatccagatatatttttggttgtgtttataaacttcaatgataaaggaaaaaccatgcggacttccaggcagacaaatatattacctacaaataaagataatcagattaatataaaaattattatttaccacactaagttctggaaggcaatgtagtagcacacagcatgaagacaaacaattttgaacttagataaacagcacaattggtattcacaaatgaaagcaaaggaaaatactagttaacttgcctggggaaaaaatgagaaaatattgtagctaaatgcaaccatgaaaataaaaaacagaatacagaaatcaagaaatgataactttcatataaacaaataattacaatgtttaatattgttattcgaataaggtggtgtgagaacacaaaggaaggaaaattcaacactgcctgaagatatcaaaagaggcctctaaaaggagggagcatgtgaattaaaccttgaaggataagtccaatcaacaggtgaacacatatggaagagggagcatagaaaaaagaataaggaaaatggatggataaaacagtgattctttagctcaggtctaaaaaactaaaaataaaataaagcttcacttgcctatctgtagcacgaatatatttttgaatacaatttactaaacagttctaacacatttgttcataaaacatatattaaatgtgtattatttgtttttccctgtgtcagattctgggtgttgaaacaaagtaagttatcattcatattcaacacctgctcatagtgtagaagaaataaaatgaagaattacacaagatattataatatataagaaatcaaattattcaggacacagactctgacactctgaaatttgcatccaggagatttattcagcaattctcttgaaaaagagtcccaggtgatagaagaggattgggtgggagagagacatttaactgtcatgcaggctcaacaaaagtttcaggtgattccatagggatatctggagttaggctttcccttaagagatttcctcaatttagccaaaggagttaagccatgaaagtcagtgtagaggagaaaaaaatatcttccaatgggcaaagcttctagaagttcacctggtcacacactgtgtgaaatgaggagactctaagatgagtatatacattcctaggctattgccaatggcctagttgtctggttaggagcttagaaggaaaagaaatggagagtggagaaaatgaggtctggaatggagtcatatagatagacataaggaagtgggtgcaaagtgtgaagattttatatggcacattaatgtccatcagaaaccatccatgatgaaagaaccactgtaaagtagtgcagagtaaagtattataaagtgttgcaaggtatataaaatggctctgccagtaaatactagccagtttttacggattcgtcactatcaaactggcacaacaggcacgtggactgaccgtccacagtgtcagaaataccggctacccatcaacccatgccaaatctatcagtaacagagaccaaagcgagcctgatacaacactatttctcactgagaccaatttgccactagatggtaagataaccagatcaggcctctttcttgaaagaataagaagtttcccctcacagagatagatacctattcaaggtataggtttgtcattcttgcccacagagccttagctagcaccacctagaggctgacagaatgcctgattcaaaattataggatctcacacaatacagcatctcactaagggaactgccagaacataccatctgaccattggtcatgttacataccacactatccagaagcaagatggcctcattgaacactggaacagtcttctgaatgcgtagctaaactaacatctagaaggcaacactttgaaagaagaaggcaccattcttcaggatacaatgtatgtattcaatcagagacttctatatggcactctgtcctcaatagaaagcatacataggtccagagacaaagggtaaaagcaggagcagcgccacataacatctttcccagtaatctgctggggatttgagcttctaatctttgcaactctgctcttgtaaccctaggctttgcgggtttggaggtgctggtccccaagggaagcatattcttgccagggtgcacagtatggatttcaataatttataatatatggctccaaacaaggaattttggactccccatctacagatagcatcatcgaagaatggacatcatcagtgtggcaggagtaactgattctgattggaagaaattgatggggcttcttttacacaatgaggtaaatgaggacatgtagcaccaaagtgatctgtttaggtaccttctgattataacttgctctatcttaactgtgaatgaacacatgcaacatctgagtctgaaaaggatacaaaccaaggtctcagtccactcaggtagaaagttttggttataataccagctaagctaactgaggtgataactaagggtgaatacaatatgaaataatggaaaagagaaatggtgaataccagctgtaatcttgagaccacctgcaacatgaaaggatatagttcctcccactatctcctttccaaatttcccctcaggaagagagaccataggaatcatggagaagctgttccctaaatgcaggacgaaatagatctgcactgtcacgtggagtctgatggccataaaaattcaccactccttctttagaaagcataattgactaacagcccaacttctgctctgctggatcctccctcacactgtgctgaggccatgcttacttcaggctgctggtagccagcaccgcggcacaatgaggacactaatggaagtaaggctggaatcccttgacaggtgaccatggcttgaggactccccataaacccagccaaaactttctcagactctagaatctttccaatcttttttcctccacctctaactcaaaagagtgaaaccaacatcatggtctgaaggccctccccactttctctgtcttcctctcctttgtccttcacaaacatttcctgatatatatgtcttgcatatctaatttcatatggaggatgcaaatcaggacagaagggatcatgtcttattcattcttttactttcagcactttagagagtgccaggtatatatagagcttaaatctatcccattttatactcagaactcaagagaagttctgacatgcagtagttattcagtacatatttgttgaataaatggatgcaatcaagaaatgtttgttgaattaattacagtgatatctaaactaatgacttcatataatctaataaaatacaaatttcagttatagcaatttattggcatcaagcgtatctcaaaggatatgaattttaaatgctttgaaaataccttcaaaattttatgtgggaaatgtgcatatgttaataacttggtaaaagtaaaggtaatttaggttaacaatgcattagagttttaagacaggttacaaataaccttatcggttaatgttctttttttttttttttttttttttttgagacggagtctccctctgtcgcccaggctggagtgcagtggtgcaatctctgctcactgcagcctccacctcccaggttcaagtgattctcctgcctcagcctctgagtagctgggattaaaggcgtgtaccaccacgcccagctaattttttttttttttttgtatttttaggagggatggggtttcaccatgtttgttaggctggtctcaaactcctgatctcgttatctgcccacctcggcctcccaaagtgctgggattacaggcgtgagccaccgcccctggccctgttaatgttcttaaagagtgatgaagtaccttgtccttagaaatgagagtttgtgatttcctcaaacattttcatattcttctggataaaaattaatgttattggaatgttaaaattatcatggttgcaaaatttctattgatattaaatactatcattaaagtggacaagaaagtataggactaataaatttaacctaaaagggatgatatggtactagcaacataaaatgaacaataatttaatattattaatgtataagtcagggtggactgccataacaaaataccacagactgggtgacttaaacaatagaaaattattttctcatagacctgtagtctgggaagtccaagatcaagttgctggctgattctgctcctgatgagggctctcttcctagcttacagatggccatcctcatggtggagagcagtaaggagctctctggtatatacttttgtaaggacactgattctgtcaaattaggactccatccttataagcccatttaactttaatcacttccttaaataaaatatatccacaatgagggttaggacattaacatatgaattttgaggggacacagttcagttcgtagcgcctaataaacactcaaagttgaatctagctttttcttggacctacagttacagaatcagtgttcatttaagtctgacaaggaggaaaaatataaatcgttttgtgagcatttgaaaggaataaatgttgcaagaacaaggttggaaaatacgtgtaggaacactgcatcatttccacctttgcaagtaatccatttttggctttctgatatctctatattccctctctccctctccctcttgtcactctaccactttttccactctcagtctttttttcccttcttcccaaacatctgagtatgaaagttatataatgatggacatgtacacactaattataaaattacaattcttgatggtgtttccagtttatcaaaagaaacagagtaacaaagcattttacacaaataatacccatttttcccctcgcaaagataaaatttgatgtaagagaatactgcagtccccatactgtctttattttgctttgtctagcttggggcttctgagactacggcaaccaaagcacaaaacaatcatgtcgggaaaggttagtatatttggtttctgttgttccctgtcatattatggcaagcttggtggtcttaaacaacttctatttattagttccaagttgtgtatgtcagggtcaggcagtgtggctgggttctccgctcaaggtcttacaagctaaaagcagcgtccaccaggctgcactcctagctggaggttctaaaagggatctactttcatgctcattcaggttgttgtcagaatttgttattgcagttgtagaactgaggccctttctgtttttctagctgtggacctgggatagctctcagcttacagacattgttctcaggtccccccacccaggcagccccttccacttcagcaacggacgacatcctttgtatcaaaaccgtcttatacagaaaatctctctgacctctatgcctcaccactgagagaaaaactgtctgcttgtaaagggttcacgtgattaggtcaagcataacaaaataacctcgatatcttgaggttagctgggccatagaatgtaacctaatcacaggagtaaaactcatcacatttacagctcagtggatcaaacagggaagtgtacaccacagttgggaatcctggagaccatcttagaattcttcctatcatagccagttagaaggaaaattagtttttaaaaaaattatcaacaaataaaatctaaaaccccatcttgttttcaaaaatgtctttaaaaacaagtcactttaaaaagtttgtgtgtgtgcatttataaacagaaataatctgtcactttttgtgatgattcttcatcagttttttacttactaggctggtatgtacacacaatttaaaaaaagcaattgagaggaatttaagttaagtttaaggcccaactccataactcctaaatttattctttcattttggaccattttcctccttgttcaacttttgagtttctgccacaaaaacaaagctctatattattgacataaatgctcataatttttttttaggaaacagagattttcctgctggaatatgcatagttcagtctagttcagcatttttatcaagaaaatatatataattatcaattctaaaatgacacaaattgtccaaatcatccctatacattaccattaatagctacaaagatactatttgtatcagcctgtcgtttttcttatgaacattatgtaagacactttaccagactcactttttgccttcaaactattactctcacacttcccactcccaactctgagtcatattcatttttatactaatctttttaactgtgaagtaatttatttgaactgacattcaggtactttatgtgaagtcatgtatatagttttaaattaaagaaaagaaaatcaactgaagatagtactctcattctagactttgaaactttacataactggctacactggatttttatttaatttgtattctcagctgtaataattctctgctctggaaatttatgccagctatactctgaaataacactggagattcatgcttttgaaggctatattggaaatgaaattctcaactgggaggagaatcctaattcttgcagtagtgagcgggagcttttacctctctctccctgagtaaagcaactagaatcaatactgcctagctggaatcccaaggtgtctccctagagttggattcagaatatgtccactactgcctcgcatccaaagtcaccaacactggccaactgtggccatactatacaatagcaaaattctcaaatttggagatgttctttgtggactacatgaaatgatttctgaatatctgatcctgttaattaatactttacaaaactcttgaaatgaaaaaaaaaaataaacaaatgctttctttatgaagacagattaaattatcaaaattgtttgtttggaagcaaatgagattagactacagatgctccttagctgggtgtaagcagagtaaggtgaaaaagattggtgttttcatcttgatggcagctgcagagcactgtgaggcatgtttctatttacataaagattattctagaagtttgccactggaaacacaagagtgagaaatccaagaaactcatgagtcttttaagtgtcagctaacagggcaaatggaagacaaagtttctagaccttctgaaacttgataaaaacttacttagagtaatattttttgtgaaggaaaacacagtgtgcagcagacaatccaagcttttgaaattgagaaatgaaggaatattatgctaagtgttgttctacaggagaagataaatctttaagtttatgtcaaataagggtgatgtttgagctgcaaagtgtgcagtaatgctgatgctttgaaaatgctactgtttaattaaaaattgagtaatagatatggattggtggtttggttaacggaacaagcagcatattacttttactacttttcattgtgtaaactcaataacctttttaagtatttagttttcatattgataaaataccagtacataattcttgaaaaaatttctcatcagcagcagcatcatcattgtatgaagcatctatgaatgcttctcttgatgtacaatgccaggcactatacaactcctattctgaaagtcacagatatgcagtccaagtactcccaagtgtaatagaaagttatgttgacagggattgatatttgaaaaaggaaactattcagctaagaaaaaaagtaaacaaatatttatatgttaaggaatagatgcatttgatgtcgtagagcataaagagaaaatccaaagcagagcctggaatagaaagccagcaagtcagtggtgaacttactgaacacagataattcctgctctcctggagcttgagttctaatggtttgtgaaagtgaactactcagactcgctctgaggagagccacacagatgaagtggaaactttctgatagatgggcctggtaaagttgcgttttacctatagggatttattcaaaaatgcaacctaataaaagagaggcaggaagagaaactgagtgaacaatgagggtatgtaagatatatgcgtgtgagaagttatgtaaaatgtagtttaacatagatatagagagtggaatgataggcaatggaaactcagagggggaaagaacaggagggggtagatgatgagaaattatttaatgtgtacaatatattatacatgattcagatgatacatcccctaaagccttgacttgaccactatgcaatctatacatgtaacaaaattgtacttttaccctatgggtttagagatttttttaaaattaagaaataaagtataatgtcatgaagaaaatgcataatagataaagcaggatttcaaaaaatatcacaaaacaggacatgaccaaagatgcctgactctccacagagcccctttctaccaatctctgctgagactctcttcaagagaccattcattggatcttattgaatctgcttccatttgcatgccagtcacatactatgtcaatatttggataaatttttgtttatttagccctcatctctgtcttgtttgtttgtggaaactcacagaacctgtcttagtgaagtatatataagatttcaatgtatgtgttttggattgaataatttgattgtatatttatattcaaaatagcaaaacgaatattttatttctcttagattttgtcacaatgtattccactttctcagattatatacattaatttcctatctttgggtctttcaaaatattttatgaagaaaagagtagggagaatctattaaataaaacaaatatagaataataatgtatcttataaagtttcaaggatttttctatcaaagagatatcacatcatccagcacttctagttaatgactccaaagagacatcatacatttagtttacataaacttcattctgtgactttatttgtgtgtgccttcttggagaagtgagctcacgaataaacttccttggtattgattgccatggatgatttcacaggttaagaaaggggcaggggaaacaaaagtgtacttggctgaagggcttttgtgaaaaataaggctgcctcttgagtggtcaagaaatatcacaagaagagaaaaatggtaatcagaaatttatgtaggctggttgcaagtcacactgacctaaggagagtcctgagatgaagtaaattattttcctctatgtcttggacagcttatccttatgtcactgtgacccaaccagtttccctggatacagccagtgtccatgtgtagggggctgaaagaacaagtgaatctacatttatgctcttcatcacacaaaaaaaatgcaacctaaattttaaaagcaagtgcatgttcatttctaaaacaccaaaaacaatggcaacaaaagccaaaattgacaaatgggatctcattaaactaaagagcttctgcacagcaaaggaaaccaccatcagagtgaacagacaacctacagaatgggagaaaagttttgcaatctactcatctgacaaagggcaaatatccagaatctacaatgaactcaaacaaatttacaagaaaaaaacaaacaaccccatcaaaaagtgggcgaaggataagaacagacacttctcaaaagaagacatttatgcagccaacagacacatgaaaaaatgctcatcatcactggccatcagagaaacgcaaatcaaaaccacaatgagataccatctcacaccagttagaatggcgatcattaaaaagtcaggaaacaactggtgttggagaagatgtggagaaataggaacagttttacactgttggtgggactgtaaactagttcaacctttgtggaagtcagtgtggcgattcctcaggggtctagaactggaattaccatttaacccagccatcccattactgagtatatacccaaaggactataaatcatgccactataaagacacatgcacacatatgtttattgctgcatgattcacaatagcaaagactaggaaccaacccaaatgtccaacaataatagactggattaagaaaatgtggcacatatacaccatggaatactatgcagccatacaaaatgatgagttcatgtcctttgtacggacatggatgaagctggaaaccatcattctcagcaaactatcgcaaggaaaaaaaaccaaacaccgcatgttctcactcataggtgggaattgaagaatgagaacacatggacacaggaaggggaacatcacacacctgggcctgttgtggggtgggggcaggggagagggatagcatttgcagatatacctaatgttaaatgacgagttactgggtgcagcacaccaacatgacacatgtgtacatatgtaactaacttgcactttgtgcacatgtaccttaaaacttaaagtataattaaaaaaatgcgttgtaacacttatggcaaaaaaacacaattacctttgcaccagcctaatagttaactgtcagatctaatgaataataccatttctaccaagtagttagaatgtttcatttttatcactttgtcctcaattcttaactcttcctccttccctgaatagaaatctgttttcttcctctcaaatcctactgatattcattgccttagtcctcatcatccttataatggttttttttcattggttcctcttactccagtctctccccatcctgtgcaccaaagttaccaatctcttccctatctcttccaccagggttgctttctattacacacatctgattggatctcctcatagataatgtcttctaatgactccatcttgccaattggataaagttaactttgcttggcataatatacaaagcccttctacatacaagcttatatttcctctccaacctcatctttatccacctttcctctatcacaattccaaactggacttttatatacatgtcatgacgcgtgatgttctaaacacacttgcacttttttttttttgactggtattgtgggctatttattgttgcctagaattgcttccaccaccttgtcctctcattcttccccttggaatccctccatgactgccccacacagaattagttgcacattctttttctgcaacccttagtattttgtacataacaatattggtttatagtaatttacctgctttacaattatctgtttacttgcctttcatctctactagataatgttttccataataacagggctatcttagtcatctttgagttcttggtccccaaaataatagatgatcaaatgtcaatgaattgaaatttgatttttagtttgaaatgtaactattctatttctcaaatacattatttgtatcaaagttttccttaattttttttacaaaagaattctctattatttaaatctggcctccagagtcacactaacagtctaatggaaaatttaaaaacaccttcgtaatcccttttgtgacaatctcaggaaagcaggtcttgacaaataatgagttccacaactcaggaaggaaagtttggtctcagcgataatagtatgaaatactttaaaaattctaaatttcaagtggagggaagggcctgcctctggatgttcaaaagtttttgtgtggatccacaacactggtgtcatctcaaagtttgcaagaaacacaaaggccccacctcagactttccaaatcagttttactccccaagtaattcagatgcatgttaaagcttgagaaacactgctctgggagagatcagtatgagtgtatgtgtgtatgtataaatattaatatcctaaagtaatactaatgtatgtataacatttattaatacacacactctatgtgtgtgtatgtgtgtatgtataaacatttattaatatcctaaagtaatattctgagaaatgccctttgggatatgcttgcctagctcatacattataggttagtcttgttcctttttcttcttcaccagaaaacctatttacttcattttatgtatttcatttagctttgatatttgacctttattccaacacatctatctcatccctgacctaggaaccaagtaagaagccactgaaaaatatagtttcaggaaagttttaagcatttacttgcccaagatcatcaaggttctgtgtatttataaccttagctatctggtctccaattttctggcttcacagtctggttttcaaagtgagtctgaattcttattttgatgtccattctatcttaccagtttctcatttcacaaatctgaatgatttcttcattttcatagtaaccgtggctctgggaaacagaacatccttcctctgtcctagcaaaaaaaaaaaaaaagccattgataagtttagtctcctactcaacacctttctcttaagacaactgaaattgtaatatttaaaaagttatttccatttaaactgtacattattttttacctaaataaatagctctgcacaagataagatgtaaaaaattctaatgttacactgtgtcaatattcatagagataagccttgaggtagaatgtttagccacagatcatcaaatatcatagagacttacttaaaaaataatggcataatattttatgtttctttcctttattaaaaatatgttttccttgtttagaggagtagcaaaatgtttttaaccccaggtcctacttttatacactcattttcactatgaattcaagatacaataaaagtaaatattgggttcagtaatgacagtgttttcatttacagtgtcttggctaactggtttccaaatttctggctctgtaatattctgagacaacctttgggatatgcttgcttagcttatacattacagcctagtcctatgacttttttgccagattacctatttacttcattttatgtatttaatttagctcagatatttgacctatatacaaatatgttcatcacatatgtttgtcccttgcttaaaacaaatgaatacaggcaaaagttaagatttcatttagttttacagtaaactactacctaacctagatgcccatttatttacttatttattttttattacactttaagttctagggtacatgtgcagattgttacataggtatacatgtgccatggtggtttgctgcatccaacaacccatcatctacattaggtatttttcctaatgctatccctcccctagccccccaccccctgagaggcccaagtgtgtgatattcccctctctgtgtcaatgtgttctcattgttcaactcccatctatgagtgagaacatgaggtgtttggttttctgttcctgtgttagtttgctgagaatcatgctttctagcttcatccacatccctgcaaaggacatgaacccatccttttttatggctgcatagtgtttcatggtgtgtatgtgccacattctctttatccagtctatcattgatgggcatttgggttggttccaagtctttgctatttgtgaacagtgccgcaacaaacatatgtgtgcatgtgtctttatagtagaatgatttataatcctttgggtatatacccagtaatggtattgctgcatcaaatggttatttccagttctagatccttgaggaattgccacgttgtcttccctaatagttgaactaatttacactcccatcaacagtgtaaaagcattcctgtttctccacatcctctccagcatctgttgtttcctgactttgtaatgatcgccattttaactggcgtgagatggtatctcattgtggttttgatttgcatttctctgatgaccagtgaggatgagcattttttcatatgtttgttggctgaataaatgtcttcttttgagaagtgtctgttcatatcctttgcccacttctcgatgagattgtttgtttttttcaggtaaatttgtttaagttctttatagattctggatattagccctttgtcagatggatagattgcaaaaattttctcccattctgtaggttgtcagttcactctgataagagtttcttttgctgtgtagaagctctttagtttgattagatccttggtgttttagtcatgaagtctttgcccatgcctaagtcctgaatggtattgcctaggtttttttttctaggaatttatggttttaggtcttacatttaagtctttaatccatcttgagttattttttgtataaggtgtaaggatggggtccagtttcagttttctgcatatggctagccagtttttccaacaccatttattaaataggggtttctttccccgttgcttgtttttatcaggtttgtcaaagatcagatggttgtagatttgtggaattatttctgaggcttctattctgttccattggtccatatatcagttttggtaccagtaccatgctgtttttgttactgtagccttgtagtatagtttgaagtcaggtagtgtgatgcctccagcttttttctttttgcttaagattgtcttggctatgtgggctcttttttggttccatatgaaatttaaagcagttttttttccaattctgtgagaaagtcaatggtagcttgatggggaaagcattgaatctataaattactttgggcagtatggccattttcataatattgattcttcctattcatgagcatgcaatgtttttctatttgcttgtgtcctgtcttattccttggagcagtggtttgtagttctccttgaagaggcccttcacatcccttgtaagttgtattcctaggtagcttattctcttcatagcaatagtgaatgggagtacactcatgatttggctctgtctattattagtgtataggaatgtttgtgatttttgcacattgattttgtatcctgagactttgctgaagttgctcatcagcttaaggagatttggggctgagacaatggggttttctaaatatacaatcatgtcatctgcaaacagagacaatttgatttcctcttttcctgactgaatatcctttatttctttctcttgcctgattgccccagccagaactttcagtactatgttgaataggagtggtgagagagggcataatctgatgcccttttattgggtcaaattagaaagatacaaatccagtcatttcaattaataattaggtgggtggataatagcaaagcattttgtgcacagattaggacacagctattgcagttttaaaaacagcttttgaataaacctctcaaagataaaggcaattggggttgtggaaggggctgaactcatcttctcatccttcagggacagctactcaaaagtgaatctccaaaccaccttgagattatatcatgaccaaagcactagaaagcaatttaggttatttgtttatcaattcttccccttccaccaccacctttttttttcaaaagtttctctaccacgaactgaggacaaaagcttggatttggattaagtgttgattataaccaggagtcaaacaaaaaggacctagtttgaaataaccagtgttattttggtcagtgacatcttgttgtggcacattcagcatatattaacaatcgcactaaagtttaaaaaactgaatttctcacttctttctatgaagcaatagagcatataattttaagctcatcttctcaatttaagacactttattttacagctttttgacatacataacactagaatgaactagtgccaaatattcttcaactgtgttctttttgctggtctttcttcatttttgaatcttttttataatctctattctgtctgaagtagtttgacaaaatatcaaggagaatgtattttaagttatgagggatcaacaaaaattttcatacaggagtagttcattgcaagtcttcaaagtgccacaaaatcaactgtactctttagcctggcattcaagagcttttacaattttacccactcaagttctcttcttatacccttgtaaatgaagtctcctatctagtcaaactagcctactcatggttccttaaatataccctttgtgtttctgacgttttatctcttgtgcatgtcatgtcccctgcatgaagtagctttcttcttgctttcttcttctgcctccaccctatgcatcttttaaggcacaattaaaatcccattcccctgagaagtctttctttatttcccccaacattccttattatcaatgtttctcatgagtcatattaaaaaccctaatttacattgttacttatccttttatatgtaagttctgtgatctttcagagaataagaatctatatcagggatcagaaaattttctataaagagccagatattaaatatttaaggtttttaggctaagagtcaaaatttaggatattacataagtagtcataaaacaagacagataatttaattctacaattttatgaaatttaaataataagaattgagtacaatcttaaatctactgatgaaaagaataacaatatttggagggatagcattttgcacatttggaggtcaaagttaactgactacaaatattcatctcagtgctgatttataattagattttatgtacattcatgtgtcacagaataatgttttggtcaacaatgagcctcatttatgatggtgttcccataaaattataatattatatttttgctgtattttctctatgtttagatatgtttagatacacatatatttcccattgtgttacaattgcccagagtattcaatacagtaacatgctgtgcaggttggtagcctaggagcatagagcctatgttacacctcacaatttgtgttaagtacactctaaaaagttagcacaatgatgatatagcctaagagcccatttctcagagcatatttccatcattaagtaatgcatgactgtatttcatgtttgaagctgtatttttacatagacaggtattgtcaaatactgatgatattgacttcaatccacaagcatgattttagttgagtatattcatcatttggaagatatcaatggaattctattagccttttagcatgtcagcacattgcagattaatccttctaattaaaaattaagttgaaactcctcaattgcaaatatagattttgaaatgcatagatttcttttgcacttgcaccaaagtttgaactatgttaatgcagctgagatttaagcaaatacatccactataatttgtgtgagaatggagatttgcttcttgtttcaacttttggcagcacaggaagtatataaagcagtgtgacattacttgtgattcaaaaatgttagttgtcaaaatgactttaccatagtgtgatttttcacatataaacactgctttttcttggagttttaggttaaattcattaagaaacattatcaaaatgatacctcttttctcctttagaaaaaaatataatctcattcgggagccaaaaacatcaaagaaagagaaaaagaaaaaaaaaaaaaaaaaaactctgccaagtcatcaaactaccctttggtgaaagaactcaggatatttaagataaagttcatcactgacactagtggttcaataacacataatggagtcaaacattttttataaaatagttgctaatgaataatacaatgaataagcttttaaaatcttaacagatttcattccagtttgtattgaatttgagttttctaaacttctttgaaaatatcatcgtagatattcacagaggctaatgcttaggtcacttcaaactcagctccgagtacttgacaaagcaatatcgactgagcagtgttggtagcatcaggcaattcatcaggaatgaagtaaaaccaggaaaaaaaaattgttttgttctttttttgatgctcctcccaaagtcctcaacaattcaaacaactattcttgcctaaaggctaaaaatttaaacaagtttattttctatggacaaatttcttcagcacctgaaatcaaacatgatttaattaactcaccattgttaagtggctttccttgactaacaaaggaggtacttgaaaagttactttgcagcctccttttaattttttttttctttcttgggaagaaaaccacactgataagatatctcattttagatttcctcattttttggccattggtttcctatgaattgggaatattatgatggttgcttagtctgtgatatcgtttggctgtgtccccacagaaatctcaacttgaattgtatctcccaaaactcccacatgttgtgggtggaccaagggagaggtaattgaatcatgggaggtgatctttcccatgcaattgtcatgatagtcaataagtctgacaagagctgatgggtttatcgggggttccacttctgcttctctcatttttctcttgccatgtaagaagtgcctttcgcctcccaccatgattctgaggcatcctcagccacgtgggactgtaagtccattttttttcttgttcttagtttcgggtatgtctttatcagcagcatgaaaacgaactaatacagtctggtaatggttcttttaactagcgatagtgtcatcacttaataaacagaatgttttgtcatctaagttaataacaaacttattcacacttcacttggccacaaaatagtaacattcaaagttcactttctcttctttttatgttttgatgaaatggatatgcactgtaactaaatacataaataaatacataaataaaacaaaattttgaacaatatacatgacactcaaaacacctttgagttataactgtgatttttgtagagtgctgagccgcagtgaaaagcaatgagagcaccatacatgttctctgttccagttgccccactctgccattgcagcacagagacagccatggacgatatgtaagtgaatgagtgtgatatggtcctataaaagtttctttacaaacactgaaatttaaatttcatttaattttcatgtgccaggaaatgttgttattattcaactattttaaaatacaaaaattattcttagtttatgaaccatagacaaataggaagtaggttacccttggcccaaaggccgtagtttactgacccctgatatatactatgtgcttaatacataccaatgcagagtgtgcaatcaagaaatgttagttggctaaaaatgacacacttatgtatttggttaactgatgttaataaattaaaatttctattaaaagattttaattaaaaatttatattatatgtatttacctgatgctaataagttaaaatttctataaatatggatatactctttaatctgtgcattggtgaagaaggatactctctactatttattcataaggaaccagaaatatgctgtcaagcgtgtattagtaaaaagaagcaaatgacctactgtgtactactgaagtcaattaagactaaggtaatttgagctaatctgtatccacatccacctgtttggaaagaaaacattatactgatcagtgctgggctatttaaaaatttatagtttcaaagtgtttattggttatgcacctaaactttaaaaataatgcttttaaatttttgcttctgaaggaactcgttgaataacaactgtgatgattcaaatttagacaagttttacttatttgactgtttttcttagtttagatttgcatccttggaaagcagcacaaggtaaataatttatttctgtgcattgggacactgacttctgttgtaacaactgggaggttcattctgccctaaaaaccagttgagaacatataggcagcttacaacattttctatttttgtgtctgtggaaaattaatcatgattcaataaattcgccctacaaaagcaaacataagggggttacttataacatattttcagattgcaagtttgtaccatctgcctacaatgagccagaacttgaaacattctgaaaatatttagaaaaacagcagaacacatgtttaattcactttatttatttatttattattattattatactttaagttttagggtacatgtgcacaatgtgcaggttagttacctgtgtatacatgtgccatgctggtgcactgcacccagtaactcttcatttaacattaggtatatcgcccaatgctatccctcccccctcccccaaccccacaacaggccccagagtgtgatattccccttcctgtgtccatgtgttctcattgttcaattcccacctatgagggagaatatgcggtgtttggttttttgtacttgccatagtttactgagaatgatggtttccagcttcatgcatgtccctaaaaaggacatgaagtcatccttttttatggctgcatagtattccatggtgtatatgtgccacattttcttaatccagtctatcattgttggacatttgggttggttccaagtctttgctattgtgaatcatgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatggtatctcattgtggttttgatttgcatttctctaatggccagtgatgatgagcattttttcatgtactttttggctgcataaatgtcttcttttgagaagtgtctgttcatgtccttcacccactttttgatggggttgtttgtttttttcttgtaaatttgtttgagttcattgtagattctggatatttgccctttgtcagatgagtagattgcaaaacttttctcccattctgtaggttgtctgttcactctgatggtggtttcctttgctgtgcagaagctctttagtttaatgagatcccatttgtcaattttgtattttgttgccattgcttttggtgttttagacatgaagtccttgcccatgcctatgtcctgaatggtaatgtctaggttttcttctagggtttttatggttttacgtctaacatttaaacctttaatacgtcttgaattaatttttgtatgaagtgtaagggagggatccagtttcagctttctacacatggctagccagttttcccagcaccatttattaaatagggaatcttttccccattgcttgtttttctcagatttgtcaaagatcagatagttgtagatatgcggcattatttctgagcgctctgttctgttccattgatctatatctctgttttggtaccagtaccatgctgttttggttactgtagccttgtagcatagtttgaagtcaggtagtatgaagcctccagctttgttcttttggcttaggattgacttggcgatgcgggctcttttttggttccatatgaattttaaagtagttttttccaattctgtgaagaaagtcattggtagcttgatgaggatggcattgaatctgtaatttaccttgggcaagatggtcattatcacgatattgattcttcctacccatgagcatggaatgttcttccatttgtttgtgtcctcttttatttcattgagccatggtttgtagttctccttgaagaggtcctttacatcccttgtaagttggattcctaggtattttattctctttgaagcaattttgaaagggagttcactcattatttggctctcatttgtctgttgttggtgtataagaatgcttgtgatttttgtacattgattttgtatcctgagactttgctgaagttgcttatcaccttaaggagattttgggctgagacgatggggttttctagatatacaatcatgtcgtctgcaaacagggacaaattgacttcctcttttcctaattgaataccctttatttccttctcctgccgaattgccctggccagaacttccaacactatgttgaataggagtggtgagagagggcatccctctcttgtgccagttttcaaaggaaatgcttccagtttttcccattcagtatgatattggctgtgggtttgtcatagatacctcttgttattttgaaatatgttccatcaatacctaatttattgagagtttttagcatgcagggtcgttgagttttgtcaaaggccttttctgcatctattgagataatcatgtgatttttgtctttggttctgtttatgtgctgggttacattaattgattttcgtatattgaaccagcattgcattccagggatgaagcccacttgatcatggtggataagctttttgatgtgctgttggattcaatttgccagtattttattgaggatttttgcatcaatgttcatcaaggatattggtttaaaattctcttttttggttgtgtctctgcctggctttggtatcggaatgatgctggcttcataaaatgagttagggaggattccctctttttctattgattggaatagtttcagaaggaatggtaccagttcctccgtgtacctttggtagaattcggctgtgaatccatctggtcctggactctttttagctggtaagctattgattattgcctcaatttcagagcctgttattggtctattcagagatgcaacttcttcctggtttagtcttgggagagtgtatgtgtccaggaatttatctatttcttctagattttctagtttatttgcatagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaacaagctcctggattcattaattttttgaagggttttttgtgtctctatttccttcagttctgcactgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtcttttttctcattggtttcaaagaacatctttatttctgccttcattttgttatgtacccagtagtcattcaggagcatgttgttcagtttccatgtagttgagcggttttgagtaagattcttaatcctgagttctagtttgattgcactgtggtctgagagagagtttgttacaatttctgttcttttacatttgctgaggagtgctttacttccaagtatgtggtcaattttggaataggtgtggtgtggtgctgaaaaaaatgtatattttgttgatttggggtggagaggtctgtagatgtctattaggtccgcttggtgcagagctgagttcaattcctgggtatccttgttgagtttctgtcttgttgatctgtctaatgttgacagtggggtgttaaagtctcccattattaatgtgtgggagtctaagtctctttgtaggtcactcaggacttgctttatgaatctgtgtcctcctgtattgggtacacatatatttaggatagttagctcttcttgttgaattgatccctttaccattatgtaatggccttctttgtctcttttgaccgttgttggtttaaagtctgttttatcagagactaggattgcaactcctgcctttttttgttttccatttgcttggtagatcttcctccatccttttattttgagcctatgtgtgtctctgcacgtgagatgggtttcctgaatacaggacactgatgggtcttgactctttatccagtttgccagtctgtgtcttttaattggagcatttagtccatttacatttaaagttaataccgttatgtgtgaatttgatcttgtcattaggatgttagctggttattttgctcattagttgatgcagtttcttcctagtctcgatggtctttacattttggcatgattttgcagcggctggtaccggttgctcctttccatgtttagcacttccttcaggagctcttttagggcaggtctggtggtgacaaaatctctcagcatttgcttgtctgtaaagtatttcatttctccttcatttatgaagcttaatttggtggggtatgaaattctgtgttgaaaattcttttctttaagtatgttgaatattggcccccactctcttctggctggtagagcttctgccgagagatccactgttagtctgatgggcttccctttgaggttaacccgacctttctctctggctgcccttaacattttttccttcatttcaactttggtgaatctgacaattttgtgtcttggagttgctcttctcaaggagtatctttgtggtgttctctgtatttcctgaatctgaatgttgacctgccttgctagaccggggaagttctcctggataatatcctgcagagtgttttccaacttggttccattctccccgtcactttcaggtacactaatcagacgtagatttggtcttttcacatagtcctatatttcttggaggctttgctcatttcttttcattcttttttctctaaacttcccttctcacttcatttcattcatttaaatgttccatcgttgataccctttcttccagttgatcacatcagctcctgaggcttctgcattcttcgcgtagttctccagccttggttttcagctccatcagctcctttaagcacttctctgtattggttattctagttatacattcttctaaatttttttcgaagttttcaacttctttgcctttggtttgaatgtcctcctgtagctcagagtaatttgattgtctgaagccttcttctctcagctcatgaaagtcattctccgtccagctttgttccgttgctggtgaggaactgcattcctttggaggaggagaggtgctctgctttttagagtttccagtttttctgctctgttttttccccatctttatggttttatcttcttttggtctttgatgatggtgatgtacagatgggtttttggtgtggatgtcctttctgtttgttagttttccttctaacagacaggaccctcagatgcaggtctgtcggttgtacccagccgtgtgagttgtcagtctgtccctgctggggggagcctcccagttagactgctccggggtcaggtgtcacggacccacttgaggaggcagtctgcccattctcagatctccagctgcgtgctgggagaaccactgctctcttcaaagctgtcagacagtgacatttaagtctgcaggggctactgctgtctttttgtttgtctgtgtcctgcccccagaagtggagcctacagaggccagcaggcctccctgagctgtggtgggctccacccagttcgagctttccagatgctttgcttacctaagcaagcctgggcaatggcaggcgcccttcccccagcctccttgccaccttgcagtttgatctcagactgctgcgctagcaatcagcgagactccatgggcttaggaccctctgagcaatgtgcaggatataatctcctggtgcgccattttttaagcccatcggaaaagtgcagtattagggtggaagtgacctgattttccaggtgccgtctgtcacccctttctttgactaggaaagggaactccctgaccccttgtgcttcccgagtgaggcaatgcctcaccctgcttcggcttgcacatgctgcctgcacccactgacctgcgcccactgtctggcactccttagtgagatgaatccagtacctcagatggaaatgcagaaatcacccatcttctgtgtcactcacactgtaattcactttatatttaatagagatatatttgttagtttagtacacatttaaacttgttttcatgcttctacatggttacctaattattttgtttatcaatattatttaaaatattacaggctaaattaatgtttattctccagaagaccactagaaaacctgaagctcaaccaaaactcactttatgaaacctatgtagtgaaggagaacaccaacttgacagttttattgatttcttaaaaggaggaagtcaggaaagtcagttttgaagacagatcttgcaagacaggcaactggttgggttgggcagagtttgtattatgatagctttgaacttctgggcaacagtgaagcaaggttctcaaaacaaatcttcatgagaaaagtgtcagacttgttaaatgtgctgtttttgttttactgtattagttttttattgcttcataacaaatcaccacaaatttagtagctttaaacaacattaattatcttatagtttgggaaggttatggcacagcttagctgagtgctctggtcagggtctcagaagtccacaatctagatgtcaaactgcatttctttttcaatcttggcatccttttctaagcacacatcgttgttgtcagaattcagttccttgtggctataggactgagttcccactttcttactgactgttagctaagtcctttcctatccccagaagccctcacagctccttcccatgtggacctcttacagcatctctctgaacatggcagacttacattttcaaagacagagaatcaaaagaggggatagtccctcttttaaagggctcacctcatttaagacaggtccacccagaataatgtcctttttgattttctcaaagtcagtggattcaggttcttcatttatctgcaaaatacctccacttattgccatataacataattataggagtgatacaccaatgccttggccactttctattgtttaaaagcaatgcagagataagacccacacttaaaacgagggcattatgcaaggatttgggtcattgcaggtcattttaggattctgccaaaggtagttagttactctgatcttacaaaagcaaatttttttttggagaaagtagctcaattatttttttctaatccttattctatttagcacaaaaagaggaaagtatgcttcatcataaaattggttataataagcacaagaatgttggttttctgttctgaaagcagagaggtttaacatttcctgatttcccagttaaattctctcagagcctctagttagtggctcagtttttccataattcctattatacaaaagacaaaatgataggcctgtaacaaatatctagcatcctatgttagtttggaccatagatatctgtttcatatctaagcactttgctttctataatacttagaattgtaaaaacaatactagtagggaggtaatctctttatcttaaaagccacttcaacaccacatattatattatttatataatataggcttacttgattgtgtgttaatttgtatctttcaaaatggtttggaactaaggtcaaaattaatcagcaatgagtctttcttttccgcacactgtatctctcgctttctgtgcctgacctgatgctgcttactgtgcattcacgttaccatcttccactgtttgtcatacatttcttgtgacactttagtcttcctaggttcaacaatccattattataatcaatcccatgtccctctatcctttcaaaactcaaacactagtattatctaaatgtcagcttagtccatacccctttcttcacagtcaaatgtaattgaagagaacacaaactataccaacacattttaaatacatgaccactaagttcaagagggcctgttttttgctgattcctgtctaccactcttctgaacaaaatacaaaaaaaaaatttaaatattctcctctactgggggaaccagcccccaatatttcaatgtaggttcttttctatttccctaagtgttggccggtctgagaaataaagggaaagagtacaaaagatagaaattttaaagctgggtgtctgggggagacatcacatgtcagcaggttctgtgatgccccctgagctgcaaaaccagcaagtttttattactgattttcaaaggggagggagtgtatgaatagggtgtgggtcacagagatcacatgcttcaagggcaataaaagatcacaaggcagaaggtcagggtgacatcacaaggtcagggcaaaactagacttgctaatgaaggtccatgtcctgctgggcacacattttcattgataaacatcttagcaggaaacagggttcaagagcagagaaccggtctgactagaattccccaggttggtatttcctaatcttagcaagcctggggatgcttcaggagacaagggcgtgtttcatccctgatctgcaactgcactcctagagtggccatttttgaggcccccccgggaatgcattattttttcagggctgttaattattaatattccttgctggggaaagaattgagtgatatttctcttacccgttttcggtaatgagagaaatatgactctgtcctgtcctgctcccaggcagtcagacttaatggtaatctcccttgttccctgaacattgctgttatcctgttctttcttcaaggtgcccagatttcacattgttcaaatacacatgctttctccctctccctctccctctccccatggtctccctctccctctccctctccctctctttccacggtctccctctgatgccaagccagagctggactgtactgctgccatctcggctcactgcaacctccctgcctgattctcctgcctcagcctgcagagtgcctgtgattgcaggtgtgcgccgccacgcctgactggttttcgtatttttttggtggagacagggtttcgctctgttggccgggctggtctccagctcctaactgcgagtgatctgccagccttggcctcccgaggtgccaggattgcagacggagtctcgttcaatcagtgctcaatgttgccaaggctggagtgcagtggcatgatcttggctagctacaacctccccctcccagccgcctgccttggcctcccaaagtgccgagattgcagcctctgcccggccgccaccccgtctgggaagtgaggagcgtctctgcctggctgcccatcatctgggatatgaggagcccctctgcccggctgcccagtctgggaagtgaggagtgcctcttcccggccgtcatcccatctaggaagtaaggagcgtctctgcccggccacccatcatctgagatgtggggagcacctctgctctgccaccccatctgggatgtgaggagtgcctctgcccagccacgaccccgtctgggaggtgaggagcgtctctgcccagtcaccctgtctgagaaatgaggagcccctcggcccagcagccaccccgtctgggaagtgaggagcgtctctgcccggcagccgccccgtccaggagggaggtggggagcagcccttgcctggccagccgccctgtccaggaaggaggtggggggcagcccccgcccggccagctgccccgtccgggagggaggtggggggcagcccccacccggccagcctccccatcccagagggaagtggggggcagcccccacccggccagctgccccatccgggagggaggtgggggccagcccctgcctggccatcctccccatcccagagggaggtgggtgcgcctccgcctggccgccaccccatccgggaggtgggctgtgcctctgcccggccgccacttctgggaagtgaggagcccctctgcctggccaccaccccgtctgggaggtgtacccaacagctcattgagaacggggcatgatgatgatggtggttttgtggaatagaaaagggggaaatgtggggaaaagatagagaaatcagattgttgctgtgtctgtgtagaaagaagtagacataggagactccattttgttctgtactaagaaagattcttctgccttgggatgctgttgatctatgaccttgcccccaacgctgtgctctctgaaacatgtgctgtgtccactcagggttaaatggattaagggcggtgcaagatgtgctttgttaaacagatgctggaaggcagcatgctcgttaagagtcattaccactccctaatctcaagtacccagggacacaaacactgcggaaggccgcagggtcctctgcctaggaaaaccagagacctttgttcacttgtttatctgctgaccttcccctccactattgtcctatgaccctgccaaatccccctctgcgagaaacacccaagaatgatcaataaaaaaaaaaaaagaaaaagaaaatttccaggctctaacctctcctgtccacactccctgaatttctgattcagtagtcagcggcaggtcccatgaatctgcatctgtagcaaatactccagtattctgattcaggtgattcatggatactttttaaaattaactttaaattttgatataatctcaaatttacagaaaagttggaaaaacaaccccaaatttttcacatatgctttactaagattcatcaattttaaatattttgctatatttgctttatcgttatttgtctataaaaatgttttcctaaattatttgagagtaggttgcatatcatctctatagcctttaaaacttcagtgtatatttcctaagaataaggatattctctttacataaccactgttcagttattaaattcagtgaatttaacattaataaaatacttatatctaatataaaaaaatacacatgctttatgaacaatttgtgcagttaacacaatcatcacagggtcttggggtgacatacatcatcagcttatgaagatgacgggactaagagattaaagtaaagacaggcataggaaattataagagtattgattggggaagtgataaatatccatgaaatcttcacaatttatgttcagagattgcactaaagacaggtgtaagaaattataaaagtattaatttggggaactaataaatgtctatgaaatcttcacaatttatgttcttctgccatggcttcagcaggcccctctgtttgggttccctgacttccagcaacactccttcacttttcttcaccttcagatggtagccttgctttctacatcactgagaaaagtaatgagaacattcacatgttccttctaccacatttgcagaaccagttttatcagttctaatgaactttgccatccttgttaatatgcacaaactctctgtgactccaaggccaaaccctccactgttctacctcactaaaccaagaacattattctagcaatgtttcctaatttatattgcagtatttcttttttgcccctcctgttggatcattcccatgggcacacaaagatgctattgtttcttttatccttaaatatatatacatatatatatatacacatacatatatttattttatatatatatcctcaagtgtatatatatatttctcaagcccctccagctactaacccccatttttgtgcatcatgttctagcaaatttgaagattatcatatattcactgtcccaaagttctctctcccaattgtctttcctacccactaccatgaaattttaactcctgccactctaccaaaagagttactaaatgatcacttctcagcttcactctgtcatattaagctttgtaaattcaactttgtaagttggtgctgggactctgcaaataacatttctgctttgcctgtttaagatctatcaataaggctcactagagagactgcaaggctgcaggaagaagtaatgattcactttttgtttgctattgtgggtttcctgtcgacttcctttgcttttgcacattctccactctggcactggcagttccttactgtaacagtggttgagtccagtttgcaacgtttctgacacttgtaaaaccagcttcacggagcccctactcagcagtatcagcactagataggtggatttccccggtcagaggcagtctcaaatctaaggggaggccagtgaggcacctagaacacaaattttaaggaagcactccctctcaaggttgtgctcctgccaatcagggacctgaacttatccagagcctgcccttaatgtggtagactaagtcagactaagtcagtgccatcagattttgctgtctttataattattgcataatctgaacttctcaaaaatctgagagattgtgacaagaattgcattcctgtcctctggtatttcattccagtcagtgttgttattgcaccttgattgcaaaacaggtatcacttttccacctaccattaatgacagggctcccacagttagttaactggctagtggtccaacttcaaaatccattttcaagtctgacttcttagacaacacctgaaaccaattgtttaagctcagatttcccaggatacacgctgagacaaaaatgtgcatgaaggacagaaacctggggagcacacttggcgggggggatcaacacctgagagagaataaataacataggactgaccagggggagaaattgaagtacaacacagctatgactgaggcttcagttgatccaaaagggagcactgaaattggagtcattgttccgtgttgtaccatcctaagccaagggacctgaacccctacagctccacatctatcagacattgggtcttgttgacccctgtagaagggacatgactttggcaaaacaaccttctttggctgagggtaactccaaacagggagactcagctcagacacatcaccattcatatctcccagaggcaggggagatgagtacctacgttctgaaggagacatcaggaaagctcatcacggcatcactacaattataaaatattaaatgaaatacaatatttttatctttaaaatattttataatcattaatagcatttacatgtcaataactttatgactatgtattcaatttgtggaaatgtgtggccacaatgtatgtttactaatccgtgtaaaaaaatttaactaattaataaatagtatattcatatgtataaatatgtattattaaaaatatacacataggcaaatattttagtttttctcccttggaaattttagtaaccaggaaagagaaccattattacaatgacttatgcttatttttaaatcaattataaataaatctgtggctgagcgcaatggctcacatctgtactcctagcactttggtaggccaaagtgggagaattgcttgaggccaggagtttgagaccaacctgggcaacatagcaataccttgtctctacaaaacataaatagataaaataaatgtcttaaataattaaatttgtagttgctactttatactcttctattcatcttacactcttttattgtcatttctttctatgactatggataactaagtgactttgttcatcctgggtaactgaactgaaaatattcttaactaagttttcacttgcatgataaaagcatatcattaaatatttactcagacatcttaagaagatgaataacaaaattgaataagtgttcttacttaagaattcaaagagagatgaatttatacaaaataaatatttagagttatgagaaatttgtaatctacagtattagttgtccacagatgtaatgttttcctaatgcttatcaaagtattatgattctaatatactcaaaaagatttataatagagcacattttctatttaacaatactggtagcagcaagtatatcatatagtaaaaatttgaatattgaaagcagtataagtataccaattagtcttttattgtgcattcacaagtctttgtttacaggacaatatgcaaatcagagtaaaggcagtcttcaggaattacttggtatgattaaccacataatttgcacattgaatcagatcatcatgaaataaggaaatatatggtcaatgttcacctgctttaaaagctttcacacattttgtgggggagttaaaacatgtttttagaagataattgcagaaaaaaatgctgaaaagaataagtaagaattttttgttatatgcttacacgtagtacataataattaatggagaagtggtaacatagaaaactcagtttttgtcaagtatttttgattcattgattcatttgctcattcagtatttcctgagtactgccatggttgagatgtagcttgtccccattaaaactcatattaaaatttgttttccaatgtgacagtgttggtagatggggcctaatgggaagtgtttggatcatggggatggatctctcataattagattaatgtcatgtcatgggagtgagttctcacttttctgctttctgccataatttgaagcagcacaagaccttcactagatgcagctgcccaatcttgaactttccagccaccagcatcaaataaatctttcttctttttaaattacctagtgtcaagtgttctgttacagtaatactagacattaagataagtgctttcctttttccaggtgctgttttaggacgtgagagtacacccaaaacaaaaatggacagaaattccagtctcataaatgtgagagatccagaagatacttctacaatttcccttcagttacatatggacactttaataaaagaatattatttttaagtgaaaaaacttaagcttattcctcaaggttctaaaatttcaatcaactatggaagtgaaaatttcctgatattttctatgcatatgaatttagtcccactctctttggtttatacaaaaggaacttgtatcagtttgttaaatcacagccttagaaattaagaattaatgttcaggattagagagctatagggtctcatattttggttttattttgtaagaaagtaataaaggtcattgtagtaaaagctgccaattaaggctaattctagaagtcaggacctcagttttattttctatagtatcgtatgcttcttccctttctacttgtaaatttatttttatttcctaatgcataattttctaaaacattagtaatcattaaaattcttatagcatgaaataaaaaagttctctttcacaacaaagcactctcctatgatatattttcttatttcttaaaaaagtttttataaaatacacgtacttcacaagtaactgtgttcaggtgagaagcaagataataacaatggttaagtgaaaatatgcaggactcagaaatcctgggttcatctacatcctaacttgaccaccgcctggccacactgtgttacttaacttgtgtgcatcacgtattttttttttcattcttagaataagggaaataatctcttacagtattatcatgaaaattaaatgtgtttatacacaagagcacttattttaaaaataccaaaagataataaacaataaacagaatagactaaggcctaacagttcttttttctttttttgagacaatttcactctgtcacccaggctgaagtgcagtggcacaatctctgctcactgcgacctccacctcccgggttcaagcgattcccctgcctcagcctactgagtagctgggactttagatgtgggcgactttaagtgcatgctaccatgcccaactaatttttgtatttttagtagagacgtggttttgccacgttggccaggccagtcttgaactcctgacctcaagtgatccacctgcctcggcctcccaaagtactaggattacaggcatgagccactgttcctggtcaggtctcacaattcttatggagaagtgagtcaaccagttgtgatatttattcagtgtctattgtgattagataatgtaaaaaagaaattagagataaagcaaaagggaagtatctctgaatttgagaatctgaatgagaagagaatcattgaagtattcacacatacaacagatatagtaacataagtatacagtgggcatatttttacacattactgatgtatcacctacatatcataaaatttacacatttttaagtgtaaaatgtaatgccttttagaaaacttacaaagttgtacgatcacactacaatccaattgtaatatatttttatcactccaaacagttcagttaatccacattcccgctcccagtcttagtcaattaacaatttggtttctgtctctatagatttacctcttctgagcatatcatatgaaagaaaacataatatgaagctttaggagcctgttttctttcatgtagaatactatttttgtgggtcattatagtttgtatcaacttgtctttatattactgaataatactccagtgtgtggttatattacattttgttcatttactagttgacaaatacttggactatttccacctttttgtgaataaggctgctatgagcatttatatacaagtcttttagtggacatatgtttttatttttcttgggttgattcctagtcatggacttgctatgttgtttggtatatttatgtataactttttaaaatattttccaaaatgtctctgtcattttatatttctactagtatatatgaggagtccatttcttctatatccttactgtgctattattagatgactttttattattataaccattctaattgtagatttaatttgcattttattagtgaataatgatgttgagtgttatttaatgtgcttactagatatttgcatgacttggtgaaaagtctattaaaggctgggcatggtggttcatgcctgtaattttagcactttgagaggccatggtaggcagattgcttgagcccagaagttcgagaacaacctgagcaacatatctaaactctgcctgcaaaaaatacaaaaattagctgagtgtggtgggcacatacctgtagtcccagctactagggaggctcagctatgaagattgttttaacccagggggttgaggctgcagtgagccatgagcatgccattgcactccagcctgggcaacagagcaagaccctgtctaagaaaagaaaaaaaggctattaaagttatttaatcatttttaattaatttgtttgtcttaataatgagtagtggaagatttcgtatattttgaatacattataatatgttaacatatgttaatacatgttttaaaattatctctcccagtctaagccttatttttcattttcttaatggtttcttttgaagtgcaacttttaaaattattttgaagctcaacttttaaaattattttgaagccaaatttaccaagatttttttttatggattgtgtttttagtttcgtatctactaattatttgtcaactaaaggtaataaagattttctcctatattttattctgaaagttttataatttgggcttttacatttcaggttattttgaatttagtgtgaagtaaggatctaaagtcatctttttgcatgcctgtgtccagttatgctagcaccatttgttgaaaagagtgtcctttctcctattaaatggtcttggcttctttcttagaaaatcaattgactgtaaatgtaagagtttatttctggtgctctcaattctgctccattgatctatgtctatccttacactagtaccatgatgtttaattattatagtttttaagtaaatttgaaatgggaaagtttagatccacaagctttgcttttttcaaaattactttggctattctgggtcctttgcatttccatataaattttaagatcggcttggcaatttatgtccccaccaacacacacaaaacagcctgctgagatgtttattatgattacactgaatctataaatcaatcagggaagctttaccatgttaacaacattgtcttccaattaataagtctggaatttttctccatttatttagatcctattttatagtttattagcaatattttatagtttgcagtacacaagtgttgtgctttattcattaaatttatttctattttgttcaattggtcctttttcttcaacattgattttaattttgggagcacacgtgcaggatgtacaggtttgttacataagtaaacgtgtgccatgctggtttgctgcacagatcaacccatcatgtacttatttagcccagcatccgttagctaatcttcctgagtctctctctccccctaccctctaagaggccccactgtgtgttgtttcccacaatgcgtcgtccttcagctcctccttataagtgagaacatgtggtgttttgttttctgtttctgcattcatttgctgggtatcacgacttccagctccaaccgtgtttctacaaaggacatgatcttgttccttcttatggctgcatagtattcccttgtgtatatgtaccacactttctttatgcagtctatcaataatgagcattcgagttgattctgtgtctttgctattgtggatagtgctgcaataaagtacgtgtgcatgtatctttataacagaatgatttattttcctttgggtatatacccagtaatgggattactgagtcaaatggtatttctgcctcttaagtctttgaggaatcaccacactgccttccacaatagttgaactaatttatactcccaccaacagtgtaaaagcattcctttccctctgtgtgaacatccattgtttcttgactttttaatgatcaccagtctgactggcatgagatgatatgtcattgtgattttgatttgcattcctctaataatcagtgatgttgagattttatatatatatacatatatatatacatatatatatatatatatatatatatatatatatatatccatcatccatccattccctaactagtcccttagaatggaaagagcatatttacttgagggaatccttttggtatcctgtgaccatataaattcctttttagaaggatatttcaaatggaaagagtgagtctgtctttcttgctattacaagagctataatcctttagtggacagaaaacaaaaattaaattatacaattgatcacccacctgggcaaagccagtacctgaaataggcatgaaactgagccctgatgaggtggatagacagagggattaggacggaaaactggcaacaatggaagtagcagagcagaacataccatggcttgtaaggatcaaaacaatgttgtggtgactgagacgtgtattgttatttgcctagaattcactatgtaaggaaatcacatgagagcttgagaacaaatgctatccctatccctttattaaagcctgtgactgcccgattatgtggtctgaatcctagggaaaaacagaaagtcaagatttctaatgccatctcttctgaggtcatgtgaaacccacacttcctccttctgggcaatttctgagatagtacaagtcattgcttcagggaaagactttccaacacaaatttcttaatttcttaaaaacttccattaccaaccagaatttgaaagtcaaaaattacattttattaaattttaaaaattgtgtgtatgtgaaattctctctactttcttcattgagaaaagacttggttagaattgtcttattttccaaaggtgaatcatatatgaggtcaaggaaaataaatacatagtttttccaaagatcacttactaaattgaaaaataaaccaaatattatgtaaaagacactgaatggaaacaacttttaaaacaaacaaaaattataaccacaaacaccatctgaaggaataatagtacccaggaaatttttagtacagtaaagtctagaaaactatttaggtgattctcttttaatgtaaaaggcaaagctcttccctcattcattgtttaaaaacagaggaaaaagacctaaaaaaatgcataatattctcaattagaaagttactggtattcaggagttatttactggaaatgtgagacacatctgtgagagacccagaaaggagagaaaaaaatgatatacagagagaagagttctcaccaccaaggtgtcatcagagaagcactgctattagaattcctcatgataaggaaatacttactgcaattctaagatgaatgacatctgatatcaaatatgaagttgctttcttatgtatgatacaattaccctctgcttcccccaaatattcagtaaacatttgtaaatttttgccacaaacaacattgtggtaaagtggaaaattaagaaatacgtacatcacactataaagtgtcacactgaaaaggaatattaatttaggtatcagctataaaggcatttataattaataataataatataagcactcctggaaatctgtggaaatagtggagacgggattagggtcacattttgtgagatgagatgaaaccatattgctcatttattaacataaaggatgtcctcagatgactgaatggtttggaggcatctctgttatattattcaagcacagaaaacaaacaaatgtttcattcttgggtcttcaaaacaggaatatcttctttctccctctctaggctctttgaggcccttctattccatgaaaaatttgactgcttttatcggttccatgttcctttttatttgaaacctaatttttcactaattattgcatttaggaaataattttgatgcttgatgattttttagctatccccaaactttttagaatcagatggactaataaactataaatataaggtaaatgctgagaataagggaaaatgaagttaataccatcagctattattaattaatatttcagcattctggattttttaactagctttctttcctagaataacaactagctgaagcaatgcccgtcaaaaaggcaaacatttcattggtcataaaaaagtgtaaaagaaagagaaagaagaaaagagcaataaaacaggaattggaagtggatgggtaacaagcatactgtacctttatatactcaatttttctaaattccattcattttttttcctgtttatttcttaacttggtcagaataagtgctgcttatcaaatagttttggcaagtttaaagtggtaaaaataaaccacactaatatgaccccatattttcaattccagcattaaattgcttagatgactttcagtctttaaaatgtccttacagaagcccttttcaactcagtacactgaagtatgaatgtgaaagtttattattttaaaaatttacattaaatgttttgacagcatcatacaaaaatgacagtcataaagcccattctattgcctgtgaaattgtaaaaatcctcatggttgattgactactacagaagactaggggatggtgtacactttacacataatggatttctgaagggaataaaaagttaaaagtacaatgtcttgagagataatactcttcttaaggtttcctgtggtccatatttgcaaaaatgttggtacttaataataacagtcatttggagcttaaagtcgacatatggaacatagaattctacttgatgagcaaagcacatactgttccattgtattataattgtggcattaatgaaatatgaaggaattattctaactctgagtgcatttattaactcaaagttcactcttaatatcaaagcataaacttcaattttcaaaggcctatgcttttgttatattaaatttagtaagggaaaaatgttttccagctattcacaagtaaataacttactagttccaaaacagacaatgacttatttccatttttttctgccaagtgataaaattatttcaccggttgacttctaatatttattttctaggtaaatgagatcattgttcatagaatagtagagacagtcaatgaaagaaacagtgtcaacaagccaaacacaaaacgataacaaaaccagtagttgggcaaagcctaaataaattgaaaacaagcaaggaataatcaagatttaaagtttcatttaatttttgtggatatgtgtgttaattgaagtttttaacaaatatctatacctgtaaatatcatggatcattttatttttaatgtttcttttttactatttctggtttctaaattttcaaaaaaaaaacctgtattgattttgtaaccagaaaaaaaatgttatttaaaataaaaataatctcatccattaacaatacaatgaagacatttgttttgcagaaaattctgcattactttggaaaagtgcactaatctattctagagtcctttttacttttaaacataaaaaatgaaatattaatcattggcttttggccacctttaaaagagagaacttaggcagaaggaatgactagctcaccctaccccacccacaaaaaataacacacagctatatgttagggcaagttaagcaaatgagaggagaaagacagatggtgattgatgctgtgcttagtacatagatttgaacactagttgaagccaagtttcctttgaaagaggcatcctttccaaaatatcactggtttaggtatttgttatattttccatttataaagtggcccatttaatacattgtagtttatattgtgtattaaataaacaatattttatttatgaaatagtgtataagtttaggaaagaagtattttacgttggcatagatatataaatttgtccttgatgaagctattaaagatatttcatgaaatgtcaataataataataataatgaagaagaagaagaagaagaagaagaggaagaagaagaggaagaaaaagaagaagaagaagaaaaagaagaagaagaagaagaagaagaagaagaagaggaagaagaagaagaaatttccctctggaaaaggaagaaaatccagatgctatatgttatttatttatttgtttatttgagacagagtctttcttactctgtgacccaggctggagtgcaagtggcattatctcagctcactgagataatgagccttcacttcctagctcaagcgttccttctacttcagcctccagactagctgggaatactggcacatgccactgcacctggcttatttttttgtacttttttggagacggtttcatcttgttgcccaggctggtctcagacttctgagcttaaacaattcacctgatttggcccccaaaatcttaggattacgagtgtgagccatgatgcctagcctgtttattaaatatttagttttggtttgggtagataaatggagtagataatttttttttttctaaatgatataccaagagattttttatgaaaaaaagtcaaagtgaggcactttggtttttcttgttgttgttttgtttttcaattttttttagaggcacagtctcactctgtcacctgggctgcagtgcagtggtgggatctcggctcactacaacctccacttcccaggttcaagtgattctcctgcttcagcctcccaagtagctgagaatagagatgcatgccactagactgggctacttttttttttttttgagaaggaatttcactcttgttgcccaggctggagtgctatgtcgtgatctcagttcactgcaacctctagctctcaggttcaagcaattcttcttcctcagcctcatgggagctgggattacaggcgcctgccaccacacatggctaattttgtattttttttagtagagacggggttttgccatgttggtcaggctggtcttgaactcttgacatcaggtgattcacccaactcagcctccaaaagtgcagggattacaggcgtgagccactgcatgcagcctagggactttgcttttaaattacatttacttttccctatgtaatgctacctcagacaccaagagggttttgggcaagctgtggcctcaatatctgattaataagacaggaaatctgatataagaaaatgatataagaggccaataactttaaaaaattctaaagggataacatcagtaaaaatcatgcctccaaaaacaatcttctccataaaagcaatgaaaacacaggcaaaaatagaaagaatcagctttttcagaactctgtatattgaccaaagaattgcagcaatgtggggagaatgtattcaggaaaaacacagaaagttggtaagagagtaagttttgtcatgtgttaacttgccctattcctatctcacattcaccagctccacagtagccttgttatacaacatcccatagtcatgatgaaaaccaacaggctggcagctagtggagaggaaagaatgaggttggaaacactttagaaccctttgtgaaaagaattgtcactatttgatctgtctggtagtttcctggaagacctaatacgcaaaactctttgtttgacctgactcagagcttgcccaatgcaaacagccttttcctgaggtgcaactgcaaacaaccacgtgcaattactgaacaaatctgctgaatgagtagtaaataacaactggagcaagcaacaggcttaaaaaggaaatgtttaaaaggaaaagctaggtaataaaatgccatagggagatttgaaaaactctgacatatttctcagaatctggaagtttgaggcagtgttgtaaaactgcctaaaggagtgttgaaggcatgccccaatatgcacaggggagagaatggaactaagcaggaacaaagattttgtattcagttgaaattctattgttactaatcaggaaaaaaattgttttaagttaaaaagtaaattgcaatcctcatggcaataggaaagaaaataactcaaaaaaagctcagtaaaagaaatgacaagataatttaagtgatacagaaaaaaatatctatttaacacacaaaaagacagcagtggcatactggaattataatatatacagaaaattaacaacaaaatggcaaaatcttacctaattactaatcacctttaatgtaaatatattagactttccatttaaaaggtaatgtgacagaaagttaaaaaaagatccaactgtatactgtctataagagatacaatttatattaaaagacaaaaataggttaaaaataaggtgatggataaatatacaccatgcaaagagtagccaaaagaaagctggagtgattatactaatatcagagaaaatagacttccagacaaaatttgttacaagagaaaaagaaagatattttatgatgataaaaaggtccatccttttagaagatactacaattatatatttatggtcaattgattttgacaagtgtgtcctgataattccatggaaaaagaatagccttttcaacagattgttctgggacaactggatatctacatacaaaacaagattggattccccagcctcacaccatatacacaattaaactcaaaataaatcaaaggcttaaaagtaaaaagtaaaattctagaattcataataaaaaacatacatgtaaatctttgttgccttggactaggcaatggtttcttagatatggcaacaaatgcacaagcaacacaagaaaaaaagataagttaaacttaatcaaaatttaaaatgtcatgcttcaaaggacattatcaagaaaatgaaaatacagctcaaatcagaagaaatatttgaaagtcatctatcttataagggtctagcatccaaaatatataaaaaatgatcacaactcaacaataaaaagtacatgttataaataagcaaaggactttcatagatatttctccaaagaaaatagagaaatggctgacaaacatatgaaataatgtttatttgtcattggtgtcgatgaaaagagtcaaactctgtaaaatatttgaaaacatttactttaagccaaatatgagtgaccatggtctgtgatacagccctcaagaggtcctgagaacatgtgcctaaagtggttggggtacagcttggttttatatattttaggtaggcataagacatcaatcaaatacatttaagaaatacattggtttcgttcagaaagctgggacaactcaaagccagagacttccaggctataggtaaacattttctggttgacaattggttgagtttatctaaagacctggggtcaaaggaaatgttcaggttaagataaaggattgtggagaccaagttttattgtgcagaggaagctctcagatagcagacttcagagagagcaggttgtaaatttttttttgtcagacttaaaagagtgcctggctcttagatgattatctcctggatctgggaaggaaggatggaaaacaaagggaaaaagggattctccatagagtgtggatttttcccataagagactttgcaggacaatttcaaggtatggcaaggaaataaattttggggttaaatattttttccttgtctcacaatgttatgccagagtcagattaaaaactaagtcacaatatataggatcaaataaaatccatctgatgagaatttatggtttgtaggcatgacttcctagaccccttaggtaacaatttgggaaagataagaaatcagagcttcgtcctctttggaaatgcaaatcaaaacctcagagagctatgactttacaccaactagaatgactatactaaaatagacaagcaacaacaattggctaggatgtggagaacttagaagattactcagaataatcaaaaaatggaaacaatgcaactatccatcaactgataaatggataaacttacaatgggctactatttacctatataaggaatgaaatattgattaatggtataatatgcataaacctgtaaaatattagctaagtgaaaaaaccagaccctaaaagccatatattatatcattccatgtatagagagtgcccagaataggcaaatccagaaatagaaagtggatcaaaagttgccaaaggttgagtgtaagaggaaatgcagagtgactgctaaaatcaacaggagattttttggggaaggacaccaaaaatgtagtaaattagatattaataatggtcacacaactttgtgaatataccaaatgccactgaatttcatggtatttgacttatattttgttttctaaaatggctctaaaatactctgttttagcaactagacaacatcccttactataacctcctaattgtcactgatggattatatatccatcattgagttgtgggttaagcaccattgcagttaattttaaagataaagaaaaagacactgagaaaagttaagaaacttatggttatgccatggaggagaaggattttaaggtctgctgtttgtgattccaagtttatcctctaaacttacacataatgctacctcatatgataacgcagaacaattcagtttttttagcgtgacttaattcagctcacagagttaaaattttctttagtttcagcaatttagaaacactgtttttgtccattctgtgaatggacatttgggagctcattgaggccaactgcaaaaaagcaaatatcccaagataaaaactagaaggaagctatctgggaaactgtattgtgaagtaagcattcatctcacagagttaaaactttcttttcactcagcagtttggaaatactgtttttgtagaatctgcgaagggatattttggagcacattgaggcctgtggtgaaaaagaaaatatcttcagataaaaactagaaataagctttctgagaaactgctttgtgaggtttgcattaatctcaaagatttgaacctttcttttgattcagctatttggaaacactgtttttgtccgttctgcgaatggatgtttgggagctcattgaggccaatagcgaaaaaatgaatatctcaggataaaaactagaaggaagctatctgggaaatggttttgtgatgtgtgcattcatctcacaaagttaaatctttcctttctttcagcagtttggaaacactgtatctgtagaaactgtgaagggatattttggagcacattgaggcctatggtgaaaaagaaaatatcttcagataaaaactggaaagaagctttctgagaaacggctctgtggtgtgtgcattcacctcacagagttaaacgtttctttttattcagtagtttggaaacactgttttggtctcttccatgaatggacttttgggagctcattgaggtcaatggtgaaaaaccagatattccaggataaaaactagaaggaagctatctgagaaaccgctttgtgatgtgtgcattcatctcacagcattaaacctttcttttcattcagaagtttggaaacactttgcagaatctgcagagggatatttggcagctcattgaggcctatggtgtaaaagaaaaatatcttcagaaaaaaactagtaacaagctttgtgagaaactgctttgtgatgtctgcattcatctcacataggtaaaactttctttgtattcagcagtttggaaacactgtttttgtccactctgtgaatggtcatttgggagctcattgtggacaacggtgaaaaagcaaatatccagggataataactagaaggaagctatctgagaaaacattttgtgaagtgtgcattcatctcacagaattaaacctttcttttgattcggcagtttgtaaacactgtttttgtacattctgcgaatggacatttgggagtgcattgaggcctatggtgaaaaagaaaacatcttctgatcaaaattagaagttttctgagaaactgctttttgatgtgtgcattcacctctcatagttaaatttttctttcattcagcactttgaatacattgtttttgtaggatctgtggagggatacttgtgagcacatagagtccaatagtgaaaaagaaaatatcttcagataaaactagaaataagctttctgagaaactatttgtgttatgtgcattaatctcacaaaggtaaacccctttcttggcattcagcagtttggaaacactgtttttgtagaatctttgaagagatatttgggagcacgttgaggcctatgttgaattaaaaaaaccttcagaaaaaaatagaaagagggtttcagagaaactgctttgtgatgtgtgcattcttctcacagagttaaacctctctttactttcagcagtttggaaacacagattttgtccattctgccaatggacatttgggagctcactgaggccaatggtgaaaaagtgtatcttccaggataaaaactagaaggaaactatctgagaaaccactttttgatgtgcgtattcatctcacaaagttaaaccttacttttccttcagcagtttgtaaacactgtttttttagaatatgtgaatggatatatgggagtgcattgaggcttatggtgaaaaagaaaatatcttctgataaaaattagaaaaaggctatctgagtaacagctttgtgatgtgtacattcgtctcacagagttaaacctttgtttaacttttgtttttatcctgggatattcacttttttgccattggcctcattgagctcccaaatgtccattcacagaatggacaaaaacagggtttccaaactgctcaatcaaaagaaagcttaactctgtgagactaatgtacccatcacaaagcagtttttcagaaaggttatttctagtttttatctgaggatattttcttttttgccataggcctcaatgtgctcccaaatatcccttcgcagattctaaaaaacagtgcttccaaactgctgaatgaagggaaagatttaactctgtgagatgaatgcacatatcacaaagcagtttctcagatcactttcttcaagttgttatcctgggatctttcttttttgccattggcctcaataacctcccaaatgtccattcacagaatgggcaaaaacggtgtttccaaactgctgaatcaaaagaaacatttcactctttgagatgaaagcacacatcacaaagcagtttctcagaaagcttatttctagtttttatctgaagatattttctttttcaccttaggcttcaatgcgctcccaaatatcttttcaaagagtctacaaaaacagtgtttccacactgctgaatgaagtgaaaagtttccctaagtgagatgaatgcacacatcaaaaagcagtttctcagaaaacttctttctagtttttatctgaagatattttctttttcaacataggcctcaagcactcccaaatagccccacacagattcaacaaaaacagtgcttccaaactgctgaatgaaaagaaaggtttaactatgtaggttgaatgcacacatcacaaagcagtttctgagatagcttccttctagtttttatcctgtgacagttgcttttttaccattgtcctcagtgagctctcgaatgtccattcacagaatgcagaatgcacaaaaaccatgtttccagacggctaaatcaaaagaaacgtttgactatgtgagatgaatgcacatatcacaaggcagcttctcagaaagcatctttcttgtttttatctgaagatatattctttttcaccataggcctcgctgtactcccaaatatccttttgcagattctacaaaaacagtgtttccaaactgctgaatgaaaaggaaggtttaactctgtgagattaatggacacatcatgaagaggtttctcagatagcttctttctattttttatcctgggatattctctttttcaccactggcctcaaagagctcccaaatgtccatttacggaatgcacaaaaatggtgtttctaacctgctgaatcaaaagaaaggtttaattttgtgagatgaatgcatacatcacaaagcagtttctcagaaagcttctttctactttttatctgaagataatttctttttcaccgtaggactcaatgtggtcccaaatatctctgtgcagattccaccaaaacagcatttccaaactgctgcatgaaaagaaacttttaactctgtgaaatgaatgcacagcacacaaagccgtttctcaggtagcttccttccagtttttttcctgggatattcgttgtttcaccattggcctcaatgagctcacaaatgaccattcacaaaatggacaaaaacagtgtttgcaaactcctcaatcaaaaagtggtttaactctgtgagatgaatgcacacatcacaaagcggtttctcagaaagcttatttctactttttatgtgaggatatttttttttcactgtaggcatcaatactttcccaaatatcccttcagagattctacaaaaacaatgtgtccaaactgctgaatgaaaagaaaggtttaactctgccaaatgaatgcacagatcatgaagcagtttctcagagagcttcattctagctttgatacttggatattcactttttcaccattcacctcaatgagcttcacaatgtctatttgctgaatgttcaaaaacagcatttcctaacttctcaaatgaaagttttatttctgtgatatgaatgcacacatcacaaagcagtttctcagaaacctttctagttttgatctgaagatattttctttttaaccataggtctcaatgtgttcccaaatattccttggcagattctacaaaaacagtgtttccacactgctgaatgaaaagaaaggtttaactctgcgagatgaatgcataaagaaagttttaactctgtgagataaatacacacatcacaaagtggtttctcagacagcttcattctagtttttattctgggatattcactttttcaccactggcctcaatgatttcccacatgtccatttacagaatagacaaaaactgtgtaatgaaactgttgaaccaaacagaaagatttaactctgtgatatgaatgcacacgtcacaaagcagtttctcagaaagcttctttctagtttttatctgaagatatttgatttttcaccacaggcctcagtgcactcccaaatatcccagtgtagattgtacaaaactagtgtttccaaatggcagaatgaaaagaaagttttaactctgagtaatgaatgcacatatcactaagtggtttctcagatatcttccttctagtttttatcctgggatattcccttttttgccattggcctcaatgagttcccgaatgtccattcccagaatggacaaaaacaatgtttccaaactgctcaatcaaaggaatggtttaacactgtgagatgaatgcacacattatgaagcagtttcacagaaagtttctttagtttatatctgaagatatttcctttttcaccataggactcaatgtgctaccaaaaatcccttagcagattctacaaaaacaatgtttcaaaacggctgaatgaaaagaaaggtttaactctgcatgatgaatgctccatcacaaagcagtttctcagatacattccttctagtttttatcctgagatattcactttttcacacttgtccttaatgagctcccaaatgtcaattcacaaaatggacaaaaaccatgtttccaaacttctgaattgaaagaaaagtttaagtctgtgagatgaatgcacacatcacaaagcagttcctagaaatcttctttcaagtttttatctgaaaatattttctttttcaccataggtctcaatgtgctccaaaatatcccttcacagattctacaaaaccagtgttaccaaactgctgaatgaaaagaaagttttaactctgagagatgaatgcacacataacaaaatgattgcatagatggcttgcttgtagtttttatcctgggatattcacttttttgccatttgcctcaaagaagcccaaaatgtccattcccagaatagacaaaaactgagttccctaactgctgaatcaaaagaaagttttaactctgtgagacgaatgcacacatccaaagcagtttctcacaaagcttctttgtagtttttatctgaacatattttgtttttcaccataggcctcgatgtgctaacaaatatccctttgcatattgtaccaaaacagtgtttcctaactgtcgtatgaaaagaaaagtttaactctgtgagatgaatgcacacatcacaacacggtttcttatatagcttccttctagtatttgtcctgggatattcgctttttcaccattggcctcaatgagctccgaaatgtccatttgcagaatacacaaaaacagtgtttccaaactgcacagtgaaaagaatgctttaactctttaagatgaatgctcacatcacaaagcagtttttcagaaagcttccttctagtttttatctgaagatattttcttttaaaccataggcctcaatgcactcccaaatatcccatcacagattctgcaaaaaaatgtgtttatgtgaagtttttttctttttcaccacaggcctcaatgtgttcacaaatatcctttcccagattctacaaaaagagtgtttccaaactgctgaatgaaaagaaagatttaactctgtgagaagaatgcacatatcacaaagtggtttcccagagagattcgttctagcttttttccttgaatattcacttttttgccattggcctcaatgagttcccaaatgtccattcgcagaatggacaaaaacagtgtttccaaactgctcaatcaaagaatggttttatctggggaaaccaaggacattattcttccacccccctcaatagagtgacaatattttccatggctacatggacccttccctgttttaacaggtctacatctaaagttcctttttcaggaaaccaaggaccgtatttttctactgcaatgaatagagtgaccatattttccatgggcacacgaacctttctctgttttaacaagagtttaatatagtagatataagtataatgtttatactctgtgtgacccataggtaacccagaccatacacagactactcaccagttgtcagggagttgaacaagcatttctgtggactgaactgatgatgtttctccacacacactaaagggaatcgggttccctcatgcacttgggaaaaagagaaaaccacattggtgcaccagatattgggggaaccagcccctgatatttcaaagtaagttcttttctcttttccctacatgttggccagtctgagaaatacaggaaaagaatacaaaagagaaatttttaaatctggttttctggggcagatatcacatgtcgccctgttcagtgatgccccctgagccataaaaccagcaagttttattagcaattttcaaagaggagggagggtatgaataggatatgggtcacacagagatcacatgcttcaagggcaacaaaatatcacaaggcaaatgatctgggcaaggtcaaaaggccaggacaaatctagaattactaatgaggttcccgttcctgctgtacgggcattgtcattgataaacattaggaaacagggtttgagagcagacaactgatctgactaaaacttactaggcaggaatttcctaatccaaataagccagttggtgctgcaggagactaaggtgtgtctcatccctatttacaactgcataaggcagacactaccagagcggccattttagagggtgctcccaggaatgcattcttttcccaggtctgttaattattaacattccttactggggaaataattcagcaacatttctcttaccagtttttggcaataagagaaatatggctctatgctgcatggctcccaggcagtcaaacctattggttatctcccttgttccctgaacattgctgttatcctgttcttttttcaaggtgcccagatttcatattgttctaacacacatgctttatgaaaaatttgtgcagttaacacaatcatcacaaggtcctgaggcaacatacatcctcagtttacaaacatgacatgattaagagattaaagtaaagacaggtatatgaaattataagagcattgattgggaaaatgataaatgttcatgaaatcttcacaatttatgttcagagattgcagtaaagacaggcataagaaattataaaagtataaatttggaggactaacaaatgtccacaaaatcttcacaatttatgttcttctgtcatggcttcaaccagtccctccttttggggtgcctgacttcctgcaacaggtttaactctatgagatgaatgcacacatcacaaagcagtttctcagaaagaccctttctagtttttatctgaagatattttcttctgcaccataggtctcaatgtgcaccagaatatccctttgcagattctacaaaaacagtgcttccaagaggctgaatgaaaagaaaggtttaactctgtgagatgaatgcacatatcacaaagcagtttctcagaaattttccttatagtttttatcctgatatattcactttttcaccactggcctcaaagagctcccaaatgtccattctgtgaatggacacaaagaatatttccaaactgctcagtcaaaagaaagttttaactctgtgagatgaatgcacatatcacaatgcagtttctcagagcagttccttctagatttatcccgacatattcactttttcaccattggcctcaatgagctccaaaatgtccattcacagagtggacaaaaacagtgtttccaaactgctcaatcaaaagaacggtttaactctgtgagatgaatgcacacatcacaaagcagttttgcagaaagttgctttctagtttttatcttaagatattttgtttttcaccagaggcctcaaagcactcccaaatatcccttcacagaatgtaaaaaaacagtgcttccaaactgctgaatgaaaagcatggtttttactctgcaagatgtccacgcccatcagaaagcagtttctcagacagcttctttctacatttatcctgagatattcacttttttgccataggcctcaatgagctccgaaatgtccattcacagaatagacaaaaactgtgttcccaaactgctgaatgaaaagaaagttttccctttgtgagatgaatgcacacatctcaaagcagtttctcagaaagcttctttctagattttatctgaagatatttcctttttcaaaataggtcccaatgcactgccaaatatcccttaacagattctacaaaaacagtgtttccaaactgctgaatgaaaataatggtttaactctgtgagatgaatgcacacatcaaaaagcagtttctcagagagcttccttctagtttttatcctgggatgttcactttttggcaatagtctccagtgagctcccaaatgtccattcgcagacaggacagaaatagtgtttccaatttgctgaatccaaagaaaggtttaactctgtgagatgaatgctcacatcaccaagcagtttctcattaagcttcttcctggtttttatctgaagatatttccttgttcagcataggcctcaatgcactaccaaatatcttttcacagattctaagaaaacagtgtttccaaactgtggaatgaaaagaaaggtttaacactttgagatgaatgcacacatcacaaagtggtttgtcagatagcttcttcctagtttttatcctgggatattcctttttttgacattggcctcaatgagctcccaaatgtccatttgcagaatggacaaaaacagtgttcccaaattgctgattgaaaataaaggtttaactccatgaggcatatgaacacatcagaaagcagtttctcagaatgcttctttctagtttttatctgaagatatttcctttttcaccttaggcctcaatgcactgccaaatatcccttaacagatttctacacaaacagtgtttccaaactgatgaatgaaaaggaaggtttaactctggagatgaatgcacacatcataaactgatttcttagataatgtgcttctagtttttatcctgggttattcactttttcacaattggcctcaataagctcccaaatgtccatttgcagaatggacaaaaagagtttttccaaactgctgaatccaaagaaatgttcaactctgcaagatgaatgaatacaccatgaagcagtttctcagaaacctttctagttttaatctgaagatatttcctttttcaccataggcctcaatgtgctgccaaatatccatttccagattctacaataacagtgtttccaaagtgctgaatgaaaagaaaagtttaactgtgtgagatgaatgcacacatcacaaagcagtttctcagaaagcttctttctagtttgtatctgaagatatttcctttttcaccataggcctcaatgcgctccaaaatatctttttgcagattccacagaaacagtgcttcaaaactgctgaatgaaaggaaaggtttaactctgcaagacgaaagcacacatcacaaagtggtttcttagatagtttccttctagtgtatacactgggatatttgcttttttgccaagggcctcaatgagctcaccaatgtccattcaaagaatttttaaaaaacagtgtttccaaactgttcagtcaaaagaaatttttaactctgtgagatgaatgcatacaccacaaagcagtttctcagaaagattcctaataatttttatctgaaaatatttcctttttcaccataggcctcaatgtgctccaaaataacccttcatagattctaccaaaatagtgtctctaaactgctgaatgaacagtaaggtttagctctgcaagatgaatccacacaacacaaagcagtttctcagatagcttccttctagtttttatcctgggatatatgctttttcaccattggcctcaatgaacccccaaatatccattagcagagtgcacaaaaacattgtttccaaattactgaatcaaaagagaggattaactctgtgatatgaatgcacacatcagaaagcagtttctcagaaagcttctttttagtttttatctgaagacatttactttttcatcatagtcctcaatgtgctccaaaatattcattcacaaattgtacaaaaacattgtttccgaactgttgaatgaaaagaatggttgaaccctgtgagatgagtgcacacctcaaaaaccagcttctcagataaatccttctagtttttatcctggtatattcactttttctctattggcttcaatgagctcccaaatttccattctcagaattttcaaaaatagtgtttccaaactgctcagtcaaaagaaagtttgaactctgtgagatgaatgcaaatatcacaaggcagtttctccaaaagcttctttctaggctttatctgaagattttttccttttccctgcaggcctcaatgtgctcccaaatatcccttcacagattctacaaaaacagtgtttccaaactgctgaataaaaagataggtgtaactctgtgagatgaatgcacacatcacaacgcagtttctcaggtagcttcattcttgtttttatcctgggatattcgtttttttgccattggcctcagtgagctcccaaatgaccattggcagactagataaaaactgtgttcccaaacagctgaataaataaaaggtttaactctgtgagatgaatgcaaacattacaaagcagcttctcagaaagtttctttctagtttatatctgaagatatcttacttttcaccataggcctaaatgcaatcccaaatatcccttcacagtttctacaaaaacagggattccaaactgctgaatcaaaaaaaaggtttaactctgtgagatgaattcacacataacaaagcagtttcttagaaagcttctttatatggtttatctgaagatattttctttttcaccataggcctctatgcactccaaaatatccccttgcagattctacaaaaacagcgtttccaagcagctgaatgaaaacaaaggtttaactctgcaagatgaatgcacacatcacaatgtggattctctaatagcttcattctagttttatcctgggatatttttgcttttgtgccattggcctcaatgagctaccaaattaccattcccagaatgaacaaaaacagtgtttccaaactgctaaatcaaaataaaggcttaaatctgtgagatgaatgtacacatcacaaggcagtttctcagaaacattctttctagtttttatctgcacatattttctttttcaccatacacttcaatgccctcccaaatatctgtttgaggttctacaacaagagtgttcccaaactgctcaatcaaaagaacagtttacctctttgagatgaatgtacaactcacaaagcagtttcccagaaagcttctttctagtttttatctgaagatattttgtttttcaccataggcctcaatccaatcccaaatattgcttcacacattctacaaaaaaagcttccaaactgctaaatgaatagaaaagtttaactctgagatgaatgcacacatcacaaagcagtttctcagatagcttccttctagtttttatcttgggatattcactttttcaccattggcctcaatgagttccaaaatgtccattcacagaatggacaagaacagtttatccaaactgctgaaccaaaagaaaggttaaactctgtgagataaatgcacacatcacaaagctgtttctcagaaagcttctttctagtttttatctgaacatgttttctttttcaccataaacttcaatgtgctacaaatatccctttgcagattctagaaaaacagtggttccaaactgctgaaagaaaagaaaggtttaactctgcgagatgaatgcacacatcacaaagtggtgtctcagatatctccctactagtttttatcctgggatattgtgtttttcacattaggcctcaaagagatccacaatgaccatttgcagaattttccaaaacaatctttccaaactgctcagtcaaaggaaaggtttaactctgcgagttgaatgcacacttcacaaagcagtttttcagaagattctttctagtttttatctgaagttattttttttttcaccatagttctcaatacgctcccgaatatccctttgtagatactacaaaaagagtgtttacaaactgctgaaggaaaagaaaggtttaactctgagagatgaatgggcacatcacaaagtggtttctcagataactttcttatggtttttaacctgggatattcgctttttcaccattggcctcaatgagctcccaaatgtccattcccagaatggacaaaaacaatgtttccaaactcctgattcaaaaaaaacggtttatcttggtgagatgaatgcacacatcacaaagcattttctgagaaatcttctttcaagtttttatctgaacatactttgtttttcaccataagcctctatgcactaacaaatatcccttcacagattctacaaaagcagtgtttccaaactgctgaatcaaaagaagagtttaactctgtgagatgaatgcaaacatcacaaaactttttctcggaaagattctttccagtttttatctgtagatattttctttttttttattatactttaagttttagggtacatgtgcacaatatgcaagttagttacatatgtatacatgtgccatgttggtgtgctgcacccagtaactcgtcatttaacattaggtatatcacctaatgctatccctcccccagatccccaccccacaacagaccctggtgtgtgatgtttcccttcctgtgtccatgtgttctcattgttcaattcccacctatgagtgagaacatgcagcatttggttttttgaccttgcgatagtttgctgagaatgatgatttccagcttcatccgtgtccctacaaacgacatgaactcattatttttatggctgcatattattccatggtgtatatgtgccacactttcttaatccagtctatcattgttggacatttgggttgtttccaagtatttgctattgtgaatagtgccgcaataaacatatatctgcatgtgtctttatagcagcatgttttataatcctttgggtatatacccagtaatgggatggctgggtaaaatggcatttctagttctagatccttgagatatcgccacactgacttacacaatggttgaactagtttacagtcccaccaacagtttaaaatgttcctatttctccacatcctctccagcacctgttgtttcctgcctttttaatgatcaccattctaactggtgtgagatggtatctcattgtggttttgatttgcatttctctgatgaccagtgatgatgagcattttttcatgtgtcttttggctgcataaatgtcttcttttgagaaatgcctgtttatatccttcgcccacttgtggatggggttctttgttttttcttgtaaatttgagttcattgtagattctggatattagtctattgtcagatgtgtagattgcaaaaatgttctcccattctgtaggtgcctcttcactctgatggtagtttttttttgctgtgcagaagctgtttagtttaattagatcccatttgtcaattttggcttttgttgccattgcttttagtgttttagacatgaagtccttgcccatgcctatgtcctgaatggtattgcctaggttttgttctagagtttttatggttttaggtctaacatttaagtctttaatacatcttgaattaatttttgtatgaggtgtaaggaagggatcccgtttcagctttctacatatggctagccaggttgcccagcaccatttattaaacagggaatcacttccccatttcttgtttttgtcaggtttgtcaaagattagatagttgtagatatgtggcattatttctgagggctctgtaatgtttcgttggtctatatgtctgttttggtatcagtaccatgctgttttggttactgtagccttctagtatagtttgaagccaggcagcgtgatgcctccagctttgttcttttggcttaagattgacttggcaatgggggctcttttttggttccttatgaacttcaaagtgtttttttccaactctgtgaagaaagtcattggtagcttgatggagatggcattgaatctagaaattaccttgggcagtatgaccattttcacgatattgattcttcttacccatgagcatggagtgttcttccatttgtttgtatcctcttttatttcactgagcagtggtttgtagttctccttgaagaggtccttcatgtcccttgtgagttggattcctaggtattttattctctttgaagcaattgaaaatgggagttcactcatgatttggctctctgtttgtctgttattggtgtataagattgcttgtgatttttgcacattgatttgtatcctgagacttcgctgaagttgcttatcagcttaaggagattttgggctgagaggatggggttttctagatactcaatcatgtcacctgcaaataggaacaatttgactccctcttttcctaattgaatgccctttatttccttctcctccctgattgccctggccagaacttccaacactatgttaaatgggagtgatgagagggggcatccctgtcttgtgccacttttcaaagggaatgcttccagtttttacccattcagtatgatattggctgtgggtttgtcatagatagctcttattattttgagatacgtcccatcaatacctaatttactgagagtttttagcatgaagggttgttgaattttgtcaaaggccttttctgcatctgttgagatgatcatgtggtttttgtctttggctctgtttctatgctggattacatttattgatttgcatacattgaaccagccttgcatcccagggatgaagcccacttgatcatggtggataaggtttttgatgtgttgctggatttggtttgccagcattttattgaggatttttgcatcgatgttcatcaaggatattggtctaaaattctctttttttgttgtgtctctgccagactttggtatcaggatgatgctggtctcataaaatgagttagggaggattccctctttttctgttgattggaatagtttcagaaggaatggtgccacctcctccttgtacgtctggtagcattcggctgtgaatccatttggtcctggactttttttggttggtacgccattaattattgcctcaatttcagagcctgttattggtctattaaagatccaacttctgcctgttttagtgttgggagggtgtatgtatcgaggaatttatccatttcttctagattttctagtttatttgcatagaggtgtttatagtattctctgatggtagtgtgtatttctgtgggatcattggtgatatcccctttattttttattgtatctatttgattcttctctcttttcttctttattagtcttgctagtggtctatcaattttgttgatcttttcaaaaaccagctcctggattgattgatttttttgaagggattttagtgtctctatttccttcagttctgctctgatcttagtgatttcttgccttctgctagtttttgaatgtgtttgcccttgcttctctagttcttttaattgtgatgttagggtgtcaattttagatctttcctgctttctcttgtgggcatttagtgctataaatttctctccacacactgctttgaatgtgtaccagagattctggtatgttctgtctttgttcttgttggtttcaaagaacatctttatttctgtcttcattttcttatgtacccagtagtcattcaggagcaggttgttcagtttccatgtatttgaggggttctgagtgagtttcttaatcctgagttctagtttgattgcactgtggcctgagcagagttttttataatttgtattcttttacattggctaaggaatgctttatttccaactgcgtagtcaattttgaaataggtgtggtgtggtgctgaaaagaatgtatactctgttgatttggtgtggagagttctgtagatgtctattaggtctgcttggtgcagagctgagttcaattcctggatatccttcttaaatttctgtctcattgatctgtctaatgttgacagtggggttttaaaaatcttccattgttattgtgtgggagactaagtatctttgtagttctctaaggacttgctttataaatctggatgctcctgtattgggtacatatatatttaggatagttagttcttcttgttgaattgatccctttaccattatgtaatggccttctttgtctcttttgatctttgttggtttcaagtctgttttatcagaaactaggattgcaatccttgcttttttgttttccatttgcttggtagatcttcctccatcaattcattttgagactatgtgtgtctctgcacatgaggtgggtttcctgaatacaacacactgatgggtcttgactctttatccaatttgccagtctgtgtcttttaattggagcatttagcccatttacatttaaggttaatattgttatgtgtgaatttgatcctgtcattatgatgttagctggttattttgctcatgagttgatacagtttcttcctagcattgatggtctttacaatttggtatgtttttgcagtggctggtaccggctgttccttttcatgtttaatgcttccttcaggagctcatgtagggcaggcctggtggtgacatattctctcagcctttgcttgtctgtaaagtattttatttctccttcacttatgaagcttagtttggctgaatatgaaattcagggttgaaaattcttttctttaagaatgttgaatattggcccccagtctcttctggtttgtggagtttctgccaagagatccactgatagtctgatggccttccctttgtgggtaacccgacctttctctctggctcccctgaacattttttcttcattttaactttggtgaatctgacaattatgtgtctttgggttcgtcttcttgaggagtatctttgtgacattctctgtatttcctgaatttgaatgttgacctgctttgcaaggttggggaagttattggataatatcctgcagagtgttttctaacttgtttccgttctccccatcgctttcaggtacaccaatcagacgtagatttggtcttttcacatagtcccatatttcttagaggcttttcttttcttttgatttttttttctctaaacttctcttctcacttcatttcattcatttgatcttcaatcactgataccctttcttccagttgatcaaatcagctattgaatcttgtgcagttgtcacatagttctcatgccatggttttcagctcaatcagttctttaatgacttctctgcattggttattttagttgccattcatctaatcttatttcaaggtttttaaattctttgtgatttgtttgaactttcccctttagctcagagacgtttgatcatctgaagccttcttctctcagggaaatccctttcatagccaagcaaatctgtgagagatgacacctagaaaatcagatcactcccaccctaatactgtgcttttctaacggtcttagcaaatggcacaccaggagattatatcctgtgtctcaccaaggggtccggcacccacggattattgctctttgctagcacagtagtctgaaatcgaactgcaaggtggcagtgagcctggggaaggtgtgcccaccattgctgaggcttgagtaggtaaacaaagtgaccatgaatctcaaactgggtggagccaactacagctcaaggaggcctgcctgcctcaggagactccaccactgctatgtgatgtgtacattcgtctcctagagttagacctttctttgcattcagcaggttggaatcactgtttttgcaatatctgcaaagggaaatttgagagcgcactcagatctttcatgaaataggaaatatcttcagataaaaagtaaaaagatgcttcttgagaaattgctttgtgatgtgtgcattcctctcacagagttaaaactttctttggaggcagcagtttgggaatactgtttttgtccatcctgtgaatggacattttggaactcttgaaggcaatagagaaagagcaaatatcccaggataaaaaatagaaggaagccatctgagaaactgcttcgtgatggatgcattcatctcccagaattaaaacgttgttttcattcagcagtttggaatcagtgtttttgcagtatctgagaagggaaatttgggagtgtattgaggcctttgattaataggaaatatctccagataaaaactagaaagaaactttctgagaaactgctttgtgatgtgcacattcatctccgagagttaaaagtttctttggattcagcagtttggaaacaatgtttttgtccattctgtgaatggacattttggaactctttgaggccaatggtgaaaaggcaaatatcccaggataaacactagaaggaagctatctgagaaactgctttgtgatgtgtgcattcatctccgagagttaaacctttctttccattcagcagtttggaatcacagtgttttgcagtatctgtgaagggaaatttgggagtgcattgagacctttactgaaaaaggaaatatcttcagataaaaacaacaaagaagctttctgaaaaactgctttgtgatgtgtgcatgcatctcaccaaggtaaacttttctttgttttccacagtttagaaacactgtttttgcccccttgatgaattgacttattgagctcactgaagcctatgaggataaagtgaatatcccaggataaatacaataaggaagctatctgagaaaccacgttgtgatgtatgcattcatcttgcagagttaaatttgttttcattgagcagtttggaaacactgttttggaagaatctgtgaaggtgtatttgggaacacattgaggcctatggtgaaaaaggaaatatccttagataaaaattagaaagaagattgctgagaaattgttttgtgaagtctgcattcatctcacagagttaaacgttttctttagattcagcattttggaaacagttcttttctccattctgcaaatggacatttgggagctcattgaggccaatggtgaaaatgggaatatcccaggataaaaaattagaatgaagctatgtgagaaatcgctttgtgatgtgtgcattaatttcacagagttaaaactttcttttcattcagcagtttggaaacactgttttggttgaagctgcaaagggatatttgggagtccactgaggcatttgatgaaacaggaaatatcttgagataaaaagtagaaagaagctttctgagaaactgctttgtgatgtgtgcattcatctcacagagctttacatttctttggattccacagtttggaaaaagtattttggtagaatctgcaaagggatattgggagggcattgaagactacggtgaaaaaaggaaatatcttcagacaaaactagaaggacgctttctgagaaattgctttgtgaagtgtgcatttatctcacagagttaaacctttctttggattcagcagtttggaaactgatttttccattctgggaatggatatttgggaactcattgagggcaatggcaaaaaaaggaatatcccagaataaaaactagaaggaagctatctgtataatcactttgtgatgtatgcattcatcttgcagagttaaacctttcttttcattcagcagtttggaaacactgttttggcagaagctgtgaagggatatttgggagtgctttgagacctatggtgaaaaaagaaatgtcttcagataaaaactggaaagaagcttttgagaaattgctctggaagtgtccattcatctcacagaggtaaacctttctttggattcaacagtttggaaacactgttttgtccattctgtgaatgcatatttgtgagctcattgagggcagtgtcaaaaaagagaatatcccaggataaaaactagaaggaagctatctgagaaactactttgtgatgtgtgcattcatctcacagggctaaaactttcttttcattcaacagtttggaaacactgttttggtaaaatctgtgaaagtatattttgcagcacgttgagtcctatggtgaaaaaacacatatctttagataaaaactggaaataagccttctgggaaacagctttgtgatgtctgctttcatctcacggagttaaaactttctttggattcagcagtttggaaacactgtttttgtctattctgctagaggacatttgagatcttattcaggccactgttgaaaaagggaataaaccagggtaaatactaaatggaagctatctgagaatccgtgttgtaatatgtgcattcatctcacagacttaaaattttcctttcattcattatttgggaaacactgttttggttaattctgtgaagaggtatttgggagcacattgaagccaatggtgaaaaacgaaatatattcagataaaaactagtagaagctttctgagaaactgctttgtgataagtacattcatctcacagaatttaacatttctttggattcagcagtttggaaacactgtttttgtccattttgtgaatggacatttgggagctcattgaggccaatggtgaaaaggggaatatccctggataaaaactggaaagaagctatctgagaaagtgcttagtgatgtgtgcattcatctcacaaagttaaacctttcttttcattcagcagtttggaaacactattttggtagcatctgtgaagggatatttcggagcactttgaggcctactgtgaaaaaggaaatatcttcagataaaaactagaaggaagctttctgagaaactgcttcgtgatgtgtgtgttcatctacagagttaagccatttttttattcagcagttatgaaacactgtttttgtccattctacaaatggacgcattgagtccaatggtgaaaaagcaaacatcccaggataattactagaaggaatctatttgagaaagtgtgttgtgttgtggtcattcatctcacagagttaaacctttcttttccttctgcagttggcaaacaccgttttggtagaaattgtgaagggatatttggtggtgcattgaggcctatggtgaaaaaggaaatatcttcatataataactagaaagaagctttcttagaaactgcttggtgatgtgtgcattaatctcatagaattaaaactttatttggattcatctgtttggaaagactgtttttgtccgctctgtgaatcgaaatttagtaactaattgaggccaatggtgaaaaaagtgaatatcctaggaaaaaaacaagaaggaagccatttgacaaaatgctttgtgatgtgtgcattcatcttgcagagttaaaactttcatttcattcagcagtttgcaaacactgttttagtagaatatgtgaagggatatttcagagtgcattgaggtctattttgaaaaaggaaatatcttcagataaaaactagaaagaatctgagaaactgctttgtgatgcatgcattcatctcacagaggtaaatattccttcagattcagcagtttgtaaacactgtttttgtccattcagtgaatggacattttggaactccctgaagccaatagaggaaagagcaaatatcccaggataaaaactagaagaaagctatctgagaaaccactctgttatgggtgcattcatctcctagagttaaagcattgttttctttttttttaaattttttttattatactttaagtttaagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagggtgatattccccttcctgtgtccatgtgatctcattgttcagttcccacctatgaatgagaataagcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatcatgccgcaataaacatacgtgtgcatgtgtctttatagcagcatgatttatagtcctttgggtatatacccagtaatgggatggctgggtcaaatggtatttcccggtgcagatccccgaggaatcgccacactgacttccacaatggttgaactagtttacagtcccaccaacagtgtaaaagtgttcctatttctccacatcctctccagcacctgttgtttcctgactttttaatgattgccattctaactggagtgagatggtatcacattgtggttttgatttgcatttctctgatggccagtgatgatgagcattttttcatgtgttttttggctgcacaaatgtcttcttttgagaagtgtctgccatcactcaggattaagaatctcactcaaaaccgctcaactacatgggaactgaacaacctgctcctgaatgactactgggtacataacgaaatgaaggcagaaataaagatattctttgaaaccaacgagaacaaagacacaacataccagaatctctgggacgcattcaaagcagtgtatagagggaaatttatagcactaaatgcccacaagagaaagcaggaaagatccaaaattgacaccctaacatcacaattaaaagaactagaaaagcaagagcaaacacactcgaaagctaggagacggcaagaaataactaaaatcagaccagaaatgaaggaaatagagacacaaaaaaccctttaaaaaattaatgaatccaagagctggttttttgaaaggatcaacaaaattgatagaccgctagcaagactaataaagaaaaaaagagagaagaatcaaatagacacaacaaaaaatgataaaggggatatcaccactgatcccacagaatacaaactaccatcagagaatactacaaacacctctatgcaaataaactagaaaatctagaagaaatggataaattcctcgacacatacattctcccaagactaaaccaggaagaagttgaatctctgaatagaccaataacaggagctgaaattgtggcaataatcaatagcttaccaaccaaaaagagtccaggaccagatggtttcacagccgaattctaccagaggtataaggaggagctggtaccattccttctgaaactattccaatcaatagaaaaagagggaatcctcccgaactcattttatgaggccagcatcatcctgataccaaagccgggcagagacacaaccaaaaaagagaattttagaccaatatccttgataaatattgatgcaaaaatcctcaataaaatactggcaaaccgaatccagcagcacatcaaaaagcttatcaaccatgatcaagtgggcttcatccctgggatgcaaggctggttcaatatacgcaaatcaataaatgtaatccagcatataaacagaaccaaagacaaaaatcacatgattatctcaatagatgcagaaaaaacctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattcggcaggagaaggaaacaaagggtattcagttaggaaaagaggaagtcaaattgtccctgtttgcagacgacatgattgtatatctagaaaaccccattgtctcagcccacaatctccttaagctgataaccaacttcagcaaagtctcaggatacaaaatcaatgtacaaaaatcacaagcattcttaaagcattgttttcattcagcattttgggatcactttttttgcagtatctgcaaagggagatttgggaatgaactcaggccttctttgatgaaataggaaatatcttcagttcaaaattagaaagaatctttctgagaaacggttttttgattctgcatttatctcacaagagttaaacctttctttggatgcagcagtttggaaacactgtttttgtccattctgtaaatggccattttggaactccttgaagccaatatagaaacagcaaatatcccaggataaaaaatagaaggaagctatctgagaaaccactttgtgattggtgcattcatctcctagagttaaaacattgttttcattcagccatttggaatcactttttttgcagtatctgtgaaaagaaattttggagtgtattgagacctttgattaaataggaaatatctccagataaaaactagaaagaagctttctgagaaactgctttgtgatgtgtgctttcatctcaccaggttaaactcttcttttcattctgcattttgaaacaatgttctggtagaatctatgaaggaatatttgtgaatgcattgagtcctatggtgaaaaaggaaatatcttcagataaaaaatagaaagatgctttctgagtaactgctttgtgaagtgtgcattcatcacacagagttaaacgtttcttgggattcagcagtttggaaacactgtttttgtgcattctgcaaatggacatttgggagctcattgaggccaatggcaaaaaagggaatatcccaggataaaatatagaagaaagctatctgagaaaaaggtttgtgatgtgtgcattcatcttctagatgtaaacccttcttttcactcagcaatttggaatcactgtttttgcagtatctttgaagggaaattggggagtgtattgagtcctttgatgaaacaggaaatatcatcatatgcaaactagaaagaagctttctgagagactgctttatgatgtgtgcactaatatcatagagttaactgttcctttggatccagcagttttgaaacactgtttttgtccattctgcaaatggatatttgagagctcattgacgtcaatggcaaaaaggcaaatatcctggggtaaatactagaaggaatctttctgataaagagtgctgtgatgtatgcattcatctcacagagttaaacatttcttttcattcagcatttttgaaacactttttaggtggaatctgtgaagggatatttgggagtgcatggaagcctatggcgaaagacaaaatatcttcagagaaaaactagaaagatgctttctgagaaagtgctttgtgatgtgggcattcaactcacagacttaaacttttcttttgattcagcagtttggaaacactgtttttgtccactttgcaattgaaaattttggaactcactgagtccaaagtcaaaaaagtgaatatcccaggataaaaacttgaaggaacctatctgacaaaccgctttgtgatatgtggattcgcctcctagagttaaaatattcttttcatagcagtttggaatcaatgtttttgcaatatctgagaagtgatatttgggagcgcatagaggccttttatgaaataggaaatattttcagacaaaaactagaaagatgatttttagaaactgctttgtgatgtgtacattcatctcacaggtttaaacgttttttgaatgcagcattttggaaacactgttgttgtccattctgtgaatggacattttggaactccttgaagccaatagagaaagagcaaatatcccaagataaaaacgaaaagaagctatcttagaaacctccttgtgatggttgcattcctcttttagagttaaaacgttttcattcggcattttggaatcagtttttgtgtatcagtgaagggaaatttgagattgtattgaggtctttgattaaataggaaatatctccagataaaaactagaaagaagctttctgaaaaactgctttgggatgtgtgcattcatcttgcaggattaaattcttcttttcattcagcagtttggaaacaatgttttggtagaatctgcgaaggaatatttttgatctcattgaggcctatgttgaaaaaggaaatatcttcagaaaaaaggtagaaagaagatttctgagactctcctttgtgatgagtgcattcttctcacagaattaaacatttcttgggattcagcagtttggaaacactttttttttttttttgtattctgtgaatggacttttgggagctcattgaggccaattttgaaaaatggaatatcccaggataaaaactacaagaaagctgtctgagaaaccactttgtgatgtgtacattcatctcctagaattaaacccttcttttcattcagcagtttggaatcactgttttcgccatacttgtgatgagaatttcaggagcacattgagtcctttgatgaaataggaaatttcttcaaatgaaaatgacaaaaaaactttctgagaaactgctgtgtgatgagtgcactcatctcacagaggtaaatgttagtttggattcagcagtttggaaacactgtttttttccattctaccaatggacattttgacttcattgaggccaatgatgaaaaagcgaacatcccaggataaatactacaagaaagctacctgagaaaccactttgtgttgtgagcattcatctctcacagctgaacttttcattaagcagtttggaaacactattttggtagaatcagtgaaggcctatttgggagtgctttgaggcctatggtgaaaaaggaaatatcttctgataaaaattagaaagaagcttactgagaaaccgtgttgtgatgtgtgcattcatctcacagaggtaaacatttcctttcattcagcagtttagaaccactgttttggtggaactgtgaagggatatttgggagtgcatggaggcctgtggtgaaaaaggatatatcttcagatgaaattagaaagaagatttctgagaaacttccttgtgatgtgtgcattcatatcacagagttaaacttttctttggattcagcaatttggaagcactgtttttgtccattctgtgaatgcacatttgggaactcactgaggccaatggtgaaaaagtgaatatcgcaggacaaaaccaagaaggaagctacctgaaaaaccactttgcgatgtttacattcacctcctagagttaaaaatttcttttccttcagcagtttggaatcaccatttttgcagtatctgcgaatggaaatttgggagcacttggaggcctttaatgaaaagagaaatatcttcagataaaaactagaaataagctttctcctaaactcctttgtgatgtgtgcattcatctcaccgatttaaaactttctgtggattcaacagtttgtaaaaactgtttttgtacattttgtgaatggacatttgagagctcattgcggttaatggtgaaatagtgaatatgccaggataaaaattagaagtaagctatctgagaaaccactttgtgatgtttgcattcatctccaaaagttacacgtttctttcattcagcagtttggaatcactctttttacagtatctgcaaatggaaatttgggagcacactcaggcctttgatataacagtaaatatcttcagataaaaactagaaagaagcatttgtcaaactgctttgtgatgtgtgcattcatctcacagaattatcctttccttggatgcagcagttgggaaacactgtttttgtccattctgcaaatggacatttgggagctccttgaggccaatggtgaaaaagcaaatagtacaggatgaaaactagaaggaagctatcagagaaatggctttgtgaagtgtacattagtctccttcagttaaagcttttttttcattcagtagtttggaacactgtgttggtagactctctgaagggatatttgggagtgcattgaggcctaaggtgacaaaggaaatatctcagaaaaaaatagaaagaaggtgtttgcaaaattgctttgtgatgttggcattcatctctgagggttaaattttcttttcatttatcagtttggaaatactgttttggtagaatctgcaaagggatatttgggaacgaaaagtggcctatgttgaaaaagaaaatatcctgaacggtaatgcctaggttttcttctagggtttttatggttttaggtctaacgtttaagtctttaatccatcttgaattgatttttgtataaggcgtaaggaagggatccagtttcagctttctacatatggctaggcagttttcccagcaccatttattaaatagggaatcttttccccattgcttgtttttctcaggtttgtcaaagatcagatgttgtagatatgtggcgttatttctgagggctctgttttgttccattgatctatatctctgttttggtaccaggaccatgctgttttggttactgtagccttgtagtacagtttgaagtcaggtagtgtgatgcctccagctttgttcttttggcttaggattgagttggtgatgagggctcctttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttatttcattgagccgtggtttgtagttctccttgaagaggtccttcacatcccttgtaagctggattcccaggtattttattcttggtgaagcaattgtgaatgggagttcactcattatttggatctctgtttgtctgttgttggtgtataagaatgcttgtgatttttgtacattgattttgtatcctgagagtttgctgaagttgcttatcagcttaaggagattttgggctgagacaatggggttttctagatatacaatcatgtcatctgcaaacagggacaatatgacttcttcttttcctaactgaataccttttatttccttctcctgcctaattgccctggccagaacttccacactatgttgaataggagcggtgagagagggcatccctgtcttgtgccagttttcaaagggacaaaagccaaaattgacaaatgggatctaattaaactaaaaagcttctgcacagcaaaagaaaccaccatcagagcgaacaggcaacctaaaaagcgggagaaaattttcacaaactactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaatacacatgaaaaaacgctcatcatcattggccatcacagaaatgcaaatcaaaagcacaatgagatagcatctcacatcagttagaatggcaatcattaaaaagtcaggaagcaacaggtgctggagaggatgtggagaaataggaacagttttacactgttggtgggactgtaaactagttcaaccattgtggaagtcagtgtggcgattcctcagggacctagaactagaaataccatttgacccagccatcccattacttggtatatacccaaaggattataaatcatgctgctataaagacacatgcacacgtatgttttcatggaatctatgaagaaatatattggagcacattgagacctatggtgaaaaaggaaatatgttcagataaaaactagaaggatactttctgagaaacagctttttgatatgtgcattcacctcacagaattaaatgattctttggattcagcaggttgggaacactgttgtccattctgtgaatggactttgggagctcttttaggccaatggtaaaaaagtgaatatcccaggataaaaactacaaggaagctatctgagaaactgctttgagatgtgtgcattcatcaggcagagctaaacttttcttttcatttagcagtttggaaacactgtttttgtagaatctatgaaggtatgtttgggattgcgttgagtcctatgatgaaaaatgaaatatcttcagaaaaaaaactggaaagaatatgcagtgtttgtttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatatgtgtgcatgtgtctttatagcagcatgatttatagtcatttgggtatataccctatatacccagtaatgggatggctgggtcaaatggtatttcccagtgcagatccccgaggaattgccacactgacttccacaatggttgaactagtttacagtcccaccaacagtgtaaaggtgttcctatttctccacatcctctccagtacctgttgtttcctgactttttaatgattgcctatcgcaagaacaaaaaaccaaacaccgcatattctcacccataggtgggaattgaacaatgagatcacatggacacaggaaggggaatatcacactctggggactgtggtggggtggggggaggggggagggatagcatttggagatatacctaatgctagatgacgagttagtgggtgcagcgcaccagcatggcacatgtatacatatgtaactaacctgcacaatgtgcacatgtaccctaaaacttaaagtataataaaaaaaaaaaaactagaaagaagctttctgagaaactactttgtgatgtgtgtatttatctcaaagagttaaactttctttggattcagcagtttggaaacactgtttttgttgaggatattttggaacttattgaggccaatgctgaaaaagtgaatatcctaggaaaaaactggaaggaaggtatctgagaaagcactttttgatatgtggattcacatcactgagataaaccattgttgtcattcagcagtttggaatcattgcttttgcagtatcttcatagggaaattcgggagtctgttgaggcctttgattaattacaaatattttcagataacaactagaccgaaaatttctgagaaactgctttttgaagggtgtattcatctcacagagataagcttttctttggattcagcagtttggaaacactctttttgtctattctgcgaatagacatttgggaattcattgaggccattggtgaaatagcaaatatcccaggttaataactagaagtaagctacctgagaaattgctttgtgatgtgtgagttcacctcacagggtaaatcctttcttttaattcagcagtttggaaacactgttttggtagaaactgcaaagggatatttgggagcacaattaggcctagggtgaaaaatgaaaaaacttcagataaaaactagaaagattatttctgagaaactcctttttgatttgtaaattcatctcacagagttaagactttctttggattcagcagtttttaaacactggttttgtccattctgtgaatggacatttgggaactcattgaggccaatggtgaaaaagggaatatcccaggataaaaactagaaggaagctatctgagaaactgctttgtggcctgtgcattcatctcctagagttaaaactttcttttcattcagctatttggaaacactggtttggtggaaactgtgaaggtatattttggagcatattgaggcctatggttgaaaaagtaattatcctcagataaaaaacagaaataaattttctgagaaactattttgtgatatgtgctttcatctgagagagataaacatttctttggtttcagtagtttggaaacaatgtttttgtctatcctgcaagtggacttttgggaactcattgagtccaagggcaaaaaagagaatatccctggataaaaactagaagaaagctatctgagaaacccctttattatctgggcattcatctcatggattttaacctttctttccattcagcagtttggaaacactctttttgtagaatctttgaagggatattttggagcacattgaagtctatggtgaaaaaggaaatatcttcagataaaaactagaaagatgctttctgagaaactgctttgtggtgtctgcattcatctgacagatctaaaactttctttggattcagcagtttggaaacaatgtttttgctaattctgcaaatgtacatttgggagctcattgaggccaatggtgtaaatgcgaatatcccaggataaaaaatagaggaaagctatctgagaaactgctttttgatgtgtgcattcatctcgtgaagtttaaactttcttttcattcaaaagtttggaaacactcttttggtagaatctgtgaagggatatttgggagctcattgaggcctttctttaaaaaggaaatatcttctgataaaaaatataaagaagctttctgataaacttctttgtggtgtgtgcattcatttcacagagtttaacctttctttggattcagcattttggaataactgtttttgtccatttcgcgaatggactgtttgttgggatctctttgaggccaattgtgaaaaagcgaatatcccaggataaaaacttgaaggaagtaacctgatacaccaccttgtgatgtgtgcattcatctcagatatttaaatatttctttggattcagcagtttggaaacaccatttttttccattctacgaatggatatttgggagctcaatgtggccaatggagaaaaatggaatatcctaggttaaaaactagaaggaaactatctgagaaactgcattttgatgtgtgcattcatgtcacagagttaaacctttctttcattcagcagtttggaaacactgctttggtagaatctcgaagggatatttcagaatgcattgaggactttggtgaaaaaggaaatgtcagacaaaaactagaaagaagctttctgagaagctgctttgtcatgtgtgcattcatctcacatagttaaacctttctttggattcatctgttttggaatcactgttttttccgttctgcaaatggacatttggcaactcattgaggccaatggtgaaaaagtgaatatcccagaacaaaaactagaaggaagctatctgaaaaattgttttttgatgtgtgcattcatctcctaaagttaaacctttcttttctttcagcagttttgaaacattgtcttggtagaatctgcaaagggatatttgggagtgcattgattcctgtggtgaaaaaggaaatatcttcagataaaaaatagaaagaatctttctgagaaactgtattgtgatgtttgcattcatctcacagacttaaacttttctttggatgcagcagtttggaaacactgttttgtctattctgtgaatggacatttcggaactcattgaggccaaaggtgaaaaactgaatatcccaggataaaaactagaaggaagctatctgagaataagctttgtgatgtgtgcattcatctcacagagttaagcctttctttccattcagcagtttggaaacactgttttttagaatgttggaagggatatttgggagctcattgagacctatggtgaaaaagaaaatatcttcagataaaaagtggacagaagctttctgataaactgctttgtgatgtgagcactcctctcacagagttcaactcttcttttgattcgacagtttggaaacactgtttttgtccattctctgaagggacattttggagctcattgaggacaattgcaataaaatgaagatctccctataaaaactagaaagaagcattctgagaaacccctttgtgaggtgtgcattcatctaaaagaattaaacctttctgttcattcagctgtttggaaacactattgttgtagaatctgtaaagggaattttgggagcccattgaggcctatggtgaaaaagaaaatatgttcagataaaagctagaaagaagcttcctgcgaaactgctttgtgatgtgtgcattcatatcccagatttaaacctttcttttgattcagcagtttggaaacgcaaatttttttcaattctgcttatgagcatttgggagctcatagtggttaatggtgaaaaagtgaatatattaagattaaaaaaagaagatatctatctgagaaaccactttgtgatgtgtgctttcatctcacagaattaaacctttcttttcattcagtagtttggaaacactgtttttgtagtatccatgaatggatatttaggagagcattgaggactatggtgaaaatatattcagataaaaattagaaaaaagctgtctgagaaactgatttgtgttgtgtgcattcacctcacagagttaaaccattcttttgattcagctgtttggaaacactgtttttgtctattctgcgaatggacatttgggagctcattgagaccaatggcaaaaaagtgaatatcccaggataaaaactagaaggaagctatctgagaaactactttgtgaggtgtgcattcatcttgtagtgttaaacctttattttcattcagcagtttggaaacactgtttttgtagaatctgcaaaaagatattttggagtgctttgaggcttatggtgaaaaagaaaatatgttcaaatagaaactagaaagaagctttctgagaaatgtctttgtgatgtgtgcattcatatcagagagtcaaacctttcttttgatgctgcagtttggaaatactatttttgtcaattatgtgtatgagcatttgtaagctcattgaggctaatggcaaaaaagggaatatcccatgataacaactagaaggaagctagctgggaaacggcattgtgatgtgtgcattcatctcacaaagttaaacttttcttttcattcagcagtttggaaaaacaattttggtagaatctgtgaagggatatttgggaatgcattgaggcttatggtgaaaaaggaaatatcttcatgtataaaatagaaagaagctttctgaaaaacagctttatgatgttgcattcatcacagagttaaacatttattttgattcagcagtttggaaacgctgtttttgaccattctgagaatggacatttgggaactcattgaggccaatggtgaaaaaacgaatatcccaggatccaatccagaaggaaagtatctgagaatccgctttgtgatgtgtgcattcatcctgtagcattaaacatttctgttgattcagtagtttggaaacactgttattgtacaaactgtgaaaggtatttgggactgccttgaggcctatggagaaatagaaaatatcttccaatcaaaactagaaagaatctttctgagaaattgctctgtgatgtgtgcattcatctaacagagttaaaactttctttagattcagcagtttggaaactgtttctgtccattccgtgaatggacacttgggaactctttgaggcccatggcgaaaaagcaaatatcccaggattaaaaactagaaggaagctatctgagactggtctatgatgtgtgcatttttctcagaaacttaaaaatttcttttcactcagcagtttggaaagactgttttggtagaatctgtgaagagatagatatttgggagcacattgaggcatatggtgaaaaaggaaataacttcagataagactagaaagaagattttggagaaattgctttgtgatgtgtgccttcacttcacagagttaaacatttatgtgaattctgcaatttggaaacactgtttttgtccattctgcacatggacattttggagttcatagaggccaaaggcaaaaaagcaaataacccaggataaaaactagaaggaagcaatctgagaaactgctgtatgatgtgtgctttcatatcctgaagttaaacctttctttacattcaccagtatggaaacactgtttttgcagtatcagtgaagggaaatttgggagcacattaaggcctttgataaaatagaaaatatcttcagataaaaactagaaagaagtttgagagaaagtctttgtgacacgtgcattcatctcagagagataaaaatttctttggattcagaagtttggaaactgtttttgtccattctgcaaatgaatattagtgagctcattgaggccaaaggccaaaaagggaatatcccaggataaaaactcgaaggaagctatctccgaaaccactttgtgatgtgtgcattcatctcagagagctaaacctttattttcattcagcagtgtggaaacactgttttggtagaatctgcgatggtatatttgggagcccaatgaggccgatggtgaaaaaggaaatatcttcaaataaaaactagacaggaactttctgagaaagcattttggaaacactgttttggtagaatcggtgaagggatattttggagggcattgaggcccatggagaaaaatgaaatatcttcatataaaaattagaaagaagctgtctgagaaactgctttgtgatgtgtgcattcatctcacagagttaagcatttcttgtgaatcagaggtttggaaacactgtctttgtccattctgcaaaaggacattccaaaactcattgaggccaaaggagaaaaagtgaatatcccaggataaaaactagaaagaagctgtctaagaatacactttttgatttctgcattcaactcctagaggtaaacctttctttgaattcagcagtgttgaatcactgtttttgcagtatttgcaaagggcagtttttgagcactttgaggcctttagtgaactaggaaatatcttcagataaaaactagaaagaagatttctgagaaaccactttgagatgtgtgcattcatctcctagagttcaaccactcttttcattcagcagtttggaaacactatttttatagaatctgcaaaggaatattttgaaattcattgaggccaaaggtgaaaaggtgactatcccaggacaaaaactacaaggaagctgtctgaaaaaccgctttgtgatgtgtgcatttatctgacagacctaaacctttcttttaattcagtagtttggaaacactgctgtggtagaatctgtgaaggcatatttgggagtgcatcgaggcctatggtaaaaaaggaaatattttcaaataaaaactagaaagaaactttctgagaaattgctttgtgatgtgtgcattcatcttacagagttatactattctttggattcatctgtttggcaacgctgtttttgtccattctgcgaatggatgtttgggaactctttgaggccaacggtgaaaaagcaaatatcccaggataaaaactagaaggaagctaccttagaaaccactttgtgatgtgtgctttaatctagagttaaaactttcttttcattcagcagtttggaaacactgttttattacaatctgcaaagggaaatttgggagtgcattgaggcctttgatgaaacaggaaatagcttgagataaaaactagaaagaaactttctgagaaactgctttgtgatgtgtgcattcatctaacagatttaaacatttctttggattcagcagtttgggaacactgtttttgtccattctgcgaatggacttttgggagctcattgaggccagtggcaaaaaagtgaatatcccaagttaaaaactagaaggatgctacctgagaaagcactttttgatgtgtgcattcatcttacacagctaaacctttcttttcattcagcagtttggaaacactgttttggtagaatctatgaagggatatttgggagcacatggaggcctatggtgaaaaaggaaatatcttcagataaaaaccagaaagactctttctgagaaaatactttgtgatatgtgcattcatctcacagagtaagcatttcttttgctttagcagtttggaaacactgttttagtccactctgtgaatggacatatgggaactctttgagtccatggtgaaaatcgaatatccctggataaaaactagaattaaattatctgagaaacaactttgtgatgtgtgcattcatctcctagggttaaacatttcttttaactcagcagtttgaaaacactgatgtgctataacctgcaaagggatatttgggagtgcactgagtcttatggtgaaaaaggaaatatcttcagataaaaactagaaagaagatttctgagaaactgcttggtgatatgtgcattcatctcacagagttaaacctttgttttgattcagtagtttggaaacactgtttttgtccattctgtgaatggacatttggaaactcattgaggctaatggcaaatatcccaggataaaaactagaaggaagctatctgagaaactgcttgtgatgtttgcattcatctcccacagttaaaccattcttttcattcagcagtttggaaccactttttttacagtatctgcgaagggaaattttggagcacattgaggcctttgatgataaaggaaatatcttcacagaaaaactagaaatattttttctgagaaactgctttgtaatgtctgcattcatctcatggactttaacatttctttgtattcagccatttggaaacatttttttttccattctgtgaatggacatttgggaactcactgaagctaatggagaaaaagggaataccccaggatgaaaactggaaataagctatctgagaaactgctttttgatgtgtgcattcgtcaccaagagttcaacatctcttttcattcagcagtttggaatcactggttttgcagtatctgcgaagggatatttgggagtgcaatgaggcctttgatgaaataggaaatgtcttcagataaaaactagaaagacgctttctcagaaactgctttgtgatgcgtgaatttatctcacagacttaacatttctttggattcagcagtttcaacatactgtttttgtccattctgtgagtggacatttcagaactcattgaagcctttggtgaaaaagtgaatatcccagtataaaaagtaaaaagaatcgatctgagaatctgctttgtgatgcttgcattcatctctttgagtttaaaactttcttttcatttagcagtttgggatcactggttttgaaatatctgtgaagggaaattttggagcacattgaggccttatatgaaaaaggaaatatctccgatagaaataagaaaaaatatttctgagaaactgctttgggatgcatgcattcatctcacaaatttaaacacttttttggattcagcagtctggtaacactgtttttgtgcattctgtgaatggacatttggaagctcattgagaccaatggtgaaaaaggaaataacctaggataaaaactagaaggaagctatctgagaaacactttgagatgcatgctttcatcttgcagagttaaacctttcttttcattcaacagattggaaacactgttttggtagaatctacaaagggatattagggagtgcatttaggccaatggagaaaaaggaaatagcttaagataaaaattagaaagaagctttctgagaaactgctaagtgatgtgttcattcatctcacagagttaaacttttctttgggttcagtagcttggaaacactgttttgtccattctgcggctggacatttaggagttaattgaggccaatgatgaaaaagtgaatatcacaggataagtagtagaaagaagctatctgagaaaccactttgtgaagtctgcattcatctcctagatttaaacacttcttatcattcaccagtttggaatcagtttttgcagtatgtgtgagggaaatttgggagcgcattgagacctttgatgaaataggagatatcttcagataaaaaaaagaaagaatctttctgagaaactgctctgtgatgtttgcattcatctcacagacttaagcatttctttgtatgcagcagtttggaaacactgtttttgtgcgttctgcaaatggacatttgggagctcattgaggcaagtggtgaaaaagggaatacactgggataaaaactagaagaggctatgtgagaaacactttgggaagtgtgcctttatcttgccgtcttaaaactgtcttttcattcaacagtttggaaacactgttttggtagaatctacaaagggatattagggagcgcatttaggccaatggtaaagaaggaaatagcttcagataaaaattagaaagaagctttctgagaaactgctatgtgatgtgtgcattcatcttgcagagataaagctttctttggattcagcagtttggaaacactgttttcgtccattcggtgaatggacatttgggaactcattgaggccaatagcaaaaaagcaaatatcccaggataaaaactagaaagaagctatctgaggaagcactttgtgatatgtgctttcaacttctagagttaaacctttcttttcattcagcagtttgtatacacagttttggcagaatctgtgaagggatatttgggagcactttgaggcctatggtgaaaaaggaaatatcttctgaaaaatgagaaagaagctttctgagaaactactttgtgatgtgtgcattcatctcagagttaaaaatctctttggattcagcagtttggaaactgcctttgtcccttctgtgaatggatatttgggagctcattgaggccaaagcaaaaaagcgaatatcccaggtaaatactagaaggaagctttgtaagaaactgcactgtgatgtgtgcattcatcttgcaaagttaaacttttctttcactcagcagtttggaaacactgttttggtataatctgtgcagggatatttaggattgccttgaggtttatggtgaaaaaggaaatatcttcagataaaaactagaaagaagctttctgagaaactgctgtatcgtgtgaattcatctcacagagttaacctttctttggattcagcagctttgacacactctttttgtccattctgcaaatgcacatttgggaactcattgaggctgatgcaaagcagcaaatatcccaggataaaaactagaaggacactatctgagaaactgctttctgatatgtgcattcatttcctagatttaaacttttcttttcattcagcagtttggaaacactgttttggtagaatgttcgcaggtatatttgggagcacattgaggcctatggtgaaaaaggaaatatctttggataaaaactataatctttttgagaaactgctttttgaagtttgcattcatctcacagagttaaacctttcttttcattcaacggtctgaaaacactgtttttgtccattctgtgaatggatatttgtgatctcattgagaccgatggtgaaaaagcaaaattcccaggaaaaataatagagcaaatctatctgagaaaccacttttttgatgtgtgcattcatctcacaaagttaaaactttctttcgatttagcagttggtaaaaacagtttttatctattctgaaaatggatattttggatctcatttaggccaatggcaaaaaaggaaagatcccaggataaaaattagaaggaaggtatctgagaaactgctttgtgatgtgtgcattcttctcacagagttaaacctttcttatcactcagcagtttggaaatgctgttttgctctaatctgtgaagagatatttgggagcttgttgaggcctgtgattaaaaaggaaatatctttggataaaatctagaaaggagctttctgagaaactgctttcttatgtgtgaattcatctcacagagttaaacttttctttgaattcatctgtttggaaacactgtttttgtccattctgcaaatggacatttggaaactcattgaggccaatggcaaaaaagtgagtatctcagaaaaaaaattagaaggaatctctctgagaaaccactttgtgatgcgtgcattcatctctgagagctaaacctttcttttcatccagcattttggaatcactgtttttgcagtatctgcagagggaaagttgggagggcaatgaggcctttgatgatgaagtaggaaatatcttcagataaaaacgaaaaataagttttctgagattatgctttgtgaagtgtgcattcatctcacagagtaaatgtttctttgcattcagcagtttggaaacattgtttttgtccattctgtgaatggatatttgggaggtcattgaggtcaatggggaaaaagtgaatatcccaggataagtactagaaggaagtggtctgagaagccatgctgtgttgtgtgcattcatcttgcagatttaaacttttcttttcactcagccatttgaaagcactgtttttgtagaatctgtgatgggatacctgggaacacattgaggcctatggtaaaataggaaatatcctcagataaatactataaagaagctttcagagaagctgctttgtgatgtgtgcattcatctcagacttaaaactttctttgtattcatttgttcagaaatactgcttttgcccattctgtggatggacatttgggaactaattgaggccattgttgaaaaagtgaatatcccaggataaaaacacaaggaacctctctgagaaaccactttgtgatgtgtgcattcttctcagagagttaaatctttcttttgattgagcagtttggaaacactgtttttgtataatctgcaaagtgacgtttggtagtaataataggcctatggtgaacaaggaaatatcttcagatagtaattggaaagaagctttctgagacacagatttgtgatgtgtgcattcatttaactgcgttaaattttttctttagtggagctgtctggaaacaaccttttggcagaatctacaatgggttattttggagcgcattgaagcctacagtgaaaaaggaaatatatccagataaaaagcagaaagaagctttaagagaaactgctttgggatgtgtgcactcatctcacagagttaaaactttgttttgattcagcagtttcgatacactgttttggtggaatctgtgaagggatatttgtcagcacactgaggcctatgttgaaaaaggaaataacttcagataaaaactagaaagatgctttctcagataacaccctgtgaagtgtgatttttttcacagaattatacctgttttttgattgagcagcttggaacactgtttttgtagggtctgcaaagggatatttgggagctcattgaagcctacggtgaaataggaaatatcttcagataaaaactggaaagaagcattataagaaactgctttctgatgtgtgcgtccatctcacagagttaagtccttctttagatggaatagtgtttaatcactgtttttgtagaatctacgaagctatatttgggagggcattgagtcctatggtggaaaataaaataccttcagagaagaataatacagaagcattctgagaaactgctttgagatgtgtgcattcatttcacagtgttaaacgtattttttgattgatcactttggaaacactgcttttgtagaatctgaatctgtgaagggatatttgggagtgcacaatgcctattttgaaaaaagaaataacttcagatgaaaactaggaggaagatttttgaaaaactgctttgggatgtctgcattcatctcacagagttaagtctttcttttcattgagcaatttggaaacactgtttttgtagaatcggcaagggtatatttgtgagtgctatgaggcctaggttgaaaaggaaatatcttcacataaaaactagaaagaagcttttagagaaactgttttgtgaagtgtgcattcaactcacagagttaaacatgttttttgattgagcagtttggaaacactgtttttgtagaatctcagacaggataacaggtagattattgaggcctatggcaataaagaaaacatcatctccatataaaaactaggaagaatctttttgggaaactgctttgtgatgtgttccttcatctcacaaagttaaacctttcttttgattcagaagtttggaaacagttttttgtagaatctgcagatggatatctgtgagcggtttgaggcctgtggtgaaaaaagaaatatattcacataaaaactagacagaagctttctgagaaacttctttgtgatgtatgctttcatctcacagagttgaacctttgttttgattgagcagtttggaaacagtctttttgtagattctgcagagggatatttgtgagcggtttgaaggcctatggtgaaaaaggaaatatcttcacataaaaactagacagaagctttttgagaaacttctttgtgttgtgtgcattcatctcacagagttgaagttttcttttgattgagcagtttggaaacagtctttttgtacaatctgcaaagggatatttctgagcagtttgaggtctatggtgaaaaagaaatatcttcagataaaaactagacagaagcattctgagaaacttctttgtgatccgtgcattcttctcacagaattaaacgtttttgttttgtttgagcagtttggaaacactatttttgtagaaactgcaaagggatatgtgggagtgcaatgatgcatatggtgaaataggaaatatcttcagataaagactggaaagaaatcctttgagaagttgttttgtgatgcatgcattcatctcaccgagttaaacttttcttttgactgagcaatttggaaacaatatttttgtgtaatctgtgaagtgatgttaaatagtgcaaaaaggcctatggcaaacaaggaattatcttcagataaaaactggagtgacgcagtatgaaaaactgctttctgatgtgtgcattcatctcacagagttaaatccttcttttgatggaactgttaagaaacactgtttttatagaatctgtgaagggatattagggaccactttgagacctttggtggaaaagggaatgtcatcagacaagagctagacagaagttatctgagaaactgctttttgatgtgtgcattcttctcacagagttaaacctttctgttgattgagcagtgtggaaaaactgtttttgtagaatcttcaaaggtatatttgggggcacaccgaggcctctggtgaaaaagaaaatatctttggataaaaacaggaaagaaagttttgagaactgctttgtgatctgcgcattcatctcacagagttaaacctttctttttgattgatcattttggaaactctttttgtagaatatttgaggggatatttggagtgtgcaatgactatgttaaaaaaggaaatcacttcagatataaacgagaaagaagctttgtgagaaaccactttgtgatgtgtgcattcttctcacagaattaaatattccttttgattgagcagtttcaaaacactgcttttgtagaaactgcaaagggatatttgggagcacattgatgcctatggtgaaaaggaaatgacttcagatcaaaactagaaagaagctttttgagaaaccgtttgtgatgtattcattcatctcacagagttaaacttttcttttcatggagcagtttggaaacactctttttgtataatctgtgaagcattgttaagtaacacaaaaaggcctattgtgaacaaggaaatatcttcagataaaaactggaaagaatcattatgagaaactgatatcagatgtatgcattcattgcacagagttaaatccttcttttgatggtacagtttagaaacactgtttttgtagaattggcaaagcgatatttggtagtgcgttaaggcctatgatggaaaaggaaataacttcagaggagaactagacagaagttttctgagaaactgctttgtgatgtgtgcattcttctaagatagttaaaactttgttttgattgagtagattggaaacactgtttttgtagaacctgcaaagggatgtttgggagcatgaaatgcctatggtgaaaaaggaaataacttcagataaaagctagaaagaagctttctgagaaaccactttgtgatttgtgcattcatctcacagagttaaaactatcttttgattgagcagtttggaaacactgtttttgagaatctgcaaaagtatatttcagaattcactgaggcctatggtgaaaaggaaatatcttcagattaaagtagaaaaaagcttttcagaaactgctttgtgatgtgggcatttgactcacagagttaaagcagctttttcattgagcagtttggaaacactgtttgtgtagaatctgcaaaagtatgtttcagaatgcactgaggcctaggttgaaaaggaaatatctttggattaaactagcaagaagatttttaagaaactgttttgggatgtggacattcagctcacagagttaaaagagttttttcattgagcagtttggaaacactgtttttgtagaatctgtgatgggatatttgggagtgcattgaatcctatggtgataaaggaaatatcttcagataaaaactagaaagaagcctttttagaaactgttttgtgatatgtgcattcgtctcacagagttaaacctttcttttaactaagcagtttggaaacactgttttctcaataattgcgaagctgtatcaggtagcacaaaaaagcctatgatgaacaaggaaatatcttcagataaaaactggaaagaagcgttatgagaacctgctttctgatgtgtccgttcatctcagactgctaagtcattcttccaatggaacagtttggaaagactgtttttgcagcatctgcaaagggatctttgggagcacattgaggcttaaggtggaaaaggaaatatcttcagagaacagccagacagaagctttctgagaaactgcgttgtgatgtgggcattcgtctcatagagttaaagcagtttttctcattgagcagttttgaaacactgcttttgtagaatctgtgatgggatatttgggagtgcattgaagcctatggtgataaaggaaatatcttcaaagaagaactagacagaagctctctgagaaactgcattttgatgtgtgcatttgtctcacagagttaaacctttcttttgattgaggagtttggaaacactgtttttgtagaatctgtgaagggatatttgagagtgcactgatgcctatggtgaaaaaggaaatatcttaagataaaaactagaataagctttttgagaaactgctttgtgatgagtgcattcatctcacagagttaaacatttcttttgattgttcagttttgaaacactgtttctgtagaatctctgaagggatattttggtgtgcacatggcctatggtgaaaaaggaaataacttcagataaaaactagaaagaggctttgtgagaaactgctttgtgaagaatacattcttctcacagatttaaacatttcttttgattgagcagtttggaagcacggtttacatagaatctgcaaagggatatttgggagtgcatagatgcctacggtgaaaaaggaaatatgttcgggtaaaaaccagaaagaaggttttgagaagctgctttgtgatatatgcattcatttcacagagttaaatttttcatttgactgagcagcttggaaacactctttttgtattacctgtgaaacaatgttccatagcacaaaaaggtctatggtggaaaggaaaatttcttcagatacattatgagaaacggctttctgatgtgtgcattcatctcagagagctaaattcttctttttatggaacagtttggaaacactgtttttagagaatctgagaagtgatatttgggagcgctttgaggcctatcatggaaatatcttcagaggataactagacagaagctatctcagaaactgcattgtgatgtgtgtgttcgacacacagagttaaacctggtttttgaatgagcagtctggaaacactgtttttggggaaactgcaatgggacatttgaaagcccagttaagcctatggtggaaaaggaaatatctttggatataaactagaaagaaattttttcagtaactgctttgtgatgtgtgcattcatctcgcaaagttaaaactttcttttgactgagcagtttggaaacactgtgtttgtataatctgcagagcgatattatttagtgcaaaaatgcctatgttgataaagaaatatcttcagataaaaactggaaagaagcgttatgagaaactgcttttggatgtgtgcattcatctcatagagttaagtccttcttttgatgtaacagtttggaaaacttgtttttgtagaatctgcaaatgtatatttgggagtgcttttgaggcctatggtggaaaaggaaatatcttcagagaagaaatagaagctttctgagaaactgttttgggatgtgtgcattcatctcacagggttaaacctttctattaactaagcagttttgaaacattttcttgtgtagattatgcgaagggatatttgggaatgaattgtattaaagcttatggtgataaaggaaaaatcttcagattgaaaactagaaagaagccttttgagaaattgctttgtgatgtgtgcattcatctcacctagttaaacctttcttttgatagagtagtttagaaacactgtttttgtataacctacgaagtgactttttgtagtgcaaagaagtctatgttgaaaaaggaaatatctttggataaaaactacagagaagctttctgagaaacttctatcaatgactgcattcatctcacagaagtaaaactttcttttgattgatcagtttggaaacactgtttttgaagaatctgcgaaggcatatttgggagactttgaggcctatggtgaaaaaggaaatagcttctgataaaaattagaaagaagctctctgagaaactgctttatgatgtgtgcattcttctcacagacttaaacatttcttttgatacagcagtttgaaaacactgtttttgtagaatctgcaaagggatatttgggagtgcactgacacctaagatgaaataggaaatatcttccaagaaaaacttgaaagaagatttttgagaaactactttgtgatgtgtgtgtttagctcacagagttaaacccggtttttcactgagcagtttggaaacactgttattggagaatctgcaaagggatatctgggaatgcattgaagcctaggacgataaggaaatatctttgtttaaaaactagaaagaagatttttgagaaaatgctttgacatgtgtgcaatcatctcaaagagttaagtccttcttttgatggaacagattggaaacactgtttttgtagaatctgtgaagggatacttgggagtgcccatggcctatggtgaaaaggaaatatcttcagataaaaactaggaagaagcattttgagaaactgctttgcgatgtgtgcattaaactcaaagagttaaacttgttttttgattgagcagcttggaaacacacttttcgtagaatctgcagtaggatatttgggagtgttttgaagccagtggtgaagaagaaaatatatctttgtatgaaaactagaaagaagcttttaaagaaactgccttatgatgtttgaattcatctcagagaggtaaacctttcttttgactgagcagtttggaaacactctttttgtaaaatctgtgaagtgatattaggtagcacaaaaaagcctatggtgaaaaaggaaatatcttcagataaaaactgtaaagaacggttatgaaaaactactttctgatgtgtgcattcatctcacagggttaagtctttcttttgatggaacagtctggaaacactgtttttgtagaatgtatgaagggatatttgggagtgcaatgaggcctattgtggaaaaggaaatatcttcagaaaagaactagacagaagctctctgagaaagtgcattgtgatgtgtgcattcatctcacagagttaaactttcttttgattgacctgtttggaaacattgttttcatagaatctgggaagggatatttggggatcgagtaaagcctatgatgaaaaagggaatatatttcgataaaaactagaaagaagatttttgagaaactgcttttttatgtctgcattcatctcagagaggtaaacctttcttttgactgagcagtttggaaacactgtttttatcaaatttgcaaagggctatttgggagcacatgaggctgaaggtggaaaaggaaataacttcagataaaaactagaaacattcttagaaaccactttttgttgtgtgcatttttctcacaaagatagatttttcttttgcttaagcagtttggaaacagtgtttttgtagaatatgcaaagggatatttgggagtccacaggtgcctaaggtgaaaaaggaaatatcttcagataaaaactagaaagaaaagttttgagaaactgttttgtgatgtatgcattcatatcacagagttaaactttcctttggttgagcagtttggaaacaccgtttttgtagaatctgccagggtatatttgggagcacactgaggcctattgtgaaaaatgaaatatttttggataaacactagaaacaagctttttgaggaacggctttgttgtgtgtccattcaactcagagttaaacctgttttttgattgagcaatttggaaatgctttaattgtagaatctgcaatggggtatttgggagcacattgaagcctacagtgataaagtaaatacctttggataaaaactagaaaggagttttttcagaaactgctttgtgatgtgtgcattcatctcacagaattaaacctttcttttgactgagcagtttggaaaccctgtttttacaaaatctgcaaagtgatgttaggtagcgcaaaggcctatgttgaacaggaaaatatcttcagataaaacttggaaagacacattatgagaaactgctttcttatgtatgtgttcatctcacagagttaaacctttgtgttgattgagcagttcagaaacactcttttgtagaatctgggaagggatatttgggagctcacatagcttacagtgaaaaaggaaatatcttcgggtaaaaagcagacagaagctctttgagaaactgctttgtaatgtctgcattcaactcacagatttatacctgttttttattgagcagtttggaaacactgtttttgcagaatttgagcagggatattttggagtgcgttgaagcctatggtgataattgaaatatctttggataaaaaccagaaaaaaagcattttcagaaactgctttatgacgtgtgcattcatctcagagagttaaaccattctattgactgatcaggttggaaacactgtttttgcaaaatctgtgaaacaatattatgtagcacaaaaaagcctttagtgaaaaaggaaatatcttcagataaaaactggaaagaagcattatgaggaactgctttctgatgtgtgccttcatctcgcagatttaagtccttcttttgatggagcagtttggaaacactgtttttgtagaatgtgtgaaggaatatttgggagtgcatttaggcctatggtggaaaaggaagtatactcagagaagaagtagacagaggctttccaggaagctgcttggtgatgtgtgcattcatctcacagagttaaacctttcttttgaaagagcagtttcaaaacactgtttttctagaatctgtaaagttatactttggtgcacgtggtgtcttatgttgaaaaagtaaaaatcattggataaaaaatagaaagaagatttttgagaaagtgctttgtgatgtgtgcattcaactcatgactttaaacctgttttttgattaagcagtttggaaacatgtttttttagaatctgtgatgggatattttggagctcattgaaacctatggtgataaagaaaatatcttcagataaaaacgagaaaaaaagatttatgagaaactgttctgtgatgcctgcattcatctcacagagttaaacttttcttttgaatgaccagtttggaaacactgtttttgtagaatttgcgaagggatatttggaagtgcattgaagcctatggtaaaaaagagaatatctttggttaaaactagaaagaagctatttgagaaactgctttgtggtgtgtacattcattgcacaaagttaaaactttcttttgattgaacaatttggaaacactgtttttgtagtatctgcaaaggtatattttggagcgcaatgaagcctatggtgaaaagggaaatacctttggataaaaattagagagcaggtttttgagaaacttctttttttttcttcttttctttgggaatgccctgattcttttattttattttattttattttattattattatactttaagttttagggtacatgtgcacaatgtgcaggttagttacatatgtatacatgtgctgtgctggtgtgctgcacccattaactcgtcatttagcattaggtatatctcctaatgctatctggattaagaaaatgtggcacatatacaccatggaatactatgcagccataaaaaatgatgagttcatgtcctttctagggacatggatgaaattggaaatcatcattctcagtaaactatcgcaaggagaaaaaaaccaaacaccacatgttctcactcataggtgggaattgaacagtgagaacacatggacacaggaagagaaagggaacaccagaaaggctaacatcacactctggagaaacttctttgtgatgtgtgcattcaactcacagtgttaaccctgtttttcattcagcagtttagaaagagtgtttttgtagaatatgcaaaaggatatttgggagcgcatgagaactatgttgagataaaaactagaaagaagctttctgagaaactgctttgttatgtgtgtcttcctctcacagagttaagtccttcttttcatggaacagtttggaaacactgtttttgtagaatatgtgaaggggtatttgggggcatattaagcctatggtggaaaaggaaatatcctcagagaagatgtagacagaagctttctgcgaacctgctttgtgatgtgtgcattcatctcactaaattaaaactttcttctgattgagctgtttggaaacagtatttttgtagaataagtgaaggtacatttgggagcacattgatgcctagggtgaaaaaggaaatatcttttaataaaaactagaaagaagccttttgagaaacttctatgcaatgtgtgcattcatctcacagagttaaacctttttttggattgatgagtttggaaacactgttttggtagaatctgtgaagggatatttggaagcccatgaggcttatggtgaaaaaaggaatatctttggataaaaactggaaaggagtttttgaaaaactgctttgtgatctgtgcattcaactcacacagttaaaagtgtttcttggttgagcagtttggacacagtgtttttgtagaccctgtgaggggatatttgggcacacatagaatcctatggtgataaaggaaatatcttcagagaaaaactagaaagaagctttttgagaagctgctttgtgatgtgtgcatttatctcactgagtaaaacttttcttttgactgagcagtttggaaaggctgtttttgcaaaatctgcaaagtgatattatgtactacaaaaaagcatgtggtgaaaaaggaaatatcttcagataaaaactggaaagaagcattaagagaaattactttctgatctgtgcgttaatctcacagagtttagtccttcttttgatcgaacaatttggaaacactgtttttgtagaatctgcaaagggatattttggagcgcattggggtctatggtcaaaaaaggattatctacagataaaactagaaggaagatttttgagaaactgttttgtgataagtttgttcaactcagagagttaaacctgctttttattgagcagtttggaaacagagtttttgtagaatctgtgacaggaaatttgggagagctttgaagcctatagtgataaaggaaatatcttcagataataaccagaaaggagctttttgagaaactgatttgtgatgtatgcattcatcccacagagttaaacctttcctttgactgagcagtttcagaacactgtttttccaaaaatctatgaagcaatattaggtagcgtaaaaaagcctatgatgaacaagaaaatatcttaaggtaaaaactgaaaggaagtgttatgggaaactgctttctgatgtgtgcattcttctcacagagttaaacgtttcttttgattgagcagtttggaaacactttttttgtagaattggcaaagggacatttgggagggcaattatgcctatggtgaaaaaggaaatatcttcatataaacactaaaaagagctttctgagaaactgcttagtgatgtctgcattcatctcagagacttaaaaaatacttttggttgagcagtttagaaacactgtttttgtagaatctacaaagtgatatttgggagtgcatgagtcctatggtgaaaaaggaaatatctttggataaaaactagaaagaagctttttgagaaactgctttgtgttgtgtgtgttcatctcacagagttaaaactttcttcttactgagcagtttggaaacactgtttttgcaaaatctgcaaagcaatattttgcagtgcaaaaaaagcctatggtgaaaaaagaaatgtcttcagataaaaactggaaaaaatcattatgagagactgccttctgatgtgtgcattcatctcagagttaaggccttctttcaatgcaacagtttggaaacactgtttttgtagaatctgcaaagggatatttcagagtgcatttaggcctatattggaaaaggaaataccttcatataagaactacacagaagctttctaagaactgctttgtgatgtgtgcattcatctcacagagttaaaactttcttttggttgagcatttaggaacactgttttggtacaatctgcgagggaatatttgggagtgcattgaagaatatggtgaaaaagggaatatctttggataaaaactggaataatgtatttgagaaactccttggtgatgcttgcagtcatctcacagagttaaatctttcttttcatggagcagtttggaaacactgtttttgtagaaactgcaaatggatatttgggagtgcttgaggcctatgatgaaaaaggaaatatcttcagataaaaattagaaagaaacttcttgagaaactgctttgtgttgtgtgcttacaactcacagagttaaagctgttttttgattgagcagtttggaaacactttttgtagagttggcgatgggatatttgggagtgctttgaagcatatggtgataaaggaaataacttccaataaaaagtagaaagaagctttttcaggaactgctttgtgatgtgtgttttcatctcacagagttaaatccttctgttgatggaacatttcagaaatactgttttaagagggtctgagaagggatattttggagcacattgaggctgatgttggaaaaaggaatatcttcagataagaattatagagaagctatctgagaaactacttttgtgatgtgtgcattcaccacacatatttaaacctttctgttgattcatcaatttggaaacactgcttttgtagaatctgcaaaggtatatttaggagaccactgaggctatggtgaaaaaggaattatcactgataaaaacaggaaagaagattcttgagaaactgctttgtgatgtgtgcattcaactcacagagataaagctgacttttgattgagcagcttcaaaacactgattttgtaggacctgcgatgagctatttcggagcacattgaagcctgtggtgataaaggaaatatctttggataaaaactagaaagaagctttttgagaaactgctttgtgatatgtgcattcacctcacagagttaaacctttcttttgatagagcagtttggaaacactgtttttgcaaaatctgcaaagcgatataatgtagcacagaaaagcctgtggtcaaaaagggaatgtcttcagataaaaactggaaagaagggttatgagaaactgatttctgatgtgtgcatccataacaccaagttaagtccgtcttttgatgaaagaatttggaaacactttttttgtagaatctgcataaggatatttgggagctcattgaggcctatagtggaaaaggaaatatcttcagagaagacttagacagaagctttctgagatactgctttgtgagctgtgcattcatctcacacagttaaacctttcttctgatggaagggtttggaaacactgtttttgtagaatctgtgaaggcatatttgggagcacattgaagcctacggagaaaaaggaaatatctccggataaaaactagaaagaaggttgttgagaaactgctttgtgatgtgtgcatttatctttcagaattaaacctttcttttttggaacagtttggaaacactgttttagtagaatgcacgaagggatatttgggagaacagagaggcccatggtggaaaaggaaatatcttcagagaagaactagacagaagctttctgagaaactgctttgtgatgtgtgtattcatcttacagagttaaatctttcttttcattgagaagtttgggtacactgtttttgtagaatctgcaaaaagatatttgggagagcattgaagcctatggataaaaaggaaatatctttgtattacaaccagaaagaaatattttgagaaaatattttgtgatgagtggattcttctcacagagttaaacgtttcttttgattatcagtttgtaaacactatttttgcttaatctgtgaagggttttttgggagtgcattgaagcctctggggaaaaaggaaatatcttcagataaaaactggaaagaagcattatcagaaactgctttctgatgtgtgtattaatctcacagagttaagtccttcttttgatggagcagtttgtaaaaactgttttctagaaactgcgaacggataattgggagcgcattgaggtctatggtggaaaattaaatatcttcagagaagaattagagagaagctttctgagaaactgttttgttatgtgtgcattcttctcacagagttaaacctgcttttgatttatcagtttggaaacactgcttttgtagaatctgcaaagggatatttgggagtgcaagaggcctattttgaaaagggacataacttcaggtaaaaactagaaagaagctttctgagaaagtgctttgtgatgtgtgcagtcttttcacagagttcaacgtttcctttgactgaacagtttggaaacactgtttttgtagtatctgcaatgcaccatttgggagcacactgaggcctattgggaaaaagaaaatatgttcagataaaaactagaaagaagctctttgagaaactgctttctgatggatgcattcatctcacagaaaaaaaaaacttttcttttggcttaccagtttggaaacactgtttttgtatgatctgtgaagtgacgttaggtagcacaaaaaggcctatggtgaacaacgaaatatcttcagataaaaactggaaagaagcattatgagaaactactttctgatgtgtgcattcatctcacagtttgaaatccttcttttgatggaacaattcagaaactctgtttttatagactctgtgaatggatatttgggagtgagttgaggcctatggtggaaaaagaaatatcttcggagaagaactagtcaggatctatttgagaaacagttttgagatgtgtgcattcatctcagagttaaacatttattttgattgaacagtttgcaaacactgtttttgtagtgtccacaatgctctatttgggagcacacggaagcctatggtgaaaaaggaaatatctttggataaaaaatagaaggaagcttgagaaacagctttatgatgtttgcattcatcacacagagttaaacctattattgactgaacagtttggaaacactgtttttgcaaaatctgtgaaacaatattaggtagcacaaaaaaggttatggtcaaagaggaaatatcttcagataaaaactggaaagaagtgttattacaaactgctttctgatgttcgtgttcatctcacagagttaagtccttgttttgatggaacagctttgaaacactgtttttgtagaatctgtgaagggatatttgggagcaccaggaggcctatggtgtaaaaggaaatatcttcagagaagtagtagacagaagctttctgagaaactgctttctgatgtgtgcatttatctcagagttaaatatttctcttgtttgagcagtttaaaacactttttttgtagaatctgtgaagggatatttttgagcgtattaaagcttatgttgaaaaaagaaatatcttggtataaaaagtagaaagaaaattttgataaactgctttgtgatgtgtgcattcatctcaaagagttaaacctttcttttgattgagcagtttggaaacactctttttgtagaatctgcaaagggatatttgggagcacgctaggcctatggtaaaaaaggaaacaacttcagataaaagctagaaagaagctttctgagaaatgctttgtgatatgtgcattcatctcacattgttaaacctttcttgtgattgagcagtttggaaacactgtttatgtagaatctgtgaagggatatttgggagagcattgaagcctatgatgaaaaaggaaatatctttggatacaaattagaaacatgaactttgagaaactgctttgtgatgtgtgcagtcaactcacagagttaaaactttcttttgattgatgagtctggaaacactgtttttttagaatttgtgaagggatatttgggagctcatgaggtttatggtgaaaaagttaagactttcctttcatttagcagtttggaaactctgtttttgtagaatctgtgaagggatatttgtgaacacacagaggcctatggttgaaaaggaaatatcttcagataaaaactagacagaaatatcttctgatacattatgagaaactgctttctgatgtgtgcgttcatctcacagagttaaaactttctctggattggttatattggaagcactgtttttgtagaaactgtgaaaggatatttggagtacatgaggcctgtggtgaaaaaggaaataatatcatataaaaactaaatggaagctttttgaaaaaccattttgtgatgtgtgcatttttatcacagatttaaaattttctttttatttagcagtttggtaacactgtttttgtagaatccgcaaagagatatttgggagcccactgatgcctacagtaaaaatggaaatatcttcagaaaaaaaaactagaaagaagctctttgagaaactgattcctgatggatgcattcacttcacagaaaaaaacttttcttttgactgagcagtttagaaacactgtttttgtataatctgtgaagtggtgttgtagcacaaaaaagcctatggagtacaaggaaataacttcagatttaaactggaaagaagtgttatgagaagctggtaattgatgtgtgcattcatctcacaaagttaagtcctccttttgatggaactgttctgaaacactgtttttatagcatctgcgaagggatgtttgtgagtgcattgaggcctaaggtgcaaaaggaaatatcttcagagaagaattagacagaagctatttgagaaactgctttgtgatgtgtgcatttatctcacagagttaaacgtttcttttgatggagcagttaggaaacactgtttttgtagaatctgtgatgggatatttgggagcacattgaagtctatgatgataaagaaaatatcttcggataaaaactagaaagaagctttttgagaaactgtttgtgatgtgtgcattcaactcgcagagttaaacctgttttttgattgagcagtttgaaaacaccagtttttgtagaatgtgcaacaggatatttgggtgcacattgaagactatggtgataaaggaaatatcctcagataaaaactagagagaagctttttgagaaactgctttgtgatgagtaccttcatctcagtgagttaaacttttcttttgactgagcagtttggaaacactgtttttgaaaaatctgcaaagtgatattaggtagcacaaaaaagcctatgttgaaaaaggaaatatcttcagataaaaactgtaaagaagcgttatgagaaaatgttttctgatgtgtgcattcatctcaaagggttaagtccttcttttgatggaagagttggaaacaccgtttttgtagaatctgtgcagtgatatttgggagcacactgaggcctatggtggaaaggatgtatcttcagagaaaaactagacagaagctttctgagaaactgctttgtgaagggtccattgaggtaagagagataaacctttcttttgattgaacagtttggaaaaacagtttttgtggactctggaaagggatgtttgcaagtgcattgaagcgtaaggtaaagaaggaaatagcttctgataaaaactataaagaagccattctaactggtgtgagatggcttctttatagtttttatgagaagttatcaccttctttaccttaggcttcaatgcacttgcaaacatccctttgcagattccacaaaaactgtttttccaaactggaagtcagtgtggcgattcctcagggatctagaatgagaaataccgtttgacccagccatcccattactgggtatatacccaaaggactataaatcatgctgctataaagatacatacacacgtatatttattgtggcactattcacaatagcaaagacttggaaccaacccaaatgtccaacaatgatagactggattaagaaaatgtggcacatatacaccatggaatactatgcagccatacaaaatgatgagttcatgtcctttgtagggaaatggatgaaattggaaatcatcattctcagtaaactatcgcaaggacaaaaaaccaaacaccacatgttctcactcgtagatgggaattaagcaacgagaacacatggacacaggaaggggaacgtcacactctggggactgttgtgtggtggggggagggatagcattaggagatatacctaatgctaaatgatgagttaatgggtgcagcccaccaacatggcacatgtatacatatgtaactaacctgaacgttgtgcacttgtaccctaaatcttaaagtataatcattaaaaaaaaaactataaagaagctttctgattaactgctttgtgatgtgcttgttcaactcaccgagtgaaacccattttttgattgagcagtttggaaacactgcttttgttgaatctgtgacaggatatctgggagcacattgaggtctaaggtgataaaggaaatatcttcggataaaaactagaaagaagatttttgagaaaccgcttgtgatgtgtgcattcatctcacagtgctaaacattacttttgattgatcactttggaaacactgttttgtagaatctgtgaagggatatttgggaacacaggagacctacagtgaaacaggaaataattccagataaacactagacagaagctttctgagaaactgatatgtgatgtgggcactcttctcacagaggtaaatgtttcttttgattgagcattatggaaacactgtttttgtagaatctccaaagggatatttgggaatgcactgatgcctatggtgaaaaatgaagaatctccagataagaactagaaagaatatttttgagaatctgctttgtgatgtgtgcattcatcacacagagctaaacctttcttttgatagagcagtttggaaacacagtttttgtagaatgtgtgaagggatatttgggagcacacagatacctgtggtgaaaaaggaaatatcttgtgataaaaactggaaggaaggattttgagaaactcctctgtgatgtttgcattcatctcacagaggtaaacctgtttttcactgagcagtttggaaacagtttttgcagaaactgcagagggatgtttgggagcacactaatgcctttggtgaaaaaggaaatatcttgtgataaaaacgggaaggaaacattttgagaaactgctttttgatgtatgcattcatctcaaagaggtaaacctttctttttactgagcagttgggaaacattgtttctgtagaatctccgaagtgatgttaggtaccacaaaaagccctatggtgaacaaggaaatttattctgataaaaactggaaagaaacgttatgagaaagtgctttctgatgtgagtattcatctcacagagttaaatccttctaatggaactgttcaaaaacattgtttttatggactctgtgaagggacattttggatcacattgaggtctacggtggaaaaggaagaatcttcagagaagagctagatggaagcaatctgagaaactgctttgtgctttgtgcatttatctcacagacttaaacctttcttttgattgagtagtttggaaacactgtttttgtataatctgcaaaggtatatttcagagtgcactgaagtctatggtgaaaaagggaatatcttcagaaagaaactaaaaagaatctttttgagaaactgctgtgtgatgtttgcattcacctcaccgaagtaaacttgtctttggattgagcagtttggtaacactgtttttgtagaatctgcgctggaacatttgggagcacattgaagcctgtggtaataaaggaagcatcttcagataaaaactagagagaagctatttcagaaattgctttgttacgtgtgcattcatcactcagagttaaaactttctttgactgatctgtttggcatcactgtttttttttatatccatacacatgggcgataagtttatttccagtgttaactgatttctcaaatattgtagtagtgatatctttctaaaatttcttttttttgtatttactgttctttttttaaattttattgtattattattatactttaagtcttagggtacatgtgcacaatgtgcaggttagttacatatgtatacatgtgccatgctggtgtgctgcacccattaactcgtcatttaacattacgtatatctcctgatgctatccctcccccgaccccccaccccacaacagtctccagagtgtgacgttcgccttcctgtgtccatgtgttctcatttttcaattcccacctatgagtgagaacatgaggtgtttggttttttgtccttgtgatagtttattaagaatgatgatttccaatttcatccatgcccctataaaggacatgaactcgtcattttgtatggctgcatagtattccatggtgtatatgtgccacattttcttaatccagtctatcattgttggacatttggattgcttccaattctttgctattgtgaatagtgctgcaataaacatacatgtgcatgtatctttatagtaacatgatttatagtcctttgggtatatacccagtaatgggatggctgggtcaaatggtatttctagttctagatccctgaggaattgccacactgtcttccacaatggttgaactagtttacagtcccaccaacagtgtaaaagtgttcctatttctccacatcctctccaacacctgttgcttcctgactttttaatgactgccattctaactgatgtgagatgctatctcattgtgcttttgatttgcatttctgtgatggccaatgatgatgagcgttttttcatgtgtcttttggctgcataaatgtcttcttttgagaagtgtctgttcatgtccttcacccactttttgatggggttgtttgtttttttcttgtaaatttgtttgagttcattgtaggttcttgatattagccctttgtcagttaagtaggttgtgaaaattttctcccattttgtgggttgcctgttcactctgatggtagtttcttttgctgtgcagaagctctttagtttaagtctttttttttttgatggaacagtttggaaacaatgtttttgtagaatctgcgaagggatattttggagcacattgaggcctgtggtgaaaaaggaaatatcttcagatcaaaactagaaacaagctttctgagaaactgctttgtgatttgtgcattcgtcacacagaattaaacttttcttttgatttatgagtttggaaacactgtttatgtagcatctgcaaagggatactggggagcccatgaggcctatggtgaaaaacgaaataacttcagataaaaactagaaataaactttctgagaaactgctttgtgaattgtgcagtcttctcacaaagttaaacctgttttttcatgagcagtttggaaacactgtttttgtagaatctacaaggggatatttgggagtgcactaatgcctatggtaaaaaaggaaatatctttggataaaaactaggtagaatctttttgagagactgctttgtgatgtatgcattcatttcacagagttaaacttttcttttgactgagcagtttgtaaacagtctttttgtataatccactaagcaatgttaggtagcataaaaaggcctatggtgaaaaagttaatatcttcagataaaaactggaaagaagcattaggagaaaatgttttctgatgtgtgcattaatctctcagagttaaatccttctattgatggatcagttcagagacactgtttttatagaatctgcaaagtgatatatgggatcgcattgaggcctatggtggaaaaggaaatatcttcagagaggaactagacagaagctatctgataagctgctttgtgatgtgtgcattcatctttccgagttaaaactttctttcagttgagcagtttggaaaaagattttttgtagaatctgcaacaggatatttaggaacgcattgaagcctatggtgataaatgaaatatcttcagaaaaaaactagaaataatctttttgagaaactgctttgtcaagtgagcattcatctgacagagtcaaacctttttttgatggaccagtttggaaatactttttttgcaaaatctgcaaagtgatattaggtagtgcagaaagcctatggtgaacaaggaagttacttaagataaaaactggaaagaagcgttaggagaaactctctctgatgtgtacattcatctcacagtgttaagtccttcttttgatggaacagtttgtaaacactggttttgaagattctgcaaagggaaacttggtagtgcactgagtcctaagttgaaaaaggaaatttctttgcataaacactggaaagaaacattttgagaaaatgctttgtgatgtgtgcattcaactcacagagttaaacctgttttttggttgagcagtttggaaacgctgcttttgtagcatcttatatgcgatatttgaaaactcaggccattaggcctatggtgaaaaacgaaatatctccatataaaaactagaaagaagctctttgagaaactgctttgtgatgtatgcattcatcttaaaaagctgaacttttcttttgactcagcagtttggagacactgtttttgcaaattctgagaagcgatattttgtagcgcaagaaaagtctatggtgaacaaggaaatatccacagataaatactggaaagaagcattatgaaaaactactttctgatgtgtgtgtctatctcactgagttaagtccttcttttgataaaacagcttggaaactctacttttgtagaatctgttaagggatatttgagagcgctttgaggtctatggtggaaaaggaagtatctttaattaagaacaagaaagaagctttctttgaaattgccttgtgatgtgtgcattcatctcacagagttaaacttttcttttgattgagcagtttggaaacactctttttgtagaatctgtgaagggatatttgtgagcacaggaggcctatggtggaaaagtaaacaacttcagataaaaactacaaagaagctttctgagaaaccgctttgtgatgtgcacattcttctcacagagataaatatttattttgatttagcagtttgcaaacactgtttttgtagaatctgcaaagggatatttgggagtgcaccgatgcttattgtgaaaaaagaaatatcttcagataaaaaccagaaagaagctttctgagaaacggttttgagatgtgttcactcttctcacagagttaaatctgttttttgattgagcagtttggaaaccctgtttttgtagaatctgcaaatgtatatttgggagctccctgaggtctaggtgaaaaaggaaataccttccggaaaaaactaaaaagatgctgtttgggaaactgcttcattaagtatgcattcatctcacagatttaaacctttcttttgactgagcagttttgaaacactgtttttgccaaatctgcagagcgatatttggtagtgcaaagagcctatggtgaacaaggaaatatcttcagataaaaactggaaagaactgttatgggaaactgctttctgatgcgtgcatacatctcacagagttaagtcttcttttgatggaacagttaggaaccactgtttttatagaatctgtgaagggatattttggagttcaatgaggcctatggtagaaaaggaaatatcttcagattaaaactggaaagaagtgttatgagaaactgttttcagatgtgtgtgttcatctcacagagttgtccttcttttgatggaacagtttggaaactctgtttttgtagaacctgcgaagggatatttgggagtgcattgaagccaatggtggaaaaggaaatatcttcagagaagaactagacagaagctttctacgaaactgctttgtgatgtttgcattcatctcactgtgttaaacctttcttttgattgatcagtttggaaacactctttctgtagaatctgcaaagagatattcaggagcacattgaagcctatagtgaaaaaggataaacagtagaaagaagctctttgtgaaagtcctttgcaatgtgtgcactgagttaaaacattcttttgactgatcagtttggaaacactgcttttgtagaatttttgaaaggatatgtgggagcacatgagatctacaatgagaaaggaaataacttcagataaagtctagaaagaagctttctgagagactgctttgtaatgtgtgcattcttctcacagagttaaaaaatctttttgattgatcagtttggaaacactgtttttgtagaagctgcaaggggatatttgggagagcactggtgcctatggtgaaaaagaaaatgtcttcggacaaaaattagtaagaagctttttgagaaactactttgtcatgtacgcattcatctcttggagttcaaattttcttttgattgagcactttgggaaaactgtttttttttttttttttttaatgcctgatttgtttatttacttagaactcataatagttattcacatttcagcctgatttaagcattattattattttttttctttctttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccccagtccccagagtgtgatattccccttcctgtgtccatgtgatctcattgttcaattcccacctatgagtgagaatatgcagtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctctgctattgtgaatagtgccgcaataaacatacgtgtgcatgtgtctttatagcagcatgagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggaaaactgtttttataaaatctgtgaagcaatgtttggtagcttaaaaaggcctgtggtgaacaaggaaatatcttcagataaaaactgcaattaagaagtatggggaactgctttctgatgtgtgttcatctcacagacttaagtacttctttggtgtaacagtttgtaaacattataagaaatagaacccacgaagggatattttagagtgcattgagccctatggtggaacaggaaatatcttcagagaagaaatagacagaagctatctgataaactgatatctgatgtgtgcattcatctcacagagttaaagctttcttttcgttgaacagtttaggaacactgtttttgtagaatctgcaaaggtatatttgggaacgccctgaagtcgatggtgaaaaaggaaatatctttgcgtaaaaactacaaagaagctttttgagaaactgttttgtgatatgtgcattcaactcacagagttaaacttgttttttgattggtcagtttggaaacagtttttgtagaatctgcaacggtatatttgggatatttgcgttgaagtctatggtggtaaatgatatatctttggataaaaactacaaagaagatattaagaaactgctttgtgatgtgtgtattcatctccctgagttaaatatttcttttgactgagcagttttgaaacactgtttttgcaaaatctgcgaagtgatattatgtcacacaaaaaacctatggtgaaaaagaaaatattttcagataaaaacaggaaagaagtggtatgagaaactggtttctgatgtgtgcattctattcagagatttaagaccttcttttatggaacagtttggaaacaccgtttttgtagtatctgcgaagggatatatgggagcacattgaagccaatggtggaaaaggaaataactacagagaagaattagatagaagcattccgacgaaatgctttgtgatgtgtgcattcatctcacagagttataccttccttttgattgagcagtttggaaacactgtttttggagaatctgtgaagggatatttgggagtgcactaggcctatggtgaaaaaggaaataacttcagataaaaactacaaagaagatttctgagaaaccgctttctgatgtgtgccttctcacagagttaaacgtttattttgattgagcagtttggaaacactgtttttgtagaatctgcaaagggatttttttttcaatggtttttcaatatattttttattttattttattattattatactttaagttttaggatacatgtgcacaatgtgcaggtttgttacatatgtatacatgtgccatgttgctgtgctgtacccattaactcatcattaagcattcggtatctcctaatgctatcgctgccccttccccccaccccacaatggactctggtgtgtgattttccccttcctgtgtccatgtgttctcattcttcaattcccacctacgagtaacaacatgtggtgtttggttttttgtccttgctatagtttgctgagaaagatggtttccattttcatccatgtccctacaaaggacatgaactcatcattttttatggctacatagtattccatagtgtatatgtgccacattttcttaatccagtctatcgttgttggacatttaggttggttcccagtctttgctattgtgaatagtgccactctaaacatatgtgtgcatgtgtctttatagcagcatgatttatactcctttgagtatatactcagtaatgggatggctgggtcaaatggtatttctagttctagatccctgaggaattgctacactgacttgcacaatgattgaactagtttacagtcccaccaacagtgtaaaagtgttcctatttctccacatcctctccagcacctgttttttcctgactttttattgatcgccattctaactggtgtgagatggtatctcattgtggttttgatttgcatttctctgatggccagtgatgatgagcattttttcatgtgttttttggctgcataaatgtcttcttttgagaagtgtctgttcatatccttttcccacttgttgatggctttgtttgttttttttcttgtaaatttgtttgagttcattttagattctggatattagccctttgtcagatgagtaggttgtgaaaattttctcccattctgtagattgcctgttcactctgatggtattttcttttgctgtgcagaagctctttagtttaattagatcccatttgtcaattttggcttttgttgccattgctttcggtgtttcagaaatgaaatccttgctcatgcctatgtcctgaatagtattgcctagattttcttctagggttttcatggttttaggtataacatgtaagtctttaatccatcttgaattaatttttgtataaggtgtaaggaaaggatccagtttcagctttctacctatggctagcctgttttcccagcaccatttattaaataaggaatccttttgccattgcttgtttttgtcagatttgtcaaagatcagatcgataggtgtagatatgtggcattatttctgagcactctgttctgttccattgatctatatctctgttttggtaccagtaccatgctgttttggttaatgtaggcttgtagtatagtttgaagtcacgtagcatgatgcctccagctttgttcttttggcttaggattgacttggccatgcaggctcttttttggttccatatgaactttaaagtagtttttccaattctgtgaagaaagtcattggtagcttgatggggatggcattgaatctgtaaattaccttgggcagtgtggccattttcaagatattgattcttcctacccatgagcatggaatgttcttccatttgtttgtatcctcttttatttccttgagcagtggtttgtagttctctttgaagaggtccttctacagaatagagaaattttttgcaactgacttatctgacaaagagctaatatccataatctacaatgaactcaaacaaatttacaaggaaaaaacaaacaactctattaaaaagtgggcaaaggatatgaacagacacttctcaaaagaagacatttatgcagtcaaaaaacacaggaaaaaatgctcatcatcactggccatcagagaaatgcaaatcaaaacaacaatgacataccatctcacatcagttagaatggtgattattaaaaactcaggaaacaacaggttccagagaggatgtggagaaataggaacacttcttttacactgttggttggactctaagctagttctaccattgcataagtcagtgtggtgattcttcggggatctagaactagaaataccatttgaccaacccagccatcccattgctgggtatatacccaaaggactataaattatgctgctataaagacacatgcacacatatgtttattgtggcactattcacgataacaaagactaggaactgacccaaatgtccgacaataatagactggattaagaaaatgtggcacatatacatcatagaatactatgaagccataaaaaatgatgagttcttgtcctttgtagggaaatgggtgaagctggaaaacatcattctcagcaaactatcacaaggagataaaacaaacatggaatgttctcactcatagttgggaattgaacaatgagaacacatggacacaagaaggggaacatcacacactggggacagttgtggggtggggtgaggggggagggatagcattaggagatatacctaatgctaaatgacgagttaatgggtgcagcacaccaacatggcacatgtatacatatgtcacaaacctgcacgttttgcacatgtacactaaaacttaaactataataataataatttttttttaaaaaagaaacttttgaagaatctgctttgggaggtatgcattcaactcaaagactcaaaactttccttggttgagtggttcggaaacattgtttttgtaaattcttcgaagggatatttaggaacccactgaggcctatattgaaaaaggccttcacataaaaactagaaggaagccttctgagaaagtgcttcgtgatgtatgccttcatctcacaaagagaaaattttatttgatggagctctttggaaaaaaatatttttgtggaatctgcaaaggcatatttgggagcacattgaggtctatggtgaaaaaggaaatatcttcagagaaaaactagaaagaagctttctgagaactgctttgtgtggtgtgcattcatcccacagaggtaaacattaaacctatctttagatggagcagtttagaaagactgtttttgtagaatctgtgaagagatatttgggagcacattgaggtctttgtgaaaacatgaaatatgctgggagaaaaccagaaataagttttctgagaaactgagttgtaatgtgtgcattaatctcacagagttaaatgtttcttttgatggagcattttggaaaaactgttgttttagaatctgtgaagggatattttggagtgcattgaggtctatggtgaaaaaggaatatcttcagatagtaactagaaagaagcttcttgggaaactgatttgcagtgtgtgcattcatctcaaagagttaatccattcttttaattgggtagtttggaaacattgtttttgtagaaactgcatagtgatattagcgagtgccttgaggcctttggtgtaaaaggaaatatcttcagagaaaacctagaaagtagctttctgagaaactgctttgtgttgtctgcgttgctctcacggagttaaacatttctatggaaggagcaggttggaagcactcctattttagaatctttgaaatgatatttttggagtgcattcaggtctatggtgaaaaaggaaatagtgtaagagagaaagcagaaagaggtttactgtgaaactactttgtgatatttgcattcatcttacagagtgaaatttttgttttgaaggaacagtttggaaacactgtttttgttggaagtgagaaaggatattcgtaagcacattagggcctatggtaaaaaagtacatatcttcagataaaaactataaataatctttctgagaaactgctttgtgacgtttgcattcatctcagagaagtaaagctttcttttaataacgtagtttgcaaacactgttttcgtagaatctgtgaaggtgtatgttttaacactttaagacctatggtggaaaaggaaatatcttcagagaaaaaatataaagaatctttctgagaaactgctttatgataagtgcattcatttcacagactaaagcttttcttttggttgcaatgtttggaaacatggtttttgtagaatttgggaagggatatttgggagtgcattgagggctatggtgaaaaaggaaatatcttcagagaaaagctagaaaaaatctttctaagaaactgctttgtgatttgtgcattcatcacaccaagttaaaacattattttgattgagctctttggaaaaactgtttttgtagaatctgtgaagggatatttgggagcaccttgaggcttgtggttaaaaggaaatatcctcaggaaaaactagaaagatggttttgagtaaatgctttgtgatgtgtgtatctttctcacagggttaaacctttcttttgatggagcagtttgaaaacactgttttgtggaattggcaaagggacatatggtgaaaaatgaaatatcttcaaagaaaaactggaaagaatctttctgagaaactggtttgtgatgtgtgcatccaactcacagagttaaacattccttttgatcagctgtttggcaacactatttttttagaatcagtgaagggacatttcgagtgcattgaggcttatggtgaaaatggaaatatctacagagaaaaagtgaagacaagctttctaagaaactgcttggttatatgtgcatccatctcagagagttaaccctttcttttgatagagcagtttggaaacactgtttttgtaggatctgcaaaggtatatttgggagtgcactgagacctattgtgaaaaattaagtatctttggttaaaaaatagaaagaaacattctgaaaaactgctttgtgatgtgtgcattcatctcaaagagttaaacatttgttttgatggagcagtttggaaacactgtttttgtagaacctgtgaagggatatttgtcagggaattgaggccaatggtgaataatgacatgtcttaagggagaaaatcagaaagaactttctgagaaactgatttgtgaagtgtgcattcaagtcacgaagttaaatctttcttttgatggagcagtttgcaaacactgtttttgtagaatctccaaagggacatttgggagcaccttgaggcctatggtgaaaaagaaaatgcctcagataaagaattcacagaagctttctgagaaactgctttgcgatttgtgcattcatctcacagagttaaacgtttcctttgattcagcaatttggaaacgctgttttcgtagaatctgtgaagggatatttgtgaggtaattgagaccaatggtgaaaaatgacatatcttaagagaaaaaccagaaagaagctttctgagaaactgatttgtgaagtgcacattcatgtcatgaagttaaacctctgttttgatagagcagtttggaaacactgtttttgtaggatctgcaaaggtatatttggagcgcactgagacctatggtgaaaaattaaatatctttggataaaaagtagaaagacgctttctgagaaactgctttgtgatgtgtgcattcatctcaaagagttaaacttttgttttgatggaggagtttggaaacaccctttttgtagaatctgtgaagggatatttgtcagggaattgaggccaatggtgaaaaaccacatatcttaagggaaaagccagaaagaactttctgagaaactgatttgtgaagtgtacattcaagtcatgaagttaaatctttctttttgtggggcagtttggcagcactgtttttgtagaatttgcaaacgggcatttgagagcacattgaggtctatggtaaaaaagaaattatctcagataaagaattcacagaagcttgctgagaaactgatttgtgatttgtgcattcatctcacagagttaaacgtttcctttgattcagcgatttggaaacactgttttcgtagaatctgtgaagggatatttgtgagggaattgaggccaatggtgtaaaaccacatatcttaagagaaaaaccagaaataagctttctgagaaactgatttctgaagtgcacattcatgtcacaaatttaaacctctgttttgatagagcagtttggaaacactgtttttgtaggatctgcaaaggtatatttggagcacactgagacctatggtgaaaaattaggtatctttggataaaaagtagaaagaatctttctgagaaactgctttgtgatgtgtgcattcatctcaaagagttaaacttttgttttgatggaagagtttggaaacactctttttgtagaatctgtgaaggggtatttgtcagggaattgaggccaatggtgaaaaaccacatatcttaagggaaaatccagaaagaactttctgaaaaactgacttgtgaagtgcacattcaagtcatgaagttaaatctttctttttatggagcagtttggcagcactgtttttgtagaatctgcaaatgggcatttgagagcacattgtggcttatgttgaaaaagaaattatctcagataaaaaattcacagaacctttatgagaaactggtttgtgatttgtgcattcatctcacagagttaaatatttcctttgattcagcggtttagaaacactgtttttgtaggttctgtgaagggatatttgtgagggaattgaggccaatgttgaaaaacgacttatcttaagagaaaaaccagaaagaagctttctgagaaactgatttgtgaagtgtgcattcatgtcacaaagttaaacttttcttttgatggagcagtttggaaacactgtttttgtagaatctgcaaagggacatttgggaacacattgaggcctgtggtaaaaaagaaaatatctcagataaaaaattcacagaagttttctgagaaactgctttgtgatgtgtgctttaatcttacagatttgaacgtttctttgatggagaggtttggaaacactgtttttgtagaatcatcaaagggatatttgggagtgcattgaggcctatgttcaccatatggaaatatcttcagagaaaaactagaaagaagctttctgacaatcatctgctttggaatgtgtgcattcatctccctctgttacagcttccttttgattgagcagtttggaaacactgtttttgtagaatctgcaaagggatatttgggatcacatttaggctttggtgaaaaaggaaatatcttcaggaaaaactagaataaaactttctgagaaactgccttttgacttgtgcattcgtctcacagagttcaaattttcttttgatttagtagtttggaaacactgtttttgtgcaatctgcaaagggatatgtgggagcacattcaggcctatggtgaaaaaagaaatatcttcacataaaaactataaagaagctttctgagaaactcctttgtgatgtgtgcattcacctaacagactcaaaactttcttttgatggagcagtttggaaatactgtttttgtagtatatgtgaaggcatgtttgagagcacaaagaggtctgttctgaaaaaggaaatatctgcagagaaaaactagaaagaatctttctgagaaactgacttgtgttgtgtgcattcatctaactgactgaaaacattctgttggtgtagcagtttggaaccactgttattgcagaatctgcaaaaagatacttgggagcactttgaggcctatggtgaaaaaggaaatatcttcagacaaaaagtaggtggaagctttctgagaaactgttttgtgatgtggccattcatctcacagagttaaaacttcgttttgacttagcagctggaaacactgtttttgcagaatctgcaaagggatatttgggagcactttgaggcctgtggccaaaaaggaaatatctttagataaaaactagaaagaagctttctgagaaactgatttgtgatgtgtgcattcatctcacagtgttaaacttttattttatggggcagtttggaaacacagttttttagcaatctgtgaagggatatttaggagtgcattgaggattattgtggaaaaggaactatcttaagagaacaaccagaaagaagatttctgagaaactgatctgttatgtgtgcattcatctgaaagaggtaaacatttctttagaaggagtagtttggaaatatggcttttgtagattctgtgaaaggatatttgggagatcattgaagcctatggtggaaaaagttatatcttcggagaaaaattaggaagaagctttgtgagaaactgctttctgatgtgtgcgttcatctcacagagttaaacctttcttttgatggagcagtttggaaacgcaattttgtagaatctgcaaactgatttttgggagcacattgggaccagtggtgaaaaagaaaatatcttcagataaaaagttcaatggagctttctgagaaactgctttatgatatgtgcattcatctcacagagttaaacctttcttttgatagagctgtttggaatcactgtttttgtagaatctgtgaagggatatttgggagcacattgaggcctattgtcaaaaaggaaatatatttacataaaactagaaagaagctttctgagaaagtgcattgtgatgtatgcattcatctcacagagttaaaaattatctgattggagcagcatggaaacagtgtttttgtagaatctgcaaaaggatggtagggagcaccttgaggcttatggtgtaaaagcaaatatcttaagagaaaaactagaaactagctttctgggaaactactttgtgttgtgtgcattcgtctcacaaaggtaaacatttttttcaatggagcagtttggaaacacgtttttgtacaatctgtgaaggaatatttgggagcaaattgaggcctatgttgaaaaataaaatatctttagcaaaaagctagaaagaagctttctgagaaactgccttgtgatttgtgcatttatctcaaagactcaaacctttattctcttagcacagtttggaaacattgtttttgtagaatctgtgaaggggtatttatttgggagcacattgaggcatgtagtgaaaagggaattatcttcagagaaaaactagaaagaagtttctgagaaactgttttctgttttgttcatttatctcacagaggtaaacttttgtttgagcagcttggaaacactgtttttgtggaatatgcaaaggaatatttgggagcacattgaggagtatgctagaaaagtaaatatcttcatagaaaaactggaaagaatgtttctgagaaactactttgtgttgtgtccattcatctcacagagttttacctatcttttgattgagcagtttggaatcactatttttttggaatctacgaaaggatattttggagcacattgaggcctatggtgaaaaaggaaataacttcagagaaaaactagaaggaagcttagtgagaaggtgctatgtgatgtgtgcattaatctccctgagttaaacatttcctgtcattcagaagtttggaaacactgtttttgtaaagtctgcaaacgtgtatttccatgcaaactgaggcctgtgatgaaaaaggaaatattttcagagaaaaactagaaagaagttttctgagaaactgctttgtgatgtgggcattcatctcacagaattacacttttcttttgatggagcattttggaagcactggttttgtagaatatgagaagggatgtttgggagtgctttgagtccaatggtgaaaaaggaaaaatcttcgtagattctgcgaagggatactttggagtgcaagaaggcatgtggtgaaaagagaattatgttcagagaaaaagtagaatgaagctttttgagaaactgctttgtgatctgtccatttgtctcacagagttaaaactttccttagaaggagcagtttgaaaacgctgtatttgtagaatctgcaaagccatatttgagagctctttcagacgaatggtgaaaagggaaatatcctcagataaaaactagacagaagttttctgaaaaaatgatttgtgatgtgtgccttcaactaacagagttaaacttttctttgatggagcatttgcaatcactgttttcgtagaatctgtgaagggatatttgggattgcattaaggcctgtgtggaaagtgaaatattttcagagaaaaactagaaagaagcttttgaagaaattgctttgtgatgtgtccatttatctcacagagttaaacctttcctttgaaggagcagtttgaaaacactgcatttgtagaatatgagaagccataattgggagccctttaaggagtatggtgaaaagagaaatacattcagatcaacactacacagaagctttttgagaaactgctttgtgatgtgagctttcatctcacagttaaacttttcttttgatggagtagtttgtaaacactgtttttgtattatcagcaaagggatatttgggagcgcattgagtcctatgatgaaaaggaaatttgttcaaaaattgggaggaaactttctgagaaactactttgtgatttgtgcattcatctcacatagttaaagctttcttttgatggagcagtttcttaaatctgtttttgtatcaactgcaaacggatagttcagagcacattgaggcctatggtgaaaatggaaatatctttagacgaaaactagaatgaaacttcctgagagacttctttgtaatgagtgccttcatctcactgagttaaacctgtcttttgatggagcagtttggaaacactgtatttgtagaatctgtgaagggataatttggagtgcattgaggcatattgtgaaaaaggaaatgtctttatagaaaatctacaaagaagctttctgagaaacagccttgtgtagtgtttattcatctcactgatttaaacctttctttgatggagcagtttggaatcactgttttcatagattccgtgaagggttactgtggagtgcaagaagccatgtggtgaaaagagaaatatgttcagagaaaaagtagattgaagctttttgagaaactgctttgtgatctgtccattcatctcacagagttaaacctttcctttgaaggagcagtttgaaaacactgtatttgtggaatctgcaaagccatatttgagagtgctttcaggcctatggtgaaaagggaaatatcttcagataaacactacacagaaactttctgagaaactgtttgtgatgagtgctttcatctcagagagttaaacctttcttttgatggagccgtttgaaatcactgtttttgtagaattggcgaaaggatatttcagagtgcttttatgcctgtggtgtaaagagaaatatcttcagagaaaaactagaaagtagctttctgagaaactgctttgtgatgtgtccattcatctcacagagttaaacctttcctttgaaggagcaggttggaaacactgtatttgtagaatctgtgaagggatatttgggagtgctttgaggcctatgttgaaaataaatatcttcagataaatctagaaagaagcttactgagaaattactttgtgatgtgtgcattcatctcacagaggtaaacctatattttgatggagcaggttgtaaagactgtttttgtataatctgcaaatggatatttgggagtattttgagtcctatggttaaagggaaatacgttcagagaaaaactaaaaagaaactttctgagaaactactttgtgatgtgcacattcatctcacagagttaagcctcccttttgatagagctgtttgtaaaccctgttttttgtatgaactgcaaagggatatttgggaatgcattgaggcctatggtgaaaatggaaatatcttttttttctttatgttttagcgtacatgaccacaacatgcaggttttttacatatgtatacatgtgccatgttggtgttaaaactttcttttgatggacctgtttgtaaaacctgtttttgtataaactgggaaggggtattttagagcacattgaggcctaggagaaaatggaaatatctcgagacaaaaactagaatgaatctttctgagaaactgctttgtgtattgagcatttatctgacagatttacacttttcttttgttcgaggagtttggaaacagtgtatttgtagaatctgcaaagggatattttggagcactttgaggcctatggtgaaaaaaaattatcttcagagaaaaactagaaagaagctttctgagtaactgctttgcgatgtgtgcattcatctcacagagttaaacctttcctttgaaggatgagtttgaaatctctgtatttgtggaatgtgaaaagccatattttggagtgctttcaggcctatggtgaaaagggaaatattttcagataaacactagatggaagctttctgagaaactgcttcgtgatgtgtgttttcatctcacagagttatgcttttcttatgatggagtagtttgtaaacactgtttttctgtggttggcaaagggatatttgggagtgcattgagtcttatggtgaaaagaaaatatcttcagagaaaaattagaaagaaactttctgaaaaactactttgtgatgtgcgaattcatctccctgagttaaacctttcttttgatggggcagtttgttaatcccatttttgtataaactgtgaagggatattttggagcacattgaggcctacggtgaaaatggaaatatctttagacaaaaactagaatgaagcttttggagaaactgctttgtgatgtgttcattcatatcacatatttcaacctttttcttcatagagcagtttggaatcactgtttttgtaaaatctgcaaagagatattttggagtgcattaagtcctgcagtgaaaagagaaatatcttcagagaaaaactggagagaagctttctgagaaactgctttgtgatgtgggcattcatctcacagagttaaacctttcctttcaaggagaattttgaaaacactgtatttgtgtaatctgcaaagccatatttgggagaactttcagacctatggagaaaagggaaatatctttagataaatacgagacagaagatttctgagaaactgccttgtgatgtttcctttcatctcaaagagttaaaactttcttttgatggagtagtttataaacactttttgtataattggtgaagggacatattggaatgcattgagtcctacagtgtaaaggaaatatcattatataaaaactagaaagaaattttctgagaaagaattttgtgatgtgtgcattcacctcacagagttaaccctgactcttgatgaagcagtttgttaagcctgtttttgtataaatgatgaatagctatttcggagcacattgaggcctacggtgaaaatggaaatatctttagacaaaaattagaatgaagctttctgagaagctgctttgtgatgtgtgcattcatcacacaaagttaaagcttccttttgatggagcagtcgggaatcactgtttctgtagaatctgcaaagggacatttgggagccagttaaggcctgtggtgaaaagagaaataccttcaaagaaaaacaagaaagaagctttcagagaaagtgctttgtgatgtgtccattcatctcacagagctaaaactttctttgaaggagcagtttgaaaaaactgtatttgtaggaactgcaaagccatatttgggagccctttcaggcctacggagagaagggaaatatcttcagataaaaactagactgagactttgtgagaaactgctttgtgatgtgtgttttcatctcacacagctaaaccattctttttggtggagcagtttggaaacagtttttgtagaatctgtgaagggatattttggagtgcattgaggcctctgctgaaaaaaaatcttcagataaatctagaaagaagctttctgataaacaactttgtgatgtgtgcattcatcccacagatttaaaactttctttggatagagaagtttgtaaacactgtttctgtatgatcagtgaagggacaaatggcacacattagtcatatgatgaaaaggaaatatcttcagagaaaaatgagaaagaaattttctgagaaaatactttgtgatgtatgcattcaactcacataattaaacctttcttttgatggagcagtttgttaagcctgtttttgtataaatgaagaaggaatattttggagaacattgaggcctatggtgaaaatggaaatacctatagacaaaaaccagaatgaagcgtctgagaaactgtgttgtgatgtgtgctttcatttcactgagataaaaccttacttttgatggaacagtttggacacactgtacttctagaatctgtgaagacatatttgggaatgcattgaggcttaatgtgaaaaaaggaaatatcttcagaggaaaactagaaagaagctttctgagaaacttctttgtgacatgtgtgcattcttctcacagagataaacacttcttttgttggagcagttgggaatcactcttactgtagaatccgtgaagggatatttgtgaacacattaagcctggggcgaaaagagaaatatcttcagaggaaaattataaagaaaactttctgtgaaactgctttgcaatgtgtccattcatctcacagagttaaacctttcctttgaaagagcagtttgaaaacactgtatttgtagaatctgcgaagccacatttgggagtgctttcaggcctatggtgaaaacagaaatatcttcagataaaaactggacagaagctttgtaagaaactgctttgtgatgtgtgctttcatctcatagagtttaacctttctataatcttttaaagcttttgtataatctctgaagagatattctggagcactttgaggcctatggtgaaaagaaatattttcagataaatctagaaagaagctttctgagatactattttgtaatgtgcgcattcatctcacggaattaaaactttcttttgatggagcattttgtaaacagttttagtataatctgcaaatcaatatttgggagttctttgagtcccatggtgaaaaggaaatatctccagaaaaaaactagaaagaatctttctgagaaacgactttgtgatgtgtgcattcatctcacagagttaaacctttcttttgatggagctattagtaaaacctgtttttgtacaaaatgcgatggaatatttcagagcactatgaagcctatggtgaaagtggaaatatctctagacaaaaactagaatgaagctttccgagaaactgctttgtgatgtaagcattcatttgacagatttaaacaacatttttaatggagcagcttggaaacactatttgtggaatctgcagaagactatttgggagcacattgaggcctatagtgaaaaaggaaatatctccagagaataactataaagaagcttcctaggaaactgtgatgtttgcattgatctcaaagatttaaacttttcttttgatggagcaatttggaatcaccgtttttgtagaatctgcaaaagggtatttgggagcacattaaggcctgtggtgaaaaggatatatctttggaaaaaaactagaaagaaactttctgaaaaactaccttgtgatatttgcattcatctcacagagttaaacctttcctttgatggagcagttcggaaacactgtttttgtagaatctgcaaaatgatatttgtgagcataaggataattttgagcccttcgtggactatgttgaaaaaggaaatatctttggataaaaactagagagaagccttctgataaactcctttgtgatgtgtacatacttctcacacagttaaacctttcttttgattgagcagtttgcaaagactatttttgcagagtctgcaaaggtatatttgggagtgcaccgaggtttatggtggaaaaggaaatatcttcagagaaaaactagacagaatctatctgagaaactgcaatgtgatgggtctgttcatctctgacgtatacgtttcttttgaatgagcagtttgcaaacacagtttttgcaaaatctgcagaacaatattcagtagtgcaaaatagcctatggtgaacaagaaaatatcttaagataaaaactggtaagaattgttatgagaaactgcgttctgatgtgcattcatctcagagagttaagtccttcttttgttggaagagtttgcaaacactgtttttgtagaatccacaaagggatatttaggagtgcattgtggcctatggtgaaaaacgaaatatcttcagataaaaactagaaacaagcttttgggaagctgcattgtgatgtgtgcattcatctgagagagttaaacctttgttttgactgagcagtttggaaacactgtttctgcaaaatttgtgaagcgatattaagaagagcaaaaaagcctatgttgaaaaaggaaataatttcagataaaaactggaaagaactgttatgagaaactgctttctcatgtgtgtattcatctcacagagttaagtccttcttttgatggaactgtttggaaacactgtttttctagaatgtgcgaagggttatttgggagcccatttatgcatatggtggaaaaggaaatatcttcagagaaaaactagacagaagcattctgagaaacttctttgtgatgtgtgaattcttttcacagagttgaacctttcttttgattgagcactttggaaacagtatttttgtggtatccgtgaagggatatttaggagcacattgaagcctatggtgaaaagggaaatatcttaggataaaaactagaaagaagctatttgagaaactactttgtgatgtgtgcatttatctcacagagttatactattcttttaattgatcagtttggatacactgtttttttaggatctgcaaaggtatatttggtgaaaaaggaaatgccatcagataaaaactagaaagaagtttttgagaaactgctttgtgatgtaggtgttcaactcacagagttaaacctgttttttgattgaggagttttgaaacagtgttttggtagaatgtgcaaagggatatttttgagcacattgaggcctatggtggaaaaggaaatatcttcagggaagaactagatagaaaatatgtgagaaagtgctttgtgacatgtgcattcatgtgacagatttaaaactttcttttgattgagctgtttggaaacactgtgtttgtagtatcagcaaatgtatatttgggagtacaccgaaggctgaggtgaaaaaggaaatatcttcaaataaaaaatagaaagaagctttgagaaactgctttgtgatgtgtgcattcaagtcagatagttaaaagtgttttttgatgaagccgtttgtaaacactgttgtggaatctgtgatgggatatttggcagtgcattgatgcctatggtgataaaggaaatatctttggataaaaactacaaagaagcattttgagaaacagctttgtgatgtgtgtattccttgcacagagataaatatttctttggactgagcagtttggaaacagtgtttttgtataatcgatgaagtgatgttaagtagtgcaaaaatgcctattttgaacaaggaaatatcttcagattgaagctggaaagaagcgttatgagaaactgctttctgatgtgtgcattcatctcacaaagttaaatccttcttttgatggaacagataggaaatactgtttttatagaatctgtgaagggttatttgagaatgcattgaggcatatggtggaaaaggaaatatcttcagagaactagacagaatttttctgagaagctgcattgtgagatgtgcattcaactcacagagttaaacctgttttttgattgagcagcttggaaacacggtttttgtagaatcttcgatggggtattttggagtgctttgaagcctatggagataaaggaaataacttcggataaaaactagaaagaagctttttgagaaactgcttctgataaaaaatagaaagaagctttctgagaaactgctttgtgatgtgtgcattcaactaacagggttagacctgatttttgattgagcagcttggtaacaatgtttttgtagtaccttcgatgggatatttgggagtgctttgaagcctatggtgataaaggaaataaccttggataaaaactagaaagaatattattgagaaactgctctttgatgtgtgcattcaactcagagggttaaatctttcttttgacagagtagtttggaaacagtgcttttgcaaaatctggcaaacaataactggtagtgcaaaaaagcttatggtgaacaaggaaatgtcttcagataaaaactggaaagaagaattatgagaaactgctttctgatgcatgcattcatcctacagagttaagtcatttttttcacggaacagtttggtaacactgtttttgtagaatttgtaaagtgatatgtggggctgcattgatcctcatggtggaaaaggaaatatcttcagggaagaagtagacaggagctttctgagaaacttctttgtgatttgtgcattcatctcacagagttacacctttcttatgattaagcagtttggaaacactgattttgtagaatccatgaagggatacaagggaacacatttacacctatggtgaaaaaggaaataacttcgaataaaaactagaaataagttttttgagaaacttctttgaaatgcgaccattcatctcatggagttaaacctttctattgattgatttgtttggaaacactgtttttgtggtatctgcaaagggatacttgtgagcacatgaggtctatggtgaaaaaggaaataacttcagataaaaactagaaagaagctttccgagaaactgctttgggatgtgtgcattcttctaaaagagttaaacctgttttttgcttgagcagtttggaaacagttttttgtacaatctgcagagggatattttggagcacacagatgcctatggtgaaaaaggaaataactttggataaaaactagaaagaacgtttttgagaaactgctttgtgatgtatgcattcatctcacagagttaaacatttcttttcactgagcaattggaaacactctttggtattatctgtgaagcaatgttatgtagcccacaatggcctatggtgaacaaagaaatgtcttcagataaaaactggaaagaagctttatgagaaactgatttctgatgtgtgccttgatctgacagagataaatacttcctttgatggaacacttcagaaacactggctttatgaaaactgtgaagggacatttcagagcacatagaggcctatggtggaaaacaaatatcttcagagaagaattagagagaaactatctgagaagctgatttgagatgtgtgcattcatctcagagttaaacctttcttttgattgggtagtttggaaacactgttttgtagaatctgcaaagggatatttaggagctcagtgatgcctatgatgaaaaatgaaatatctctggataaaaactagaaagaagctctttgagaaactgctttgtgatgtttgcatccatctcacagagttcagcttttcttttgactgaacagtttggaaacactgttttgaataaactgtgaagtgatgctaggtagcgcaaaaatgcctatggtcaaaaaggaaatatcttcaggtaaaaactgggaagaagtattatgagaaactgctttgttatccttgcgtttatcttacagagttaaacctttcttttggttgagcagtttggaaacaccatttttgtagaatctgtgaagagatatttgggagcacattgaaacctggggtgaaaagggatatatcttcagagaagaactagacagaagctttatgacaaacttctttatggggtgtctgtattcatctaacagaggtaaacctttctttcaattgagcagtttggaaagagtttttttagaatctgtaaagggatatttgggagtgcattgaagcctggggtgaaaaaggcaatatctttggataaaaactagaaagatgatttttgagaaactgctctgtgaagtgtatgcttaactcacagagataaacctgttttttgattgagtagtttggaaacactgtttttgtagaatctgcaacgggatatttgggagtgaaggggtgggttggccctccaaacatgtggctttttctcattaggtggaatgagagacttggaaaagaaagagacacagagacaaagtataaaggaagaaaaaggaggcccaggagactggcattcagcacacggaggatccccactggcctctgagttcccttagtatttattgatcattactgtgtgtctctctaagaggagcatgtggcagggtcataggataatagcggagagaaggtcagcagctaaacacgtgaataaagttctctgcatcataaacaaggtaaataattaagtactgtgttttagatatgtatacacataaacatctcaatgccttaaagagcagtattgctgcccgcatgtcccacctccagcgctaaggtggttttcccctatctcagtagatggaatatacaattgggttttatccagggatgagcaggagacagatgccttcctcttgtctcaactgcaaagaggcattccttcctcttttcctaatccgcctcagcacagagcctttatgggtgtcgggctggtggatggtcaggtctttccattcccacgaggccatatctcaggctatcacatggggagagaccttggacaataactggcttccctaggcagagttccctgtggtcttccacagtgttttgtgtccctgggtacttgtgattagggagtggtgatgactcttaacaagcttgctgccttcaagcatttgtttaacaaagcataccttgcacagcccttaatccatgtaaccctgagttgacacagcacatgtttcagggagcacatgattgggggtagggttacagattaacagcatctcaagacagaagaatttttcttagtacagaaaaaaatggagtctcttatgtctactttctatatagacacattaacaatctgatctctctttcttttccccacatttctccattttcttttcgacaaaactgccatcatcatcatgcctctttctcgatggtcactgtctcctcagagctgttgggtacacctgtagactaacaacagacaaagcaggaacacaaggattaatatgaaatttataatcgtagtacttctgatggtcttaacccaagtgacagggttaagatttatgaggccatcagcaactcctgcgattgcctcagtctctgttaccaaatttaaatgggcttttgatgctttgaaaatttgttaacttaatttggaaatgtctaaagtgacattatcttctattccctgcagatggcttctaaccatgtcacactgatactctgactcattataaacgtgaggtatgatacaaaaatctgatgtattcaagtcacactgtaactggaaatgatgttctgagctcatgagcctgtctcccatccaaatgacggtttgtctaagatcattaatttgatttgccaatttttgatcaataccagattgtgaattccacaatccagtagatttttttttgccaatcattaacaaagtttactgactgaacagaacagtgcaatgcaactcctgccacagcagccatagctgtgactgcaattaatcccataatcactgtaattaaagtaaaaatgaatcctttggatctatttaaaatgtcttttaatacttcagtcaaaatatggttggatagcgaggcctcccacggtcggtccatggatacagggatccaaatgccttctcttgctctcaccagcagaatacagtgctgccaattaaaagttgaaacaatgcaagttaaacaatctaaaattttcacaggttatagtttgagagtctggtttaataattatatttcctacaactagcatataagggggctttacacaactttgtaaaggaactgttagactggaatttaggtcaatagtataaaatggcttacagtctctggtttctaaagtttgatttccagaccaaattctaatgcagtaagaggctacagtaagcctccacaattctgaatattcaggaccagaaacaggacttgttatttttggtcttagggtagagattactttttctccccatttccaagggtagaaagattgtaatttcttatgcttatgttcgtctaaacttttggttaagttgctatcaacagttggactcacttgtgcactggaacacgactgagtttttcctgtgcaattgtggtagaattgacctcgaggtgcccaatctataacagttccgaattcactgttttgtaatatcaccgcactattggccacacattcttcccaaagtaaaacttctgtattttttgatcctttgggaatttccttggggcaagtttccctttaggtctaaattttaatgacctttgataagaaaagtcttgtaaataatttacctgtggcctgagtgtcatcccacttaccatgttataagtgaatctactgacgagactgacagtaggtacttctcccaaccaattttggattacacgcattaaacatcctgttgctctccctaggcaaatagaaggataatgatactcagtggaaatatttatcatcatgccttcttcctcaggtttgggaggacagccatcatctctggggccaggtgcccgtactctatcattaacatataattgaataggattaaccatccatgtgactggtgtttccatctctgtggaggcacttttctttgcatctctgaagggttcgctgtagaacttcaaatgtctagtggatatccaaacaggaagctgattttctcctggtgaaacacaagcaaaacctccctccctcgttatcaccttccataatttctatgtcttatttttattatctttccaccaaatcagttttccttcaattgggctgttctttttaccagtaagaagttgctctgcagaagtagtagtctgatttctataaatgtttgaaaaatttaaagtatagagtgctagattaagttgcatctgaggagtggtacactccttactctctcccccttctttttgtttaactatttgagttttgagtgttctattagttctttcaactatggcctctcattgggaattatagggaattactgttgtatgtgaaattttccactgatttaagaatttttgggaagctttagtacaatatcctcgtccgttgtcagttttatttttttctggaactcccattacagcaaaacaagataataaatgttttttaacatgggaggtactttctcttgtctggcaagttgcccgtatgaaatgtgaataagtatcaactgttacatgaacatacgataatcttccaaatgaaggtacacaggtaacatccatttgcataatacattaggacacagacctctgggattcactcctgcctcttgagtgggcaggtgtaggacttgacactgggtgcaatgttgtacaatatattttgcctgtttccatgtgacatcaaatttgttttctaatgttgctgcatttacatgagtcaaagcaagaagttcttgtgcttttatgaatgcagatgataccagtaagtcagcttgttcatttgctttagtcaaaggccctggtaaattagtgtgtgttgaatatgagtaatataaaataggaaatttctttctcttacagtttgttgtaatacattgaatagctggtttaactgatcatccatgctatgtttgattaaagctgtctcaacattccttgtagcctatactacatatgaagaatctgatacaatattgataggttgatcaaaatcttgtaacactgtaatgactgcaaccaacactgctctttgagctgatttatattgagttttgattactcactcttttggccctgtgtaagccacttttccattgctggaacaattagtaaataccattaaagggttttctaaaagttcatgtctggtaattttagataaaatccaggtagtcaattttaaaaactggaagatttttgtttttggataatgattatcaataattcccataaagttagcaagaccaatctgccatgcaccataattgataaagctttgtctaacttgttcctttgttaaagggacaactattttgtctgagtcatttccacagaattttattatttataatcttgactgactaattaatgtagctatttgatccaagtacaatgtaaaggtcttaattgtactgtgaggaaagaatgaccactccacaagatcagtattttggacaatgatgcctgttggagaatgtgcagtagcaaaaaccaaaagttggagtggggctaagggatctatttatttgtgctgactgaattttttcttccactaatttaatttcttttgttgcccctggggttaacattctcttactatttaaatctgagtctcctcttaaggtaaagaacaaattctgcatggcataattaggaatgcctagagttggctgaatccaattaatatctcctagcaatttttgaaaatcatttagtgtttttaatgtgtcttttcttattttgattttttgtgacttaatttttctattttctatctgcatccctaaataatgaaaaggagcagaggtttgaatcttatcagatgctattgccagtcctgcattggcaacctctgcttgcagaaatgtattacagtaaatcaatttgtttcttgattctgcagcacagaaaatatcatcaacataatgaatgatataacagtctgaaaactcactggttgaagagctcgacctccaaagtctgacaaatagttggactattaagcattccctgaggtaacactttccactgaaacctggtggcctgttctttattttttatggctggtatagtaaagtcaaatttttcgccatcctgctctgccagaggaatggtaaaaaagcaatcctttagatcatttataattaaaggccagtcttttgggatcatgaccggagagggcaatccgggttgaagaagccccataggttgagttacagcatttacagtccttaagtcagttaacacatacaatttgttggatttttttctgaattacaaacacaggcgaattccaaggcaagaatgaaggcttgatatgtcccttttctaactgtacatttgctaataaatgcaaagcctccagtttttgttttggtagaggccactgatttacccatactggtttttctgttttccaagttaatggtatgggtttaggaggctctacactgtctgcaactgaaaaggataccctattccttctcttttttgatttcttttagtctcaattgggactttaatgccattttcttttttttttctagtccctttcctggtatatatcccaacttaatcatgattttttgactcgtggggctatataatggagtgggcatagtgattactgcaccctattgttgtaataaacctcaaccctacagattaagaggaatcgaagtaatcattggctgaacagtactttcttgattatctggccctaaacagtgtcaaatctcagtactttgatacacttccaagagtgtgcctatgccgacagctcctctaacagccttttgtttaggccaattttttggacactgatttaaagcaatgatagagacatctgctccagtgtctactaacccttcaaaatgttttccttgaataatggccttacacacaggtctgttctctgagacctgacttgcccaatatgcagtctttcctgtcagatcaatgcttccaaaccctcctgttcttcttatctcactatttccaaccttaatatgaggcagcagtaataatcgagcaatcctgtctcctggactggcactccaaggaattgaagagctagtatccaattaaattttgcctttatagtatgaatcaaccacaccagtatgaatttgaactccctttagatttagacttgatcttcctaagattagtcctacagtcccctcaggcagtgtgccatatagcccggtgggaatttttgtgggggctctcctggaagcagagagactgcttgtatattacataaatctactgctgcactgctgcttgttgtgggggacaattgttgtattgtgttaactggctcattccctgaggcacttgggacagtgggggttgttgttcctgaaaaccctgaagaaaaaagcactgaattgggaatgccccagtttgttttagggcctgaggctggcccctcttctcatttccctataatggttgcccatttctatccaatttagaacaacattgactagcccaatgttttccttttttacatcttggacataagtccggtggctttttacctgttgttgtaatagcttgaatagttatactttgtttatttgaggctaggcaattctttttttaaatgaccaatttgaccacaattaaaacatttccctccaaatgttctaacttgtccttctaaagcaactcctgtcattgcttgagccataagcatagctttatgcatagctcctccaattccatcacaggcttttacatactctgagattacatctgatcctgcaagaatctttccttttaatggcttactggctgattgacactcaggattggcattttcttatgccaacaactccactatgactttacgggcattttcatcagcaactgacttttgagcaacaccttggaaccttgccacaaaatcagggtagggctttttagagccttgtgttattttattagaggggcaggcagttcctgggtcttggatttttttcccaggctctaaagcagatagctctaacttgctcaatggcctcattttgcattaatgcctgttgactaatagtgctccaattttgatctgttcctaatagttcatctgcatttatgttaactggaggattggcagccctatttcttcggacctgttcttgttacccatcaatccaccaagtcttaaattgtaaaaattgagagggtgagaagacgattttgccaaaatctcccaatcataaggaatgagtctatgaccatgagcaatggagtctaataatgtcctcatataagggaagttgggtccatactgttttactccctctttcatatctttcagcatttttatagaaaaagactcatatctggcctcaactgtttgaggctctccctcttgggccccttctccaggtggtattggttctaacgttactgggaattgccatgcctcaatatctccttggtttcttgaattatcaataattttatgtaacgcactaccctgttgactaggtggtgctgttggattaagtgtcatagtgggtggctgagggtatggctccctgccctgtggtgctgggagcattcctgaatgtccatactgactttctggggatggctgatgctgaagtttggccagtggccagtattgctaagctactggtggttgggtcttattttctctaacctgcattggagactgtaatgttccaggcatctcacctgctggaagagggcttggtgctcatggtttatgctcttatggcccgactaattctggacctttttcttctaattttaacgtttcaagatatataatctcctgtaattgattatagtcaacattttggattgtctgagccattaccagctctgcaacatattcacaatgtaaactttccatttctttctggaattttctccttgtctcttctttacaatctattacacagcttccagtggcatcagaaactgaaacgctatcttcttctgtttgaaatgtttctaaagctgctttaataatagcccaatcattccataccttaagtgggatgattttactctccctacttgcttgttttagttctttgccaattttttctcaatcttttagatctaaagttccctgttctggaaaccatggacaaaattcttctattgttcaaaatagcttgattagattttttgtagagactctaaatccccctctttcacaccagttagaatgacaatcattaaaaagtcaggaaacaacaggtgctggagaggatgtggggaaataggaacacttttacactgttggtgggactgtaaactagttcaaccattgtggaagtcagtgtggtgattcctcagggatctagaactagaaataccatatggcccagccatcccattactgggtatacacccaaagggctataaatcatgctgctataaagacacttgcacaagtaggtttattgtgacactattcacaatagcaaagacttggaaccaatccaaatgtccaacaatgatagactggattaagaaaatgtggcacatatacaccatggaatactatgcagccataaaaaaggatgagctcatgtcctttgtagggacatggatgaaattggaaatcatcattctcagtaagctatcgcaaggacaaaaaaccaaacaccacatgttctcactcataagtgggaattgaacaatgagaacacatgggcacaggaaggggaacatcacactctggggactgttgtggggtggcggtatgtgggagggatagcattaggagatatacctaatgctaaatgacgagttaatgggtgcagcacaacagcatgggacatgtatacatatgtaactaacctgcatattgtgcacatgtaccctacaacttaaagtataataataataaaaaatgaattttaataaagctgagataagtggcatatttacttttagttttacttttagtttgccccattgttaccctggcttcttctgagcacacaagtttaccataaggctgactgcagatgtactcaggatctctcatagacttgtcctcaatgaccatgcttgagcgtaccttcaccctagagaaaagcacccatgttggatgccagaggaaggggtgggttgcccgtcccacctgtgggttgttctccttaggtggaatgagatacttggaaaagaaagagacatagagaaaaagtacaaagaaagaaaaagtataaagaaagaaaaagggggcccaggagactgacgttcaacacatggaggatccccaccagcctctgagttcccttagtatttattgatcattattgggtgttcctcagagagggggaggtggcagggtcataggataatactggagagaaggtcagcagctaaacacgtgaacaaagttctctgaatcataagcaaggtaaagaattcagtgctgtcctttagatatatatacacataaacatctcaatgccttaaagagcagtattgccacccacaagtcccacctccagccctaaggtggttttcccctatctcagtagatggaatatacaattgggttttatccagggatgagcaggagacagatgccttcctcttgtctcaactgcaaagaggcattccttcctcttttcctaatccgcctcagcacagagcctttatgggtgtcgggctgggggatggtcaggtctttttccattcccacgaggccatatctcaggctatcacatggggagagaccttggacaatacctggcttccctaggcagaggtccctgtggtcttccagtgttttgtgtccctgggtacttgcgattagggagtggtgatgactcttaacaagcttgctgccttcaagcatttgtttaacaaagcataccttgcacagcccttaatccatgtaaccctgagttgacacagcacatgtttcagggagcacatgattgggggtagggttacagattaacagcatctcaagacagaagaatttttcttagtacagaaaaaaatggagtctcttatgtctactttctatatagacacattaacaatctgacctctctttcttttccccacagggagcgcttgaaacctatgctcaaaaaggaaatatcttctgataaaaactagaaagaagctgttctagaaactgctttgtcatgtgcatgttcatttcacggagttaaacatttcttttaatgaagcagtttttaaatttattttttcaatccacaaatcaatatttggtggtgcaaaaaccttatgctgaacaaggaaatatcttcagataaaaactggaaagaagtgttatgaggaacagttatctgatgtgtgttcatctcccagtgttaactccttcttttgatggaacagcttggaaacattttttcaagaatctgtgaagggatatttgtgattgcattcaggcctgtggtggaaaaggaaatatcttcggataaaacccagaaaaaagcattctgagaaatcgctttgtgatgtgtgcattcttcacacagagttaaatatttcttttgattgagcagtgtgggaatactgtttttgtagaatgtgcaaagggatatttgggagtgcattgatgcctgtggtgataaaacacatatctttggttaaaaagtagaaagaagtttttgacaaactgctttgtgatgcatgcattcgtctcacagagttaaacttttcttttgaatgagcagtttggagacactctttttgcaaaatctgtgaagcgatattttgtagcacaaaaaagcctatggtgaacaaggaaagatcttcagataaaactggaaagaagaattacgagaaagtactttatgatgtatacattcatctcacactgctaaatcctttctttgatggaaaagctcagaaacactgtttttataggatctgtgaagggatatttgggagtgcattgaggtctatggtggaaaaggaaatatcttcagagaagaatgagacagacactttctgagaaactgctttgggatgtgtgcattcatctcacagcgttaatactttcttttgattgagcagcttggaaactctgttttgtagaatctgtgaagggatattcgggagtgcattgatgcctaaggtgaaaaaggaaatatctttggataaaaactagaaagaagcttttttagaaactgctttttgaagtgtgcatttatttcacagagttaaaacttacttttaattaatcagcttggaagcacagtttttgtagaatctccgaagggatatttgggagcccatgaggccaattgtgagaaaggaaataacttcagttaaaatactaaaaagaagctttctgagaaactgctttgtgatatgtgcattcttctcacagagttaaacgtttccttttgttgagcaatttggaaacactgtttttgtagaatctgcaaagtagtatttgcgagcataggtaaaattttgtgtgcattgagtcctatgttgaaaaaagaaatatcttcatataaaaagaagacagaagctttctgaggaactgctttgtgatgtgtatattcttctcacgcagttaaacatttattttgattgaggagtttggaaaccctgtttttgtagaatctgcaatgggatatttgggatcacattgaagcctgtggtgaaaaaggaattattttcagaaaaaaaactagaaagaagcttcttgataaactgctttgggatgtatctatacattccacagtgttaaatctttcctgtgttggagtcattgggaaaaacccttttggcagaatctgtgaagggctattgggaactcattgagccctatggtgaaaaatgtaatatctctagatgaaaaccagaaggaagctttctgggaaacttctttgtgatttgtgcattcctctcacagagttaaagccttcttttgagtgagcagtttggaaaaacggttttgctaggatctgcaaagggatatttgggagcacaaagaggcctatgttgaaaaaggaaataacattggataaaaactacaaagaagctatctgagaaatggctttgtgacgtgtgcattcttctcacagatttaaaactttcctttgattaaacagttcagaaacactgtttttatagaatctgcaatgggatacttgaaagctcagttaggccaatggtgaaaaaggaaatatcttcagataaaaactagaaagaagctttttgacaaactggtttgtgatgtgtgcattcatctcacagagttaaaactttcttttgactgaacagtttgggaacactgtttttgtataatccgcaaagtgatatttggcagcacaaaaaagcctatggtgaaaaagaaaatatcttcagataaaaactggaaagaagcattatgagaaactgctttctgatttgtgagttcatctcatagagttaagtccttcttttgatggaacagtttggaaacactgtttttgtagaatctgcaaagggatatttgggatgccattaaggtgtatggtggaaaaagaaatatatattcagagaagaactaggcagaagctttctgacgaactgctttctgatgagtgcattcaacttacagagttaaacctttcttttcactgagtttggaaacactgtttttttgtagaatctgtgaagggatatttgggttcattcgaggcctgtggtgaaaggggaaataacttcagataaaaactagaaagaaacatttggagaaactgctttgtgatgtgtgtgttcaacacgcagagttaaacctttcttttgattgagcaatttggaaacactgtttttgtagaatctgcagtggtatatttgaaagcgtagttaggactgtggtgaaaaaggaaatatctttggatttaaactagaaagaagctttttgagtcactggtttgtgatgtatgatttcatcttaaagagttaaacctttcttttggctgagcagtttggaaacactgtttcagtataatctgtgaagaggtattagaacaaaaatgcccatgatgataaatgaaatatcttcagttaaaaactggaaagaagagtaatgagaaacagctttcagatgtgtgcattcatctcacggagttgagtcctcttttgatggaacagtttggaaacactgtttttgtagaaactgtgaagggatatttgggagtgcattgaggcctaacgtggaaaaggcaatatcttcagagaagaactagacagaagctttctgagaaactgctttgtgatgtgtgcattcatctcacagagttaaatctttcttttgattgatcagtatggaaacactgtttttgtagtatctgcaaagggatatttgggagtgcatgaagcctatggtgaaaaaggaaaaacttcagataaaaactagaaagaagctgagaaattgctttgtgatgagtgccttcttctcacagagttaaacctgtttttgattgagcagtttggaaacactgtttttgcagaatctgcaaagggatacttgggagggctctgagtcgtatggtgaaaaaagaaatatcttcagataaaaactagaaagaagctttctgagaaactgctttgtgatatttgcattcatctcatggagttaaacatttcttttgactaagcagtttggagacttggtttttgtataatctgtgaagcgatgtctggtggtgcaaaatggctcacggtgaacaaggaagtatcttagataagaactcgaaagaagcattatgagaaactgctttctgatttgtgcgttcatctcacagagttaaatccttcttttgatggaactgttcataaacgctgtttttatagaatctgcgaagggatacttgagagggcattgaggcctacagtgaaaaaaacatcttcagagaataactaacaagaatgtttctgaaaaactattttgtgatctgtgcattcatctcaagagttaaacctttcttttcatggagcagtttgttaaccttgttgttgtataaactgcaaagggatatttcagagcacattgagacctctggtgaaaatggaaataaatttagacaaaaactagaaagagtgtctctcagaaactgctttgagatgtgtgccttcatcacacagagttaaatctttctttgatggagcagtttgtaaacactgtatttgtagaatctggaagggatacttgggagcacattgaagcctatggtgaaaagaaatatcttcagagaaaaactaaaaagaagcttcctgaaaaactacattgtgatgtgtgcattcatctcacaaagataaaattttcttttaagtggactgtttgaatcactgtttttgtagaatctgcatagggatatttggtagcacactgaagccagtggtgaaaagagaaatatctacagagataaacaagaaggaagcttactgagaaactgctttgtgatgtgtgctttcatctcacagaaccaaacctttctttttcatggagcagtttggaaatactctatttgtagcatctgtgaagggataattgggagtgcattgaagcctattttgaaaatggaaatatcttgacagaaaaattagaaagaagctttgtgagaaactactttgtaatgtgtgcattcatctcaaagatttaaacatttcttaacatggagcagtttggaatcactgtttttgtagaatctgcaaaggggtatttaggagctcattgaggcctatggtgaaaaaggaaatatctacagataaaaactggaaagaagttttctgagaaactcctttttgatgtgtgcattgatctcacagagttaaacgtttctttccatatagcagtttggaattacttcttttgtacaatctgctaagggatattttggagtgcattgagtcctatggtgaaaaggaaatatcttcagaggaaaactacaaagaaattttctaacaaactattttgtgatgagcgcattcatctcacagagataaacctttcttttcttggagcatattgttaactctgtttttgtataaactgcaatgggatatttcagagcacattgaggtctgcagtaaaaatggaaatgtctttagagacaaactagaatgaagctttctgagaaactgctttgtgatgttgaattcatttcactgaggtaaacctttcttttgatggagcagattggaaacactgtaattgtagaatctgtgaagggatatttcagatggcattgaggccaactgtgaaaaaggaaatatcttcagagaagaactaaaaagaagctttctgagaaactgctttgtgatgtgtgcattcatctcgaagagttaaaccttccttttcatttaacagtttttttaaccctgtttttgtataatctgtggagggatattttggagaacttgaagcctatggtggaaatggaaatattattatacaaaaactagaatgaagctttctgagagactgctttgtgatgtatgcattcatcttactgagttaaacttttcttttgatggagcaatttgtaaacactgtatttggagaatctgcaaaggtataattcggagcgcattgaggcgtattgtgaaaaaggaaatatttcagaaacaaacaagaaaactgctttcagagaaacttctttctgctgtgtgcattcatctcactgttaaacctttctttacaaggagcagtttggaatcacagtttttgtagaatttgtgaagggatattagggagcacattaaggccagttgtgaaaagagaaatatcttcagagaaataatagaaagaagctttctgagaatctgctttggatatatccattcatctcagagagttaaacatttcctttcaaggagcagtttgaaagcattgtatttgtagaatctatgaagccatatatgggagcactttcaggtgtatgttgaagagggaaatatctggagataaaaactagacagaagctttctgagaaactgctttgtgatgtagcattcatctcacagagataaaacattcctttggtggagcagtttgttaaacttgtttttgtataaacttcaaagggatatttcagagcacattgaggcctatggtaaaaatggaaataactttaaacaaaaattagaaagaaggtttctgagaaactgctttgtgatgtgtccattcatctcacagagttaaacctttcttttgctggagaagtttgtaaacactgtagtcgtagaatctgtgaagggatagttgggagtggattgaggcctagggtgaaaagaaatatctacaaagaaaaactaaaaagaagctttatgaaaaactactttgtgatgtgtccattcatttcagaaagataaacctttcttttaatggggctgtttggaatcattgtttctgtagaacctgtgaagggatactcgggagcacattaaggcttgtggtgaaaagaaaaatgtcttcagagaaaaactagaaggaagccttctgagaaacagctttgtgatgtgtgcttttatctcacagaatcaaacctgtcttttggtggagcattttggaaacacagttttcatagagtctgtgaagggatattagaagagcacaaggaggcctatggtgaaaaaagaaacatattcaaagataaactagaaaaaattttgtgagaaactgctctctgatgggtgcattcctctcacagaggtaaacttttcttttgatggagcagtttggaaacactatttttgcaaaacctggaaagtgatattatgtagtgcaaaaaaacctatggtgaaaaaggaaataacttcagataaaaactggaaagaagcattatcagaaactgctttctgatgtgtgcattcatctcactgagttaagtccttttgatggaacagtttggaagctctgtttttgaagaaaatgtgaagggatatttgggagctcattgaggcatatgatagaaaaggaaatacgttcaggaaagaagtagacagaaggtttataagaaagaaactgctttgtgatgggtgcattcatgtcacagagtataatttttcacttgattgagcagtttggaaacaccattatttttgtagaatctgtgtaggaatatttgggagcgcattgaggcctagggtgaaatgggaaatatcatcagataaaaactaaaaagaagatatttgagaaactgctctgtgatgtatgcattcatctcccagagttaaaactttttttcgttattcactttggaaacagtctttttgtagaatctgcgaagggatatttgacagtgcaagtggcctatgttgaaaaaggaaataacttcagataaaaattagaaggaagcttactgagaaaccactttttaatgtgtacattctcctgagttaaacgtttgttttgattgaacagtttggaaacactgtttttgtagaatctgcatagagatatttcggagtgcactggtgcttatgttgaaaaaagaaatatctttgggtaaaaactggaaaaaaactctttgagaaactgttttgtgatgtatgcattcatatcacagagttactcctttcttttctctgagcagtttggaaacacagtttttgtataatctgtgaagtgatgttaggtagcgcaaaatggtctatggcaatcaaggaaatatcttcatagaaaaactggaaggaaaggatatgagaaactccttttttatgtgtgctttcatcttaaatagtcaaaaccttcttttaatggaacagttcagaaacactgtttttatagaatatctgaagggatatttggaagtgtgttgagccctatggtgaacaaggaaatatcttcagagaagacctagaaagaagctatctgaggaactgctttttgatgtatgcattcatctcacagagttaagcctttcttttgattgagcagtttggaaacactgtttttgtagaatctgtaaaagtatatttgggagcacactaacgcctatggtaaaagaggaaatatcttcagataaacactaaaaataatctttttgagaaactactttctgaattatgcattcatctcacagagtcaaacatttccttttattgagcagtttggaaacactgtttttgtagaatctgcgaagggatatttgggagtgcagtgaagcctatggtgatacagaaaatatcttcagataaaaactagaaagaagctttttgagaaactgctttgtgatgtgtgaattgatctcacagagttaaaacttccttttgatggagcagtttggaaacactgcttctgaaaaatcttcgaatcaatattaagtatcataaaaagcctatggtgaacaaggaaatatcttcagataaaaactggaaagaagtgatatgagaaactgcttttggatgtgtgcattcatctcacagatttaagtccttcttttgattgagcagtttggaaactctgttcttgtagaatatgggaagggatattagggagtgcctagaaagctatggtggaaaaggaaatatcttcagagaagaactagagagaagctttctgagaaactgctttgtgatgtgggcattcatctcacagagttacacctttcttttgattgagcagtttggaatcttggtttttgtagtatctgtgaagggatattttggagaaacggaaggctatgatgaaaaaggaaagatcttcagataataactagaaagaagctttttgacaaactgctttgtgatgtgtgcattattttcacacagttaaaactttcttttcattgatgagtttggaaatactttttttgtagtttctgcaaagggatatttgggagcgcatgcagcctacagtgaaaaaggaaataacttcagataaaaactaaaaagaagctttctctgaaactgctttgtgatgtgtgcattcctctcacagaggtaaacctgttttttgattgagcagtttggaagccctgtttttgtagaatctgctaagggatatttgggagtgcacagatgcctgggtgaaaaaggaaatgtcttcaaagaaaaactagaaagaaccattttgagaaactgctttgtgatgtcggcactcatctcagagagttaaacttttcctttgagcagtttagaaacactgtttttgtataatctgtcaagcgatgttatgtagtggaaaaacgccaatggtgaacaaggaaatatcttcagataaaaactggaaagaagccttatgagaaactgctttccaatgtgtgcattcatctcactgagttaagtacttcttttgatggaacatttcagaaacactgtttttgtacaatctgcgaagggaaatctcagagtgcattgaggcattcagtggtaaaggaaatacattcagaggagaactagacagaagttatctgagaagttgctttgtgacatgtgcattatctcaaagagtttagctattcttttgatggagcagtttagaaaccctttttttatagactctgcaatgattgatatatttgggagcacactgaggcctatggtgaaaaaagaaatatctttgaataaaacatagaaagaagccatttgagaaactgctttgtgatgtgtgctttcatctcacagaggtaaaacttttttttgattgagctgtttggaaacattgcttttgtagaatctgcaatgggagatttgaaaaaacaggtaggcctatgatgaaaagagaaatatctttagataaatacaagaaggaagctttctgagaaactgctttctgatgtgtgcattcatctaacagagttaaatctttctttcgactcagcagtttggaaacacattttttgcaaaatctgtgaagagaaattaggtagtgcaaaaaaagcctacggtgaaaaaggaaatatcttcagacaaaaactggaaagcattatgagaaactgatttctgatgggtgcgttcatctcacagagttaagtccttctattcatggaacagtttggaaacagtgtttttgtagaatctgcgaagggatatttgggagtgcattgagacctgtggtggaaaaggaaatatccttagtgaagaactaggcagaagctttctttgaaactactttgtgatatgtgcattcttctcacagagttaaaactttcttttgattcagcagtttggaacactctttttgtagaatctgcgaagggatatttggagtgcatagaagcctacattaaaaagaaaatatcttcagataaaaactagaaagaagctttttgagaaattgctttttgatgtgtgcattcatctcacagagttaaaccttccttttgattattcaatttggaaaaactttctgtagaatctgtgaagggatatttcacagtgcatgaagcctatggtgaaaaaggaagtaacttcctataaaaactagaaagaagaaagaagctttctgagaatctgctttgtgatgtgtgcattcttctcacagagataatcgtttcttttgatttagcattttggaatcactgtttgtgtagaatctgccaagagatatttgggagcatactgatgcctatggtgaaaaaggaaatatctttggataaacactagaatattttcgagaaactgcttcatgatttatgaattcatctcataaatttaaacctttattttgactgagcagtttggaaacactgtttttgcaaaatctgcgaagcgatataaggtagggcgaaaaagccagctgtcaacaaggaaatatcttcagataaaaactcaaggaggcattatgagaaacagctttctgatgtgtgcgtacaactcagagagttatgtccttcttttgatggaacagtttagcaacacttcctttgtagaatctgcgaggggatatttgggaacatattgaggcttaagggggaaaaggaaatatcttcagaaaagaaccagacagaagctttctgagaaactgctttgtgaagtgtgcattcatctaacatagttaaacctttatttggttgagaagtttggaaacattgtttttgcagaatctcccatgggatatgtgggagcacattgaaacctatggtgatgaaggaaatatttttggatacaaactagaaagaaactttttgagaaactgctttgtgatgtgtgcatttacctcacagagttaaacattacttttgactgagccgtttggaaacactgtttttgcaaaatctgtgaaaaaatattaggtagcacaaaaatgcctatggtgagaaaggaaatatcttcagataaaattaggaaagaagcattatgagagactgctttctgttgtgtgcattcatctcacagagttaagtccttctttttatggaacagtttgtaaacactgtttttgcagaatctgcgaaggggcgcttgggagcacattgaagcctatggcgaaaaaggaaatatcttcagagaagaaccagaccaaaggtctcttagaaactgctttgtgatgggtgtattcatttcagagagtcaaacttcttttgattgagaagttttgaaacactgtttttgtagaatctacaaaagcataattagaatcacattgaagcctatgatgaaaaaggaaatatttatcttcagataaaaacttgaaagaagcgttatggcaaattgctttacaatgtgtgtattcactcagagaattaagtccttcttttgatggaacagtttggaaacactgtttttgtggaatcagggacaggatatttgggagcacatggaggtctatggtggaaatggaagtatcttcagagaagaacaagatagaagctttctgagaatctgctttgtgacgtgtgcattcatctcacagagttaaatatttcttttgattcagcagtttggacacactgtttatgtagaatctgcgaagggttatttgggagcacgttgatgcctacagtgaaaaaggatacaacttcacataaaaactagaaaaaagctttttgagaaactgctttgtgatgtgtgtattcatctcacagagttaaaagtttcttttgattgatcagcttggaaacactgttttagtagcatctgcaaagggatatttgggagcacaagaggcctatggtgaaaaaggaaataacttcagataagaactagaaagaacctttctgagaaacttctttgtgatgagctcattcttctcacagtgttaaacattccttttaacggagctgtttggaagcactgcttacatagaatctgcaaagtgatattttggagtgcaagactcctatggtgaaaaaggaaatagcttgagagaaaaactagaaagaagctttctgagaaactgctatgtgatgtgtgcattcttttcacatagttaaacttctcttttcattgagctgtttgaaaacactgtttttgtagaatctgcaaagtgatatttgggagcacatggatacctttggtgaaaaaggagatatctttggataaaaactaggaagaagctctttagaatactactttgtgagagatgcattcatctcaaagggttaagcttttcttttggttgaacactttggaagcacttttttgtgtataatctgtgtagagaggttaggtagtgcaaaaggcccatgttgaaaaggaagtatctttagataaaaattgtaaaggagcattatgagaaatggcattctgatacatgtgttcatctcacagaattaagtccttctttcaatggaacaggttgaaaacactgttttgtagtatctgagagtggatatttgtgagcaaatggaggcctatggtggaaaaggaaatatcttgagagaagaactagagagaagctttatgagaaactgcttcatgatgtgtgcattcatctcacagagtaaaacctttcttttgattgagcaatttgataacaatgtttttgtagaatctgcgaagggatatttgggagcacattgaagcttctggtgaaaaaggaaatatttttggatagaaattagaaagaagcttttagagaaactgctttgtgatgtgtgcattcatctcatagagttaaatatttcctttgattgatgagtttggaagcacagtttttggagaatctgcaaggggatatatgggagtgaaagaggtataaagtgaaaaaggaaataatttctgattaaaactaaaaagaagctttctgagaaactgctttgtgatgagtgcatttttctcacagacttaaaagtttcttttcattgagcagtttggaaacactgtttacatagaatctggaaagggatatttggctgggcaccgatgcctatggtggaaaaggaaatatgtttggataaacactataaagaatgtttttgagaaacttctttgtgatgtgtgcattcaacacagagttaaaactttcctttcatagagcagtttggaaacactgattttgtagaatctatgaagggatattttggagcacatagaggcctatggtggaaaaggaaatatcttcagagaagaactagacagaagctttctgagaaaaagtttgtgctgtgtgcattcgtctcatagagttaaaccattcttttgattgatcagtttggaaacacagtttttgtagaatctgtgaagggatatttgggagcacatgaggcatatggtgaaaaaaggaaataacttcagataaaattggaaatgctgtttttgcagaatctctgaagggatatttgggagcacaggaggcatatggtgaaaaaggaaataacttgagataaaaagtagaaagaagctttctgataaaccactttgtggtgtgtacattcttctcacagtgttaaaagtctcttttgaggagtttggaaatactgtttttgtagtatctgcaaagggatatttgggagtgcaatgatgcatttggtgaaaaaggaaatatcttgagagaaaagtagaaagaagctttttgagaaactgctttgtgatgtatgctttcatatcacagataaacatttattttacctgagcagtttcaaaacactgtttttctataatctgtgaagcgatgttagatagcacaaaaaggcaaatgttgaacaaggaaatatcttcagataataacaggaaagaaacgttatgagaaattgctttctgatgtgtgcattcatctcacagagttaaatccttctttgatggaacagttcagaagcactgcttttatagaatctatgagagaatatttgagagtgcattgaggccaatgatggcaaaggaaatatcttaagagaagaattagacataagctttttgagaaactgctttgtgatgtgtgcactcaactcagggagttaaacctgttttttgattgaggagtttgaaacactgtttatgtaaaatctgcgatgggatatttgtaagcacattgaatctaattgggaaaaggaaatatctttgcataaaaaatagaaagaagctctttgagaaactgcattgtgatgtgtgcattcatctcacagagttgaactttcttttgattgatcagtatgaaaacaccgtttttgtagaatctgtgaggggatatattggagtgcatggaagcctatggtcaaaaaggaaatatcttaggacaaaaactagaaagaaaccttctgagaaactgctttgtgatgagtccattcatctcacagagttaaacctttctttggactgagcaatttggaaacatcattttgcaaaatctgtgaagtgatattaggtagtgcataaatgcctatggtgaacaacaaaatatctttagataagaactggaaataaacgttctgagaaactgcgttgtgatgtgtgcattcatctgacagacttaagttcttcttttgaaggaacagtttggaaacagtgtttttgcaaaatctgcaaagcgatattagatagcacaagaaagactatggtgaaaaaggaaatatcttcagataaaaactggaaagaagagttatgagaaactgctttctaatgtgtgcattcttctcacagagttaagtacttcttttgatggaacagtttggaaacattgtttttgtagaaaatgcaaagggatatttgggagcacattgaggactaaggtggaagaggaaatatcctcagagcagaactagacagaagctttctgagaaactactttgtgatgtgcgtattcatctaacagaggtaaaccattcttttggttgagcagtttggaaacactggttttgtagaaactttgaagggatatttgggagcacattgaagtctatggtgaaaaaaggaatatcttcagataaaaaccagaagaagattttgagaaactgctttgggatgtgggcattcaactcagagagttaaagctgggttttgattaagcagtttggaaacactgtttttgcagaatctgcaatgggatatttgggagcacattgaagcccatggagataaaggaattatcttcagataaaaaccagaaaggagctttttgagaaactgctttgtgatgtttgcattcatatcacaaagttaaaactttcttttgattgagcagtctggaaacactggttttgtagaatctgagaattgatgtttagtagcacaaaaatgcctatgttgaacaaggaaatatcttcagataaaaaatggaaagaagcattatgagaaatggctttctgatgtgtgtgttcatctcacagaattaaagccttcttctgatggaacagttcaaaaatacagtttttatagaatctgcgaagggatattttggccacattcaggtctatggtggaaaaggaagtatcttcagaatagaacaagatagaacttatctgagaaattgccttataatgtgtgcatttatctcacagagttaagcctttctttggattgagcagtttggaaacactgtttttgcagaatctgagaagggatatttgggagcacaatgatgcctatggtgaaaaaggaaatatatatggataaaaactagaaagaggtattttgagaaactgctttgtgatgtaggcatttatctcacagagttaaacttttctgttcactgtgtagattggagacattgtttttttatagtctgtgaagcgatgttaggtaatgtaaaaaggcctatgatgaagaagaaaatatgttcagattaaaaattggaaagaactattatgggaaactgctttctgatgtatgcgttcatctcacagaggtaaatctttcttttcatggaacagtttgcaaacagtttgtgtagaatctgcaaaggatatttgggagtgcattgaagcctatggtggaaaagggaatatcttgagaagaaatagaaggaagctatcgagaaactgttttgataggtgtgcattcatctcacagagttaaacctttctgttcattgagcagtttggaaacactgtttttgtagaatctgtgaagttatattttaaagtgcactgaggcttatggtgaaaaagataaaaacaggaaagaatcttttgagaaactactatatggtgtctgccctcatctcacagaattaaatgtgatttttgattgagcactttagaaacactcttttagtagaaattacaatggtatattttggggcacattgaagcctgtggtggaaaagtaattatcttcagagaggaactagacagaagctttctgagaaactactttgtgaagtgtgcattcatctcaaagagttaaaactttattttgattgagctgtttggaaacattaatttgcacatcctgtgaaaggatatttgggagcacatttaagcctatggcaataagggaaacatcttctgataaaaactagaaagaagcttttagagaacctgcttttcattgatcagtttggaaacactgcttttgtagaatctgtaaagtgatatttggagtgcacgaacccgattgtgaaaaaggaaataacttctgataaaaactagagagaagctttctgagaaacagcttcatgaagagtttattcttctaatagacttaaacatttcttttgattgagcagtttggaaacactttttacatcaaatctgaaaagggacatttgggagtgcatagatgcccatggtgaaaaaggaaataccttcggataaaaactagaatgatggtttttgagaaaatgctgtgtgatacatgcattcatctcacagagataaacctttcttttgacagagcagttgggaaacacagcttttgcaaaatctgtgaagcgacattcagtagcacaaaaaaagcctatggtgaaacaagaaatctcttcagataaaaattggaaagaagcattatgagaaactgctttctaatgtgagcattcatctcacagaattaagtccttcttttgatggaacagtttggaaacactgtttttttagaatatgcgaaggcatattttagagctcagtgagccctaagatggaaaaagaaatatcttcagaggagaactagacagaagctttctgagaaactgctttgtcatgtgtgtattcatctcacagtgtaaaacctttcattttattgagaagtttggaaactctgttttactggattctgtgaagggtatctgggaatgcattgaagactacagtgaaaaaggaaattacttcagacaaaaacaagaaagaaactttgacaaactgctttgtgatgtgtggatacatctcacagagttaaacctttcttttgattgagaagtttggaaacactgtttttgtaggatctgtgaagggatatttgggagcacactgcttcttacggtgaaaaaggatgtcttccgataaaactggaaagaagtatttcgagaaaccactttgtgacacgtgcattcatctcacagagttaaacttttcttttgactgaacactttggaaacattgtttttgtatactctgcgaagcgatgttatgtagcgcaaaaggcctaagttgaacaaggaaatatcttcagatacaaactggaaagaagcgttatgagaaactgctttcaatttgtgcattcttttctcacacttaaatcgtacttttgatagtacagtttggaaacactgcctttgtaggatctgcaaagggatatttgggagcactttgatgcctacaggggaaaaagaaatatcttcagagaaatagacagaagctttctgagaaacagctttgtgatgtgtgcattcatctcacagagttaaacctttctttggttgaggagttttgaaacactgctttaatagaatatgcaaaggggtatttagagcacattgaagcctatggtgaaaaaggaaatatcttcagatgaaaactagaatgaagatttttgagaaactgctatgtgacgtgtgcattcatctcacagaattaaacatttcttatgcgtgatcagtttggaaaaactgttttgtagaacctgtgaagggatatttcggagcacacaagacctatggtgaaaaaggaaatgatttcagataaaaactataaagaagctttctgagaaatagctttgtgatgagtgcattcttctcacagacttacacatttcttttgattgagcagcttggaaacactgtttatggagaatctgcaaagggatatttgggagtgcattgactcctatggtgaataaggaaatatctttggataaaaacttgaaggaaggtttttgaaaaactgctttgtgatgtatgcgttcatctcacagagttaaacttttcttctaaatgagcaatttgcaaacactgttttggtgtaatctgcgaagtgatgttaggtagtgtaaaaaggcctatgtagaacaaggaaataccatcagatacattatgaaaagctgctttatgatgtgtgcattaatctcacagagttaaatccttctttgatagaacatttcagaaacactgtttatagagaatctgagaagggatatttggcagtgctttgaagcctatgatggaaaaggaaatatcttcagagaagaactagacagaagctatctgagaaactgctttctgatgtgtgcattcatctcatggagataaacctttcattttattgagcagtttggaaatactgttttgtagtatcagcaaatgtatatttgggagcacactggggcctatggtgataaaggaaatatcttcagataaaaattagaaagaaatttttccaaaactgctttgtgatgtgtgcattcaacttatagagttaaacctgtttttgcttgagcagattggaaacactgtttttgtggactctgcaatgggatatttgagagcacattgaaccctatggtgagaaagaaagtatctttggagaaaaaccagaaagaagcattatgagaaagagctttgtgatgtgtgcattcatcttacagaattaaaactttcttttgagtgagcagtgtggaaacacaattattgcaaattctgtgaagtgatactaggtatcacaaaaaagcctacggtgaaaaaggaaatatcttcagataaaaaattgaaagaagggttatgagaaatgttttctagtgtgtgcattcatctcacagagttaagtccttcttttgatggaacagtttggaaccactgtttttgtagaatctgcaagggatattttggagcaaactgaggcttatgatggaaaaggaaatatcttcagagaggagctacacagaaactttctgagaaactgctttgtgatgtgtgtattcatctcaaagagtaaaacctttcttttgatgattgagaacttttgaaacaccgtttttgtatgatgtaagaagggatatttgggactgcattgaagcctacagtgaaaaaggaaatatctttggataaaaatgagaaggaaactttttgacaaattgctttgtgatgcgtggattcatctcacagagttaaacctttcttttgattggtcagtttggaagcactctttttgtagaatttctaaagggatttttgggaatgcatgaagccaaagttgaaagtggaaataacttcagataaaaagtagaaggaagatttctaagaaactgctttgtgacaagggcattcttctcacagttttaaacgcttgttttgattgagcagtttggaaacacagttttcatagaatctgcaaagggatattttgtatctcactgattcctatggtgaaaaagtatatattcagataaaactagaaaaaagcattttgagaaacagctttgtgatatgtccattcatctcacagagtaaaactttagttttaagtgaccagtttgaaaacactatttttgtataatctacaaagtgatgttaggtagagcaaaatggactacagtgaacaaggaaatatgtttagataaaaactggaaagaagtactatgagaaaccgcattcagaagtgtgcattcatctgatacagttaaatccttcttttgaaggaacagttcagaaacactgtctttatagaatctgtgaatagatatttggtagcactttgaagcctatgatggaaaaggaaatatcttcagagaataagtagacagaatctgtctgagaaattgctttgtgatgtatgcattcatctgagtcaaacttttcttttgattgtgctgctggaaacactgcttttgtagaatatgcaaagggatatttcagagcccattgaagcctatggtgacaaaggaaatacctctgaataaaaactagaaagaagctttttttttattgttatactttaagttttagggtacatgttcacattgtgcaggttagttacatatgtatacatgtgccatgctggtgcgctgcacccactaactcgtcatctagcattaggtatatctcctgatgctatcgctccctcctccccccaccccaccacaatccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcgttgttggacatttgggttggttccaagtctttgctattgtgaataatgctgcaataagcatacgtgttcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccatatactctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagctctttgtcagatgagtaggttgcaaaaattttctcccattctgtaggttgcctgttcactctgatggtagtttcttttgctgtgcagaagctctttagtttaattagatcccatttgtcaattttgtcttttgttgccattgcttttggtgttttagacatgaagtccttgcccacgcctatgtcctgaatggtaatgcctaggttttcttctagggtttttatggttttaggtctaacgtttaaatctttaaaccatcttgaattgatttttgtataaggtgtaaggaagggatccagtttcagctttctacatatggctagccagttttcccagcacaagacagggaagccctctctcaccgctcctattcaacatattgttggaagttctggccagggaaatcagacaggagaaggaaataaaaggtattcaattaggacaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagacaaatcatgagtgaactcccattcacaattgcttcaaagagaataaaatacctgggaatccaacttacaagggatgtgaaggacctcttcgaggagaactacaaaccactgctcaaggaaataaaagaggatacaaacaaatggaagaacattccatgctcatgggtaggaagaatcaatatcgtgaaaatggccataccgcccaaggtaatttacagattcaatgccatccccatcaagctaccaatgactttcttcacagaattggaaaaaactactttaaagttcatatggaaccaaaaaagagcctgcattgccaagtcaatcctaagccaaaagaacaaagctggagacatcacactacctgacttcaaactatactacaaggctacagtaaccaaaccagcatggtactggtaccaaaacagagatatagatcaatggaacagaacagagccctcagaaataacgccacatacctacaactatctgatctttgacaaacctgagaaaaacaagcaatggggaaaggattccctatttaagaagctttttaagaaactgctttatgatatgtgcattcttctcacagtgttaaacgtttcttttaacaaagcagttggaaatactgtttttgtagaatctgtgatgggatatttgggagtgccttgaagcctatggtgaaaaaggaaacttcttcagataaaaattagtaagaagctttttgagaaactgctttgtgatgtgtgcattcatctaacagagttaaaccttttgtttgattgatctgtttggaaacacagtttctgtagaatctgcaaaggcgtattttggagtgcacgaggtctatggtgaaaaaggaaataacttctgataaaaactagaaagaagctttctgagaaactgctttgtgatgtttgcattcttctcaccaagttaaacatttcttttgattgagcagtttggaaacactctttttgtagaatctgtaaaaggatatttgggagcacattgttgcctatggtgaaaaaggaaatataatcagataaaaactagaaagatgctttttgagaaactactttgtaatggatgcactcatttcacagagttaagcttttcttttgactgagccatttgaaaacactgtttttatgtaatatgtgaagtgatgttttgtagtccaaaggtactatgttgagcaaggaaatatctttagataaaaactggaaataagggttatgagaaactgcattctgatgcgtgcattcatctcatagagttaagtcctccttttgaaggaaaagtttggaaacactgtttttgtaggatctgcaaagggatattttggagggatttgaggcctatggaggaaatggaaatatcttcagagaagaaatagacagaaggtttcttagaaacagtttgtgatgtgtgcaataatctcacagagttaaaactttcttttgattgattagtttggaaacgctgtttttttagaatcctcacagggatatttgggagtgcactaggcctatggtgaaaaaggaaataacttcagataaaaactagaaacaagctttctctgaaactgctttattatgtgtgcatttttctcacataattaaacatttcttttgatagagcagtttggaaatactgtttttgtagaatctgcaaagggatattgggaacacattgatacttgtggtgaaaaaagaaatatcttccgttataaagtagaaagaagattttgagaaactgctatgtgatgtgagcattcatctcatagagttaaacctttcttttgactgagcagtttggaaacactgtttttgcaatatctgcaaagaaatattaggtagcgcagaaagcctatggctaaaaaggaaatatctttagagtaaaattggaaagaagtgttatgagaaactgctttctgatgtgtgcattcatctcacagagttaagtcttcttttgatggaacagttgggaaacaacgttttgtagattctgtgaagggatatttgggagtgcattgaggcccagggtagaaaaggaatagcttcggataaaaactggaaagaagctttctgaggaactgttttgtgatgtgtgcattcatctcacagagttaaaactttcttttgattcatcagtttggaaaatttatttttgtagaatctgtgaagggatattttggagtgcatgaggcttatgctgaaaaagaaaataacttcagataaaaactagaaacaaactttctgagaaaaagctttgtgatacatgcattcttctcacagtgttaaataatcattttgattgagcagtttggaaactgcttttgtagaatctgccaagggatattttgaagcacactgatacctacagtgaaaaaggaaataacttcagataaaaatgggagagaagggttatgagaatctgctttctgatgtgtatattcatctcacaaagttaagtccttcttttgatagagctgtttcaaaacactatttttatagaatctgtgaaaggacatttctgtgcactttgagacctacgatggaaaaagaaataacttcagagaagaacgagacaaaagctttctgagaaactgctttgtgatgtgtggattcatatcacagagtaaaacccttcttttgattgaccagtttggaaacactgttttcatagaatctgtgaagggaaatttgggagtgcattgaagtctatggtggaaaaagaaataccttcagataaaaactagaaagaaggtatttgagagactgctttgtaatgtgtacattcatctcaaaaagttaaatctttcttttgattgatcagtttggaaacatgatttttgtagaatctgtgaaggtatatttgggagcgcatgaggtctatcataaaaaggaaaaaacttcagataaaaagaagaaagaagctttttgagaaactgctttttgaagtgtgaattcagctcacagtgttaaacctttcttctcatgatcagtttggaaacactgtttttgtacaatgtgcaaagagatatttggatgcacatgaggcctcttgtaaaaaaggaaataacttcagataaaaattagaaagaaggtttctgagaaacagctttgttacatgtgcattcttctcagataactaaaattatttttgattgagcagtttggaaacactgtttttatataatctgcgaagtgctattaaatagtgcaaaaggcctatggtgaaaaaggaaatatcctcagaaaaaaactggaaagagtcgttatgacaaactgctttctgatatatgcattcatctcacaaatgtaaatccttcttttggtggaacagttcagagacacggtttttatagaatctgtgaaggtatatttgggagtgctttggggcctatggtggaaaaggaaatatcttcagagaaaaattagacagaatctatctgagaaacttcttcatgaagtgtgcattcatctcaaagagttaaacctttcttttcattaagcagtttggaaacactgtttttgtagtatcttcaaaggtatacttcagagcacactaatgcctgtggtgaaaaaggacatatattcagataaaaactagaaagataccttttgagaaactgctttgtgatgtgggtgttcaactcacagagttaaacctgtttctgattgagcagtttagaaacactgttttgtagaatctgcaaagggatatttgggagtgcattttaggtttggtgacaaagaaaatatcttcagatataaaccagaaagatattttttgagaaactgctttgtgatgtgtgcattcatctcacagagttaaacctttcttttgattcatcagtttggaaacacttgttttgtagaatctgcaaatagatatttgagtgcacatgaggcctatactgaaaaaggaaataacttcagataaaaactggaaagaagcattctgagaaatggctttgtgatgtgtgcattcttctctgagagctaaaggttgcctttgattgagtagtttggaaacactctttttgtagaatctgcaaagggatatttcagagcacattgaagcctatggtgataaaggaaatgtcttcagataaaaactagaaggaaactttttgagaaacttgtttgtgatgtatgcattcatctcacagagttaaacttttcttttgactgagcagtttggaaacacagtttttctataatctgttaagcgatgttttgtagcgcaaaaaatcctatggttaacaaggatgtttcatcagataaaaactggaaagaagccttatgagaaactgctttctgatgtgtgtgttcatctcacttagctaaatacttcatttgttggaagtgttcagaaacactgtttttataaaatctgcaaagggatatttgggagagcattgaggactatggtggaaaatgaaatatcttcagattagaaatagacagaactgtctgagtaactgctttgtgaactgtgcattcatctcacagcgttaaaccttttgtttgattgagcagcttttaaacactgtttttgtagattctgcatgtgtatatttgggagtgcactgaggcctatgttgaaaaaggaaatatctttggataaaaactggaaagaatatttttgacaaactaatttgtgatgtgtacctttaactcatagagttaatcctgttttttgattgagtggtttggaaacactgtatgtgtagaatctgtgatgtgatatttggaagcgcattgaagcctatggtgaaaaggaattatctttagataaaatccagaaagaagcttttggaaactgctttgtgatgtgggcattcatctcacagagttaaacctttttttgactgagcagtttgtatacactgttttagcaaaatctgtgaagtgatattttgtagctcaaaaaagcctacggtgaacaaggaaatatattcagataaaaactggaaagaagggttgtttgaaacttctttctgatgggagcgttcatctcacagatttaagccctttttttgatggaacagttggtaaagattgtttttatagaatctgtgcagggctatttgggagtgcattgaggcctatgatggaaaaggtaatatcttcagagaagaaattgacagaagttttctgagaaactgctttgtgatgtgtccattcatcacagagagtttatcctttcttttgagtgaggagtttggaaacactatttttgtagaatctgggaagggatatttggtagtgcctgagacctatgatgaaaaaggaaataacttcagataaaaactagaaagatggtttctgagaaaccactttggatatgtgcattcttctcacagagtcaaatgtttccatttatagaacagtttggaaacacagtttttatagaatctgcaaagggatatttgggagcgcattgatgcctatgttgaaaaaggaaatgtcttcaaagaagaaaagttaagaaattttttgagaaactggtttgtgaagtatgcattcgtctcccagagttaaaattttcttttgatggagcagtttggaaacactgtttgtatataatctcagaagcaatgttaggtagtgcaaaaaggtctacggtgaacaaggaaatatcttcagataaaaactggaatttagcattatgagaaacagctttctgatgtatactttaatctgcttgagttaaatccttctcttgatggaagagtgtgtaaacactgtttatatggaatctgtacagtgatattttggaatgcattgaagcctctgatggaaaaggaaacatctttggagtagaactatagagaaactatatgagaaactgctttgtgacgtgtgcattcatctcacagagtaaaacctttcttttgatctagcagtttggaaacactgtttttgtagaatctgcaaaagtatatttgggaaggccaagatgcctatggtgaaaaaggaaataacttcacataaaaacgacaaagaacctctttgagaaactgctttgtaatgtgtgcattcatgtcacagagttaaacctttcttttgatggatcagtttggaaacactggtattgcaaaatctgcaaagtgatatcagctcaaaaaagcctatggtgaacaaggaaatatcttcatataaaaactggaaagaagtgttacgagaaactgctttttgatgtctgcattaatctcacagaggtaagtcattcttttgatgaaacactgtggaaacactgtttttgaagaatcttcaaagggataggtaggagcacattgaggcctatggtggaaaaggtaataacttcagagtggaaattgacagaaactttctgagaaaccgctttgtgatgtgtccattcatcacagagagtttaacctttgttttgattgaggagtttggaacacagtttttgtagaatctgggaagggatactttgtagtgcacgagacctatggtgaaaaaggaaataacttcagatgaaaactagaaagacgttttctgagaatctgctttggatatgtgggttcttctcacagagccaaacatttctatttatagagcagtttggaaacactgtttctgtagaatctgcaaagggatatttgggagtgcactgagcctatgttgaaaaaggaaatgtctttgaagaagaaaggttaagaaagttttcgagaaactgcttagtgaagtacacgtttatctcccagagttaaaatttagttttgatggagcagtttggaaacactgtttctgtataatctatgaagcaatgttaggtagcacaaaaagggctaaggtgaataaagaaatatattcaggtaaaaactggaatttagcattatgagaaacagttttcttatgtgtaatttaatctccttgagttaaatccttctcttgatggaacagtgtggaaacactgtttttatggaatctgcatggggatattttggagagcattaaggcctttggtggaaaaggaaatgtcttcggagaagaactatacctaaactatatgagaaactgctctgtgatatgtgtattcatctcacagagtaaaacctttcttttgatggatcagtgtggaaacactgttactgcaaaatcatcaaaatgatgttagttagcccaaaaaagcctatggtgaacaaggaaatatcttcatataaaaactggaaagatgtgttttgagaaacttctttttgatgtgtgcattcatctcacagagttaagtcattcttttggtggaacagtttggaaacgatgtttttgtagaatcttcaaagggaaacttaggagcacatttatgtctatggtagaaaagaaaatatcttcagagaagaactagacagaagtgttctgagaaactgctttgtgatgtgtgcattcatctcacagagttaaacttttctttttattcagcagtttggaaacactgtttctgttcaatctgcaaaggtatatttcggagcccactgaggcctatggtgataaattaaataacttcagataaaaactagaaagaaggtttttgagaaactgctttgtgaagggtgcattcatctcacagcattaagccattattctgattgagcactttgggaacactgtttttgaagaatctctggtgggatatttgggaacatatagaagcatatggtgataaaggaaatatctttggataaatactagaaagaagctttttgaaaaactgctttgtgatgtgtgcattcatctcacagagttaaaactttcttttgaatagtcagtttggaaacaccgtttttatagactctgtgaagggatatttgggagtgcactaggcctatgatgaaaaagaaataacttcagataaaaactagaaaaaagctttctgagaaactgctttgtgaagtgtccattcttctcaccgagttaaatgattcttttgattgaacagtttggaaacactgtttatgtagaatctgcccagggatatttgggaatgggaaggcgttgaatcctactgtgaaaaaggaaagatattcggataaaatcaagaaagaaaattttgataaactgctttctgatgttgcatttatctcaaagaattaaaactttcttttgattgatcagtttggaaacactgtttttgtagaatctgcatagggatatttgggagcacattttggcctatggtgaaaaaggaaataacttcagataaaaactagaaagaagctttctgagaagctgctttgtaatgtgtgcattcttctcacagaattaaacttttctcttgattgagcagcttggaagcactgtttttgttgaatctgcaaagccatatttgtgataacactgatgcctatggtgaaaaaggaaatatcttcagataagaactagacagaagtcttgagaaacagctttgtgatgtgttctttcaactcacagagttaaagttttcttttgaatgagcagtttgaaaacactgtttttgtataatcttagaagctatgttaggtagcacaacaaagcctatggttaacaaggaaataacttcagataaaaactggaaaaaagcattatgaaaagcttctttctgatgtgtgctttgatctcacagagttaaatccttcttttgatggaacagttcagaaacagagatttatagaatttgcaaagggatattttggagcaaatttaggcctattgtgaaaaaggaaatatcttcagagaagaaggagacagaagttttctgagaaattgctttgtgatgtgtgcattcacatcacagaaatcaacctttcctttgattgagcagtttggaaacactggttttgtagtatctgtgaagggatatatgggaaagctttgaagcctatggtgaaaaatgaaatatcttcggataaaaactagaaagaagcttttagagaaactcccttgtgatgtgtgtttcatgttttttaatagagcagtttgaaaacactgttcttgtagaatctacaacaggatatttgggagcacattgaagcctattgtgataaaggaaatatctttggataaaaactagaaagaagctatttgagaaacttctgtgcattcaactcacagagttataactttctttttactgagcaatatggaatcattgtttttgtagaatctgcaaaaggatatttgggagcgcatgaggcctatgatggaaaaggaaataactttagataaaaactagaaagtacttttctgagaaacttctttgtgatgtgtgccttcctctgaaagagttaaatgtttcttttgattgacaaatttggaaacactatttttttataatctgcaaatggatatttgggagcccagtttttcctatggtgaaaaaggaaatatcttcagataaatactagaaagaaacccttcaagatactgctttgtgatgtatgaatttttctcacagcgttaaagttttcttttgactgagaagtttggaaacactgtttttgtataatctgcaaagtgatgatacgtagtgctaaaaggcctatgttgaacaaggaaataacttcagataaaaactagaaagaagctttctgagaaactgctctctaatgagtgcattcatctgacagaattaaaactttcttttaattgagcagtttggaaacactcttacagtagaatctgtgaagggatatttgggagagcgctgaggtccatggtgtaaaaggaaataacttcggataaaaactacaaagaatatttctgagaaactattttgtgaagtctgcattagtctaacagatttaaatatttcttttgactgagtcatttggaaacactgtttttgtagattctgcgatgggatatttgaaagtggagttaggcctatggtgaaaaaggaaatatattagcataaaaactagaaagtaattttttcagaaactgctttctgatgtacccattcatcagacagaattaaacttttcttttgactgaacagttcggaaacactgttcttgtataatctgtgaagggttatatgggagcacaaaaaagagtatggtgaaaaaggaaatgtcttcagataaaaactggaaagaagcattatgagaaactgctttctgatgtgtgcattcatctctcagagttaagtccttcttttgatggaacagtttggaaacactctctttgtagaatctgcaaagggatatttggagcgtattgagtcctatggtggaaaatgaaatatcttcagagaagaagtagacagaaatttttggaaaactgctttgtgacatgtccattcatcacacagagttaaaccttgctttgatggatcaggttggaaatacagtttttgtagaatctgcaaaggaatatttgggaacacattgatgcttattgtgaaaaaggaaatatcttcagataaaaactagaaagtagctttttgattaactgctttgtgatatatgcattcttctcaccgagttaagcttttcttttgactgagaactttggaaacactttttttttttttgtatactcagcgaagtgatgttagatagcacaaaaagcctatggtgaaccaggacataacttcatataaaaactaggaaaaagggttatgagaaactgctttctgaagtttgcattcacctcacagagttacatccttcttttgatgaatagttggaaaaactgtttttgtaggatcttggaagtgatgtttgagagcacactgaggcccatgctggaaaaggaaataactccagataagaaacagatgcaagctttctgacataccgctttgtgaggtgtgcatgtagctcacagagttaaatatttctttgtattgagcagtttggtaacattgtttttgttgaatctgcaaaggtatattttggaacccactgaggcctaggtgaaaaaggaaatatctttggttaagaaatagaaagaaggtttttgagaagctgctttgtgatgtctgctttcaactcaaagggttaaacctgttttttgatttaactgtttggaaacagtgtttttctagaatctgcgacaagatttttgggagcacattgaagcctatggtgataaagaaaatatcttcagatcaaaactagaaagaagctttttgagaagcttctttgtgatgtgtgcattcatctcacagacttaaaactttcttttgactgagcagtttggaaacactgtttttgcaaatctgtgaagcgattttatgtaccaccaaaaaccctatggtgaaaaaggaaatatcttcagataaaaactgaaggaaacatcacgataaactgtgttctgatatgtgcattcacctcacagagttaagttgagcttttgatggaacagttggaaacagtttttccagaatctgtgaagggatatttgggaacacattgttgcctatggtggaaaaggaaatatcttcagagaagaactagacagaaacattctgagaaactgctttgtgatgtgtgcattcatctcaaggagttaaacgtttgttttgattgagcagttgggaaacactgcttttatagtgtctgcgaagggatatctgtgagctcattgaggcctatggtggaaaatgaaatatcttcagagaagaacaggacagaatctttctgagaaactgcttttagatgtctgcattcatctcacagagttaaaccattcttttgattggccagtttggaaaaactactttcttggaatctgctaatggatatttgggagctctttgaagcctatggggaaaaggaaatatcttctgacaaaaactagaaggaagacttttgagaatctgctttgtgatgtgtgcattcatctcacagagttaaacctttgttttgattgatcagattgcaaaaactttctttgtagaatatatgataggatatttgagagcccaagagttctttggtgtaaatggagttaacttcagataaaaatagaaagaagctttttgagaaacttctttgtgatgtatgcattcaactcaaagagttaaacctgtcttttgattgtgcagtttggaaacactgttgttgtagaatccacaaagagatatttataagagtgcattgaagtcaatggtgaaaaaggaaatatcttcagataaaaactagaaagaagccttttgagaatctacttcgtgatgtgtgcattcatctcacagggttaaaccttctcttgacagatcagttttgaaacactgtttttttgtagaatatgtgaagggatatttgggagcccatgaggtctttggtgaaaaaggaaattactttagagaaatactaaaaagaagctttcttagaaactgctttgtgatgtgtgtaatcttctcacagtgtttaatgtctctttggattgagcagtttacaaacactctttatgtgtaacctgcaaaggcacattttggagtcccctgaggcctatggtgaaaaaggaaatattttggataaaaactagaaagaagctatttgagaaaacgctttgtgatatatgcattcgtctcacagagttaaacttttcttttgactcagcagtttggaaaccctgtttttgtataatctatgaaaccatgttaggtaaagcaaaaaggcctatggtgaacaagcaaatatattgagacaaaacatggaaagaagcattatgagaaactcctttctgatgtgggcgttcatctcacagagttcaatccttcttttgatgaaatagttcggaaacaatgtttttatataatccgtgaagggatatttgggagcgcattgaggtctttggtggaataggaaagatcttcagagaagagctagacagaagcgttatgagaaactgctttgtaatgtgtgcattcaagtgacagagttaaacctattttttgatggctcagtttggaaacactgtttttgtagaatctgtgatgggatatttggcagctcactgaagtctatggtgataaagaaaatatcttttgataaaaactagaaagaaatttttagaaactgctttgtgatgtgggcattcatctcacagagttaaagctttcttttgaaggatcagtttggaaacactgtatttgaaaaatctgtgaagtgatattatgaaacgcaaaaagcccatggtgaaaaaggtaatatcttaagataaaacaggaaacaagtgttttcagaaactgctttctgatgtgtgccttcatctcacagatttaagtcgtttttgatggaacagtttagaaataccgtttttgcagtatctgtgaagggatatttggaagctcattgatgtctatggtggaaaaggaaatatcgtcagagaaaaactgggcagaagttatctaagaaactgcattggttttaggtcaacaagtaagtctttaatccatcttgaattaatttttgtacaaggtgtaaggaagggatccagtttcagctttctacatatggctagcccgttttcccagcaccatttattaaatagggaatcttttccccattgcttgtttttctcaggtttgtcaaagatcagatagttgtagatatgtggcattatttctgagggctgtgttctgttccattgatctgtatctctgttttggtaccagaaccatgctgttttggttactgtagtcttgtagtatagtttgaagtcaggtagcattatgcctccggctttgttcttttggcttagctttgacttgtcaatgtgggcttttttttggttccatatgaactttaaagtagttttttccaattctgtgaagaaagtcattggtagcttgatggggatggcattgaatctataaattaccttgggcagtatggccattttcatcatattgattgttccttcccatgagcatggaatgctcttccattcgttggtatcctcttttattttattgagcagtggtttgtagttctgcttgaagaggtccttaacatcccttgtaagttggattcctaggtattttactcttgttgaagcaattgtgaatgggaattcactcatgatttggctctctgtctgttattggtgtataagaatgcttgtgctttttgcacattgattttgtaccctgagactttgctgaatttgcttgtgagcttaaggagattttgggctgagacaatggggttttctagatgtacaatcatgtcatctgcaaatagagacaatttgacttcctcttttcctaatagaataccttttgtttccttctcctgtaaggacttcatgtctaaaacaccaaaagcaatggcaacaaaacacaaaattgacaaatgggatctaattaaactaaagagcttctgcacagcaaaagaaactaccatcagagtgagcaggcaacctacagaatgggagaaaatttttgcaatctactcatctgacaaagggctaatatccagaatctacaatgaactcaaacaaatttacaagaaaaaaacaaacaactccatcaaaaagtgggcaaaggataagaacagacacttctcaaaagaagacatttaagcagccaaaaaacacatgaaaaaatgctcattatcactggccatcagagaaatgtaaatcaaaaccacaatgagataccatctcacaccagttagaatggtgatcattaaaaagtcaggaaacaacaggtgctgaagaggaggtgcagatatttacactattggtgggactgtaaactagttcaaacattgtggaagtcagtgtggcgattcctcagggatctagaaatagaaataccatttgacccagccatcccattactgggtatatacccaaagggttataaatgatgctgctataaagacacacgcacacatatgcttattgtggcactattcacaatagtaaagacttggaacccacccaaatatccaacaacaatagattggattaagaaaatgtggcacatatacaccatggaacacaatgcagccataaaaaaatgataggttcgtgtcctttgtagggacatggatgaagctggaaaccatcattctcagcaaactatcagaaggacaaaaaaccaaacaccgcatgttctcactcacaggtgggaattgaacaatgagatcacttggacacaggaagaggaacatcacacactggagcctgttgtggggtgggcggaggcgggaggaatagcattaggagatatacctaatgctaaatgacaagttaatgggtgcagcacaccaacatggcacacgtatacatatgtaacaaacctgcacattgtgcacatgtaccctaaaacttaaagcgtaataataataataataataataataataataataaagaaactgctttgggatgtgtgcattcctctcccagagttaaacctttcttttcattgagcagtttggaaacactgtttttttttagaatctgcaaagggatatttgggagcgcatggaagcctatggtgaaaaaggaaatatcttcggataaaaactagaaagagggtatatgagaaactgttttgtgatgtgtgcattcatctcatagtgttaagcctttcttttaattaatccgtttggaaacactctttttgtagaatctgccaaggaatatttgcgagtacaagaggcctattgtgagaaaggtaataacttcagattaaaattagaaactttctgaaaacctaatttgtgatttgtgtatacatttcacagtattaaatctttcttttgatggggccacttgaaaccacccttttggcagaatcagccaggggttatttgggatcacattgaggcctatggtgaaaaatgaaatatctccagataaaaactagcaagaagctttctgagaaactactttgagatgcttgtattcgtctgatacagttaaagctttgtattgattgagtagtttggaaaaactgttttgctagaatctgacaagggatattttggagtgcactgatgcctacagtgaaaaaggaaataacttcagataaaaactacaaggaagttttctgagaaacttctttatgatgtgtgtattcttctcacagatttagacatttcttttgattgagcagtttgggaacactgtttttgtagaatctgcaatgggataatagaaagcacagttaagttgatggtggaaaaggaaatatctttttataaaagctagaaagaaactttttgagaaactgctttctgatgtgtgcattcatctcacagacttaaacttttctttgactgagaactttggaaacactgtttctgtataatctgtgaagtaacattacacagtgcaaaaaagcctatgttgtaaaagaaggaaaaaacttcagataaaaaatggaaagaagcattatgagaaactgatttctgatgtgtgctttcatcttacagagttaagtctttcttttgatggagcagtttggaaacagtggttctgtagaatctgcgaaggaatatttgggagggcattgaggcctaagttggaaaaggaaatacattcagataagaactagagagaagctttatgagaaactgctttgtgatgtgtgtattcatctcacagagttaaacctttctttgagcagtttggagacactgttttgtggaatctgtgaagggctatttgggagcgcatgaggccaatggtgaaaaaaattaacttcagataaaaagtagaaagaagcaatctgagaaaccgctttttgatgtgtgcattcttctcacagagttaaatgtttctttatattgagctgcttggaaacactgtttttgtagtatctgcaaacatatatttaattaaggcctacagtggaaaagcgaatatcttcagagaaaaataagaaagaagccttttcagaaactgctttgttatctgtgctttcacctcatagagttaaacttgctttttattgatcagttttcaaacactgttaatgtggaatctgcaatggtgtatttgggagcacattgaatcctatggtgaaagaggaaacatcttcggataaaaactggaaagaagcattttgagaaactgctttgtgatgtgtgcattcacctcacagagttaaacatttcttttgatagagcattttggaaacattgattttgaataatctgcaaagtgatatttggtagcgcaaagaggcctatgttgaaaaaagaaatatcttcagacaaaaactggaaagaagatttctgagactgatttgtgatgtgtgctttcatttaacagtgttaaattttttctttgatggagccgtttggaaacaccattttgcaagattctgtgaagggttatttgggagtgcattgaggcctacattgaaaaaggaaatatctccagataaaaactagaaagaagcttactgagaaactgctttgtgatgtatgcattcatcttacagaggtaaacctttccttgggttgagcagtttggaaacagtgtttttgtagaatctgcaaagggaaattttggagcacactaatatttatggtggaaaaggaaataccttagtgtaaaaactagaaaaaatatttttgaggaactgctttgtgagctgtgcattcagctcacagagttaaacctattttttgattgagcagtttggaaacattgcttttgtagaatctacaacagaatatttgggagcacattgaagcctatggtgttaaaggaaatatctttggaaaaaatcaagacagacgctttttgagatactgatttgtaaagtgtgcattcatctcactgacttaaatgtggcttttgattgagctgtttggaaacactgtttttttgtaatctgcaaagtgatgctaggtagcacaaaaaggcctattctgaaaaaggaaatatgttcagataaaaactgtaaagaagctttctgagatacttatttgtctcagtgctttaatgtgtgcattcatttcacagtgattattttttcctttgatggagctgtttggaaacacccttttggcagaagttgcaaacagttatttgggagtgcattgaggcctacggtgaaaaaggaaatatttcaagataaaaattagaaaggagctttgtgaaaaactgcttagtgatgtgtgaatttatctcagagtaaaacctttcttttcactgagcagtttggaaacactgtttttgcaaaacctggaagagatattatgtaacacaaaaagctatgatgaaaaaagaaacttttacagataaaacctggaaagaagcattatgagaaatggctttctgatgtgtgtgttaatctcagagagttaagtccctcttttgattgaacggtttggaaacagtgtttttgtagaatgggtgaatggatatttggcagcgctctcaggccaatggtggaaaaggaaatgacttcagagaactagacagaaactttctgagaaagtgccttgtgatgtctgcattgacctcacatatttaaacttttgttttgattgagcagtttggaaatgctgtttttgtaaaatctcgaagggatatttaggagtgaattgaagcctgtggtgaaaaagtatatatctttggataaagattagaaagaagctttttgagaaactgctttgtgatgtgtgtgttcttctcacagaggtaaaagtttcttttttgttgagcagtttggaaacactgtttttgtacaatatgcaaagggatattttggagcgcattgaaggttatggagaaaaatgaaatatcttcagttttaagacctagaaagaagaagctttttgagaaactgctttgtgatgtgtgcattcttctcacagaggtaaatgtttcttttgattgagcagtttcgaaacactgttttggtagaaagtgtgaagggttatttgggaccacattgaagtctatagtgaaaaatgaaatatctttggataaaaactagaaagaaatttttgaccaactgctttatgatgtgcccattcatctcacagaggtaaacctttcatttgattgatcagtttggtaacactgtctttttagaatctgtgatggtgtatttgggagtgcatgaggcctatggggaaaaggaaataacttgagataaaaattagagagaatctttctaaaaaccgctttgggatgtgtgcattcttctcacagagttaacattttctcttgattgagcagtttggaaacactatttttgtagaatctgcaaagggatatttgggagcatactgagtcttactttgaaaaggaaatatcttcagataaaaagtggaaagaagctttttgagaaactgctatttgatctttgcattcatctcacagacttaaatctttcttttgagtgaagagtttggaaacactgtttttttcaaaatgtgcaagtgatattaagtagccagaaaagcctgtagtgaaaaagtaaatattttcagataaaaactggaaagaagtgttatgagaaactactgtgtgacgtgtgcattcatctcacagagttaagtccttcttttgatggaaaagcttagaaatactttttttgtataatgtgtgaaaggatactttgaaacacattgaggcctatggtggaaaaggaaatatcttcagagaagaactagacagaatctttaggagaaactgatttgtgatatgtgcattcatctcacagagttaaacatttcttttgattgagcagtttggaaacactgtttttgtcgaatctgcaaaggggtatttggggatgcattgaagctaaggtgaaaaaggatatatcttcggataaacagtagaaagaagctttggagaaactgctttgtgatgtgtgcattcatctcacacagttaaaactttctttttattgatcagtttgggaacactcttttttcagagtatgtgaaaggaaatttggaacacacgaggactatggtgaaaaaggaaattacttcagataaaaactagaaagaagatttctgagaaactgctttgtgctgtgtgcattcatctcacagagataagtacttctttttatgaaacagtttggaaatactgcttttatagaatctgtgaagggatatttcagagggcattatgccttggtggaaaagaaaatatcttcagagaagaagtagacagaagctttctgagaatctgctttgtgatgtgtgcattgatttcacagagttaaaccctacttttgattgagcagtttgaaaacactgttttggtggaatatgggaaggcatatttcggagcgcattgatgcatttggtgaaaaagcaaatatcttcagataaaaactagaaagaagatttttgagaaaatgctttgcaatgtctgcattcatctcacagggttaaacctttcttttgattgatcaatttggtaacactgtttctgtagaaactgtgaaagtatgtttggcagcacacaagtcctatggtgaaaaaggaaatacctttggattaaaactggaaaggatcattgtagaaactgccttgtgatgtgtgccttccactcacagaattaaaccttttttttgattgagtattatggaaacactgtttttgtggaatctgtgatgggatatttgggcgtgcattgaactctttggtgataaagttaatatcatcagatgaaaactagaaagaagccttttgagaaactgctttgtcatgggtgcatttatctaaaagattaaaacctttcttttcactgagcagtttgcaaacactgtttttgcaaaatgtgcgaacccatgtaatgtagcccaaagtaggttatggtgaaaaaggaaacatcttcagataaaatgtgcaatgaagcattaagagaaactgttttcagatgtgtgcattcatctcacacagttaagtcgttcttttcattgaacagtttggaaacactgcttttgtagaatctgcaaagggatatttgggagtgcacgagatctatggtgaaaaaggaaatatcttcggataaaaactggaaagaagctttctgagaatatgctttgtgatgtgtgcattcatcttacagatttaaatcactctttaggcagaacagttcagaaacagtgtttttataaaatccgtgaagggatatttgtgagcacattgaggcctatggtggaaaagggaatatctccaggtaaaaacttgaaagaagctttttgggaaactgttttgtgatgtgggcattcatctcacagaaataaacttttcttttgattgatcagattggaaacactttttttgtagaatctgcgaagggaagtttgggagcgcacaaggcctatggtgagaaaggaaataacttcagatacaaactagaaagaatctttctgagaaactcctttgtgatgtgtgcattcacctcacagagttaaacctgttttccaattgagcagtatggaaacaccgtttttgcagaatctgtgataggatatttgagatcgtattgaagcctatggtgataaaagaaatatcttcagataaaaacaaaagagaaagttttggaggaacttcttcatgatgtgtgcattcatctcacagagttaaatgtttcatttgactgagcattttggaaacactgtttttgcaaaatctgtgaagtaatattagggagcgcaaaaaaccctatggttaaggaaatatcttcacataaaagctggaaagaagcattatgggaaactgctttctgatgtgtgcattcatgttacagatttaagtccttcttttgatggaactgtttggaaacactgtttttgtactacctgcaaagggatatttgggagtgcatggaggcctatggtggaaaaggaaatgtcttcagagaagaaccagacagaagctgtatgagaaactcctttgtgatgtgtgcatttatctcacagagttaaacctttcttttgattgagcagtttgtaaacactgtttttgtagaatctgcaaagggatatttgggagtgctttgaggcctatggtgggaagggatatatcttcagaaaacaagacagaagctatctgaggagctgcttggttattagtgcattcatcacacggagttaaacctttatttggattgatcagattggaaacactgtttttgtagaatctgtgaagagatatttggagcacacgaggcctatgatgaaaaaggaaataacttcagacaaaaactttcacattaaaagtagaaagaagctttttgaaaaactgctttgtgatttgtgcattcttctcacagagttaaatgattcttttgattgtgcagtttggtaaaaatgtttttgaagaatctgcaaagcgataatttggagcaaagtgatacctatggtgaaaaagtaaatatcttcgtataaaaactacaaagaagctttttgagaaattgctttctgatggatacattcatcacacagagttaagtcttctgtttgatcagtttggaaacactgtttttgtagaatctgtggcaggatatttgggagcacacgtggcctatatttaaaaaggaaatatatgccaataaaaactagaaagaaagtttctgagaaacagctttgtcatgtgtggactcttctcagagagttaaatgttacttttgactgagcagtttggaaacagtgtttttttagtatctgcaaagggatatttggaatcacagtgttgcctatggtgagaaaggaaataatttcagataaaaactagaaagaagcattttgagaaacttctttgtgatgcatgcatttttctcacacagttcaacttttcttcttacagggccgtttggaaacactgtttttgtgtaatctgcaaacagatatttggtagtgcaaaaaggcctatcgtgaactaggaagtatcttcagataaaaagtggaaagaagcgttatgagaaactgctttctgatgtgtgcattcgtgccacatagagaaatacttttgatggaacagttcataagcactgttcttataggatctgcaaagggatatttgtgagagcattgaagcctatggtgacaaaggaaatatcttcagataaaaactggaaagaagcttttttgagaaagtgctgtttgatttgtgcattcttctctcatagttaaaagtttccttttattgagtaggttggaagcactgtttttgtgtaaactgctaagggatattttgtagcacaaaaaggcctatggtgaatatggaaatatcttcaaataaaaactgccaaagagggttatgagaacctgtttcctgacgggtgcattcatctcacagagttaagtccttcttttggtggaactgtttggaaacaagtatttaataggatctgaaaggggatattttggggtgtaatgaggcctacagtggaaaagagaatatcttcagagaagaacttgacagaagctatctgccaaactgctttgtaaaatgtgcattcatctcacagagttcaaactttgttttggttgagcagttttgaaacactgttttcctagaaactgaaaaggtatatttgggagtgccctgaggcctatggtgaataagggattatcttcagaaaaaaactaggaagaagctttttgagaaactgcttcatgatgagtacgttcacctcatagagttgaacctgttttttgattgagcagtttggaaacactttttttgtagaatctgcgacgggatatttgggagtgcattgaagcctatggtgataaatgaaatatctttggatacatactagaaagaagctttttgagaaactaatgtgtgcattcatctcacagagttaaacctttcatttgactaagctgtttggaaaccctgcttttgcaaaatctgcaaagtgatattaagtagcgcaaaataccctatggtgaaaaagaaaatatcttcagataaaaactggaaaaaagtgttatgagaaactgctctctgatgtgtgagttcatctcaaagagttaagtccttcttttgatggaacagtttggaaacactgttttggtggaatttgcaaagtgatattagggagtgcattgagggctacagtggaaaaggaaatatcttcaaagaagaaccagacagaaggtaactgagaaactactttttgatgtgtgcattcatctcaaagagttaaaactttcttttgattgagcagtttggaaacactgttttttagaatcttcaaaggtatatttgggggcacactgaggcctgtggagaaaatgaaatatcttcagataaaaactagaaagaagccttttgagaaactgctttgcgaagtatgcattcatctcacagaggtaaaactttcttttcattgagcagtttggaaacacagtttgtgtagaatctgtaaagggatatttgggagagcattgaaacatatcatgaaaaggaaatatctttggataaaaactagatagtaactttttgataaactgcattatgatgagcacattcatctcacagagtcaaacctttctttcaattgatcagtttggaaacactgtttttttagaatctgtgaaagggtattttggagcacattgaggcctatggtggaaaaggaaatgtcttcagagaagaactagacagaagctttctgagaaactgctttctgaagtgtgatttcaactcacagaattaaaccttgctcttgatcaagctgtttggaaacactgtttttatagaatctgcaaagggatatttgggtacatgttgaacgtatggtggaaaatgaaatatcttcagataaaaactagaaagaagcattttcagaaactggtttgtgatatgtgcattcaacaaacagaggtaaaggattcttttgatggatcagtttggaaactctgctttgtagaatctgcaaaggaatatttgggagtgcacaaggcctatgatgaaaaaggaaatatctttggataaaaactagaaaaaaagctatttgggaattggctttgtgatgtgcacatttaactcatagatttaaacctgtttctatattgagccatttgaaaaaactgtttttgtagaaattgtgatgggatatttgggagcgctttgaatgctatggtgataaaggaaatattttcagataaaaatcagaaagaagcattttgggaaactactttgtgatgagtgcattcacctcacatagttaagcatttcttttgatggagcagtttggaaaaactgtttttgcaaaatcagtgaagcaatgttacgtagagcaagaaagcctatggtgaaaaagtaaatatcttaaggtaaatcaggaaagcagcattatgaaaaactgctttgtgatgtgtgtgttcatctcacagagttaggtccttcttttgatggaacagtttggaaacactgtgtttatagaatctgcaaggggttatttgggagcacattgaggtctatggtggaataagaaacatcttcagagaagaactagagagaagctatctgagacagtgctttgtgatgtgtgaattcaactcacagagttaaagctttctttttaatgaccagtttggaaacactgtttttgtagaatctgcgatgggatatttgggagtgttttgaagcctaaggtgaaaaaggaaatatctttggataaaaaccagaagaaagtttttagagaaactgctttgtgatgtgtgcattcacctcacagagttaaacttatcatcttttgattgatcggtttggaaacactgtttttgtagaatctgcaaagggatatttgggagtgtatgaggcctatggtgaaaaaggaaatatcttcagataaaaactagaaagattctctttgagaaagtgctttgtgttgtatgcattcatctcacagagttaaacctttcttttgattgacccctttgaaatcactgtttttgtagaatctgtgttgggatatttgggagcataggaggactacggtgaaaaaaaacttcacataaatactagaaagaagctttctgataaactgctttgtgatgtgtgcattcttctcacagaattaacctttcttttgattgaattgattggaaacactgtttctgaacaacatgtgaagggatatttgggaggtcatgacacctatgttgaaaaaagaaataccttcagataaaaactagacaaaagctttctgagaaactgctttgtgatgtgtacattacattgacagatttaaacctttcttttgattgagaaggttggaaacacagtctttgcagaatatgcgaagggatattttggagtgcattgaagcctatggtgaaaaaggaaatatcttcagataaaaactagaaagaagttttgagaaactgctttgtgaagtgtggattcaactgacagagtaaaacctttcttttgattgatcagtattgaaatacttgtagaatctgcaaagggattcttgggagcaaataaggcctatggtggaaaagaaaataacttcagataaaaactagaaagaagctttctgagacactgcattgtgatgtgtgcatttatgtcacagagttaaacttttttttcagttgagcagtttggaaacactgtttttgtacaatctgcaaagggatagttgggagtggacaaggcctatggtgaaaaaggaaatatcttcagataaaaactagacagacactttctgagaaactgctttgagatgtgtgcattcaattcacagatttaaagctttcttttgactgaggaatttggaaacacagttttggtagaatctgtgaagggatatttgggagcacaacaaagtccatggtgaaaaaggaaatatcttcagataaaaactagaaagaagctttttgagaaactgctttgtgatgtgtgaattcatgtcacagagttaaaatgttcttttgattgagtagtttggaaacactgtttttgtagaatctatgaagggacttttgggagcacatgaggcctatggtgaaagagaaaatatctttggataaacactagaaagaagttttcgagaaactgctttctgatgtgtgtgttcaactaacagagttaaccatgtttttcactgggcagtttggaaatactctttttgtagaatgtgtgatgggatatttgggagcactttgaagcctatggggataaatgaattatctttggataacaactagaaattatctttttgagaaactgatttgtgttgtgtgctttcatctcataatgttaaacctttctttgactgagcagtatgaaacactatttttgcaaaataggagaagtgatattatgtagtgcattaaagcctacggtgaaaaaggaaatatcttgagaaaaaacttgaaagaagtgttatgagaaacttctttcttatgtgtgccttcatctcacagaggtaagtacttcttttgatggaacagttttgaaacactgtttttgcagaattggctaaaggatatttgggagagctttgatgccaaaggtggtaaaggaaatatcttcagagaagaactaggccgaagctttctgaaaaactcactcctattgatgtgtgcattcatctcacacagttaaatttttctttttattgagaactttggaaacgtcgtttctgtagaatctgtgaaggcatattttggagcactttgaagcctatggtgaaaaaggaaatatcttcagaaaaaaactagaaagaatctttttgagaaaatgccttgtgatgtgtggattcatctgacagagttaaatctttcttttgattgatcagttttgaaatacttgtagaatctgcaaagggatatttgggagcacaggatgcctatggtgaaaaagaaaataaattcagataaaaattagaaagaatttttctgagaaaccgctttgtgatgtgtgccttcttctgacagagttaatcatttcttttgattgaacagtttggaagcactgtttttgtgtaatccatgaaccgatgtttagtagtgcaaaaaggtccatggtgaaccaggaaatatcttcagataaaaactggaaggaagtgttatgaaaaagtgctttctcatgttcacattcatctcacagtgttaagtccctcttttgagggaacagtttggatacaatgtttttgtagaatctgggtagggatatttgggagctcattgaggcttatggtggaaaagaaagtacctgcagagaaaaattaggcagaaggtttctaataaactgctttgtgatgactgcaatcatctcagagactacaacctttcttttgatcgagcagtttggtaacactgtttttgtagaaactgcaaaggcatattttggagtgcaatgaagcttatggtgaaaaaggaaatatcttcagataaaaactacaaagaagctttttgagaaacagctttgtgatgtgtgcattcatttgacagagttaaacctttttttttgattgatccatttggaaacattgtttttgtagtatctgagaagggatatttgggagtgcaggaggcctatggagaaaaaggaaatattctcagataaaaaggagaaagaagatttttgagaaaatgctttgtgatgtgtgcattcaactgacagaattaaacctgtttttagattgagaagtttggaaacactgtttttgtataacctgcgataggatatttgggaggacatttaagtctatggtgataaggaaaatattttctgataaaaactagaaagatgcttttggaggaactgccttgtgaagtgtacatttatctcacagagttaaaaccctcttttggttgataagtttggaaagactgtttttgtggaatctgcgatgggatatttggaagtgcattgaaacctatggtgataaaagatacatcttcagataaaaaacacaaagaagaattttgagaaaccacttggtgatgtgtgcattcatctcaccgagttaaacttttcttttgactgagcagtttggaaaaactgtttttgcaaaatctgtgaatcaatattaggcagtgcaaaaagcctatggtgtaaaaggaaatatcttcagataaaaactgttaagaagtgttatgagaatctgctttctgatgcttctgtttatctcagacataagttcttcttttgatggaacagtttgaaaactctgtttttgtacaatctgcaaagggatatttgggagtgcactgaagtgtatggtgaaaaagaaaaggtcttcagagaagaactacacataggctttctgagaaattgctccatgatgagtgcattcatcttacagagttaaacctttcttttgatagagcaatttggaaacactggttttgtagaatctacaaaaggatatttgtgagtgcattgaagtccacaatgaaaaagaaaatatcttcggataaaaactagaaagatgctttttaagaaacttcttggtgatgcatgcatgcgtctcacagagtaaatcttcttttgtgacacagcagtttggaaactgtgtgtttttgtaatctgtcaagcaacgttgtgtagcgcaaaaaggcctatggtgaacaaggaaatatcttcagataaaaactggaaagaagcgttgtgagaaactgctttctgatgtgtgcatttatctcacagcattaaatccttcttttggtataacagttcagaaacactgtttttgtagaatctgtgaagggatatttgggagtgcattgaggcctacggtggaaaaggaaatatcttcagagaagagctagacagaaggtgtctgacaaactgctttgggatgtgtgcattcatttcacagagttaaaactttcttttgattgagtggtttggaaatgctgtttttgtagaatctgcaaagggatatttgtgaacgcactgaggccttggtgaaaaaggaaatatcatctttggataaaaactagaaagaaggtttttgaagaattgctttgtgatatgtgcattcatctcagagagtgaaacctttcctttgatagagaagtttggaagcactgtttttgcacaacctacaatgtgatattttgtaatgcaaataagcctatgctgaaaaaggaaatgtcttcagataaaaactggaaagaagctttctgagacactgatttgtgatgcatgcattcatttaacaggattaaatctttcctttgatggagccattttgaaaaacccttttggcagaaactgtgaagagttacttgtgagtgcattgaggcctatggtgaaaaaggaaatatctccatacaaaaactagaaagtatctttctgagaaactgctttctgatttgtgcattcatttggcagagttaaaactttcttttgattcagcactttggaaacactgttttggtataatctgccaagggatatttgatatcacactggccctgccaatggatatttgatatcacactgacccactggttaaaaatgaaataacttcagttaacaactaaaaagaagctttctgaaataccgctttgtgatgtttgatttcttcccatggagttaaaattttctattgaataagcagtttggaaacactgtttttgtaaaatctgcaaagggatatttgggagtgcactgatgcctatggtgaaaaaggaaatatcttcgcataaaaaaacgagtgagaagctttttgagaaatggctttgtgatgtatgtattcatctcacaatgttaaacttttcttttgagtgagcagtttggaaacactgtttttataaaatctgtgaaggtatgttaagtagcataaaaaggcctaaggtgaagaagaaaatatcttcaggtaaaaactggaaataagctttatgagaaactgctttctgatgtgtgcgttcacctcacagagttaaatatttcttttgaaagaagaattcatgaaaactgttatgatagaaactgggaagggatatttgggagggaattgcagcctaggatggaaaaggaactatcttcagagaagaactagacagaagttatctgagatactgatttgtgatgtgtgcatttatttcagggggttaaaattccttttgattgagcagtttggaaacagtgcttttgtagaatctgcaaagttataattgggagcaccatgaggcctatggtgaataaggaaatatcttagcataaaaacttcaaagaacctttatgagaaacggctttgtgatatgtgtgttcaacccacagagttaaaccttgttttttgattgagcagtttggaaacactgtttgtgtagaatctgcgatgggatatttgggatcacactgaagcctgtggtgataaagatatatatttgagttaaaactagaaacaagattattgagaagctgctttgtgatgtgtgcattcaactcatagagttaaagctctcttttgactaagcagtttggaaacactgtttttgcaaaatctgcaaagtgatattcggctgtgcaaaaaagcctatggtgaaaaaggaaatatcttcagacaaaaactggaaagaaacgttatgagaaactgctttctgatgtgagcattcctgtcacagagttaagtccttcctttgatagaacagtttggaatcaatatttttgtgtaatctgtgaagcgatgttaggtaactcaaaaaggcctatggtgaacaaggaaatatcttcagataaaaaatggaaagaattgttatgagaaactgctttctgatgtgtccgttcatctcacagacttaaatccaccttttaatgcaacaattcaggaacactgtttttatagaatctggaagggatatttagcagcacactgaggcctaagttggaagaggaaatatcttgagaagacatagacaaaagctataagagaaattgattttgatgtgtacattcgtgccatagagttaaaccttttttttgatagagcagtttggagacactgtttttgtagaatctgcaaagttgtattagggagtgcactgaagcttatggtgaaaaaggaaataaattcggataaaaactagaaggagtctttttgagaagctgcattcatctcccatagttaaacctttcttttgagagagtagtttggagacagtgtttttgcaaaacctgcgaagggatattaggtagcacaaaaaagcctatggtgaaaaagtgcatatcttgagataaagaatggaaagaagaattatgagaaaccactttctgatgtgtgcattcatctcacggagttaaatccttcttttcatggaacagtttgtaaacactgtttttgtagattctaagggatatttgggagcccattgaggcatatggtggaaaaggaaatatcttcacagaagaactagacagaagctttctttcaacctgctttgtgatatgtgcattcatctcaaagagttaaacgtttctttgattgagcagtttggaacactgtttttgtagaatctgcaaagggatatttgggagcacattgaagcctacagtgaaaacagaaatatcttcagataaaaaaactagaaataacctttttgagaggctgctttgtgatttgcacattcatctcacagaggtaaacctttcttttcactgagcaatttggaaacactgttttgtagaacctgtgaagagatattttggagcacatgaggcctttggtgaaaaagaaaataacttcagaacaagctagaaagaagcattttgagaaactgcttcatacagtgtgcattcttctcacagagataaacgtttattttgattgagcagtttggaaacactctttttgtagaatctagaaagggatatttggaagtgcactgatgcctatgatgaaaaaggaaatatcttcggataaaaactataaagaagctttttgaaaaactgttttgtgctgtatgcattcatctcacagagttaaacttttcttttgagtgagcagtttggaaacactgcttttgtacaatctctgaagcaatgttaggtagcccaaaaaggcctgtggtgaacaaggaaatatcttcagataaaaacgagaaaaaagcaatataagagactgttttctgatttgtgcattcatctcacatagttaaatccttgttttgatggaacagttgggaaacactgtttttatagggtctgcaaagggatattggagagcatattgaggcttaaggtgcaagatgaagtatcttcagagaactagatagaagccatctgagaaactgctttgtgagtgtgcattcatctcacagagataaacctttcctttgattaagcagtttggaaaaactgtgtaggtggaaactgcaaagggatatttgggagcacgctgaggcctatggtgaaaaaggaaatacctttggataaaaactagaaagaagctttttgagaagctgctttgtaatttattctttcatctcacagagttaaaactttcttttgattgaatagtttggaaaaactgttttcatagaaactgccaagagataattgggagcactttgaagcttataatgaaaaaggaaatgtctttggataaaaactagaaagaaggtttgtgagaaactcctttgtgatgtgggcattcatctcacagaaataaacctttattttgattgatcagtttggaaacactctttttgtacaatatgctaaaggatatttgggagcatacgaggattacggtgaaaaaggaaataacttcagataaaaactagaaaaaagctttctgaggaaccgctttgtgatgtttgcattcttctcacagagttaaacgtttcttttgattgagaaccttgtaaacactgtttttctagaatctgcaaagggatacttgggagcacactgatgcctatgttaaaaaagaaaatatctttggatcaaaactaaaaaggagctttttcagaaactactttttgatgtatgcattcttctcacagaattaaactgttcttttgactgagcaatttggaaacactgtttctgtataatctgtgatgcgatgttaggtcatgcaaaaaggcattgtgtgcacagggaaatatcttcagataaaaactggaaagaagcattatgagaaaatgctttctaacagagttaaatccttttgatggaagagttcagaaacactgtttttatagaatctgcaaagggatatttgggagggcattgaggcttctgttggaaaagaaaatatcttcagagaagaactagacagaaactatctgagaaatggctttgtgatgtgtgtattcatctcacagaattaaaacttcctttttaatgagtagtttggaacacagtttttgtagaatctgcaaaggtatatttgggagcacactgaggcccatgatgaaatatgaattgccttcatataaaaactagaaagaagctttttgggaaactgtttgtgaaatgtctgttcaactcatggtgttaaacctgtttttagatggagcatttcagaaacactgtagaatctacaatgggatatttaggattccattgaaatctatggcgataaaggaattctctgaaaaaaactagaaagaagctttttgagaaactgctttttgatatgtgctctaatctcacagagttaaagctctcttttcactgagtagtttggaaacactatttttgcaaaatctgtgaagcgatattaagtagtgcaaaaatgtctgtggtgaactatgaaatatcttcagataaaaattagaatgaagcattatgagaaactgcttactgatgtgtgctttcctcacacactgttaattccttctttgatggaacagtttggaaacacaatttttatagaatcttcaaagggataatttggagcacatttaagcctatgaaggaaaaggaaatatattcagagaagacccaaaaagaagcttctgagacactcccttgtgatgtgtgcattcagctaacaaagttaagcctttcttttgattaggcagtttggaaatactgctttctataatctgtgaagggatatatgggagcacattgaagcctctggtgaaaaaggaaatatcttctgataaatactagaaaggagtttgtgagaaactgcattgtgatgtgtgcatccacctcacagagttaaaacacggtttcattgatcagtttgggataaatgttttggtagaatctgcaaagtgatattcgggagtgcatgagacctacggtgaaaaaggaaataacttcagctaaaaactagaaagaagcttttgaagaaaccgctttgtgatgtgtgcattcttctcacagagttaagcgtttcttttcattgagcagtttggtcaaactgtttttgtagaatctgcaatgggatatttgggagcacactaatgcctattctgcaaaagaaatatcttctgataaaaactagaaagaagctctaagagaaactgctttgtaatatatgcattcatttcacagagttaaacttttctattaactgaacactttggaaacactatttttgtataatgtgtgaattgatgtttggtatcgtgaaaaggtctatggttaacaaggaaatatgttcagataaaaactggaaaaaagcattatgagaagctgctttctgatgtgtgcattcatctcacagagttaaatccttgttttcaaggaactgttcagaagcacttttttttttacagaatctgtgaagagatatctgagattgcattgaggcctacggtggaaaaggaaatatcttcagagaagaactagacagaaactatctgagaaactcccttgtgatgtgtgccttcatcccatacagttaaaccattcttttgattgagcagtttggaaacactgttttttttagaatttgcaaaagtatatttggtaacaccatgaggcctatgaggaaaaggaaatatcttcagataaaaactagaaagtaccatttttgagaaactactttgtgaaatgtgcattcaactcacagagttaaccctcttttttgattgtgcagtttggaaacagtgttattgtagaaactgatacgggatatttgggagtgaattgaagcctaagataatgaaggaaataccttcagagaagaacctcacagaagatttctgagtaactgctttgtgatgtgtgcattcatcaaacagagttaaacctttcttttggttgaacagttgggaaacactgtttttgtagaatctgcaaagggatatttgggaggcattgaagcctaaggtgaaaaaggaaatatcttcagataaaaactggaaagaatcattatgagtaactgctttctgatgagtgtgtctgtctcttagagttaagtctttcttttgatggaacagtttggaaacactgcttttgtagaatctgtgaaggaacaattgtgagtgcactgaggtctagggtggaacattaaatatcttaagagaagaactaaagagaagctttatgagaagctgctttgtgatatgtgcattcatctcacagagttaaatctgttgtttgattgatcagcttggaatcactgctttcgtagaatctgagaagggatatttgggagtgcatgaggcctattttgagaaaagaaataacttcagataaaaactagaaaaaatattctgagagaatgctttgtgatgtgtgcaatcttctcacaaagttaaaggttacattttattgagcagtttggaaacactctttttgcataatctgcaaagggatatttggaagcatgatgaggcctatggtgtaaaaggaaatatcttcggataaaaactagaaagaagctctttgagaaactgctttgtgatatatgcgttcatgtcaaggagttgaacttttctttttactgagcagtttggaaacactgtttttgtataatcagtgcagtgatgttaggtagcaaaaaaggcctattgtgagtaaggaaacatcttcagatacgttagaagaaactgctttctgatgtgtgcattaatctcacagagttaaattctatttagatatttttatagaatctgagaaggaatatttgggagtgctttgaggcctattatggtaatggaaatacattcacataaaaactagacagaagcaatctgagaaactgctttttgatgtgtgcattcatctcagagttaaacatttctattgattgaacagcttggaaacactgtttatgtagaatctgtgaagggatatttagcagagcattgaagcctaatgcaataaaggaaatatctttggattaaaaactagaaagaagcttttggagaaactgttttgagattgtgcattcatctcacagagccaacctttcttctgattgagcagtttggaaaccgtgtttttgtagattatacaaaggtatatttcagagcacacagccctatggtgaaaaaggaaatatcattgcataaaaactacaaagaagctttttgagaaactgctctgtgatatttgcattgaactcacagagttaaaccttttcttttgactgagtagtttggaaacattctttctgtagaatctgccaaaggataattgagagcacattgaggtctatggtgaaaaaggaagtatcatcagagaagaagtagaaagaaggtctctgagaatttttttctgatgttttcattaatctcacagagttaagcctttgctttcattgagcagtttggaaacactgtttttgtagaaactgcagtgggacatttgggagcttaatgaatcctatggtgaaaaatgaaatatcttcagacaaaaagtagaaagaagcgttttgatcaactgctttgtcatgtgtgcattcatctcaaagagttaaacctttcttttgactgagcagtttgaaaacagtgcttttacaatgtctgccaagaaatattaagtagtgcaaaaagcctatggtgaacaaggaaatatcttgagataaaaattggaaagaggcttcatgagaaactactttctgatgtgtgccttcatctcacagagttccttcttttgatggaacaatttggaaacactgcttttgtagaatctgcaaagggacattttgcagcacattgagacctaggtggaaaaggaaatatcttcagagaaaaactagacagaagatttctgagacattgctttgggatgtgtgcattcatctcacagagttaaaactttcttttgactgagaagttaggaaatgctgtttttgtagaatctgtgaagagatatttgggagtgcattgaagccaatggggaaaaaggaattaactacagataaaaactagaaatatacgttttgagaaactgctttgtgatgtctgcattcatctcacagagttaaacctttcttttgatggatcactttggaaacactgtttctgcagaatctgcaaagggatatttataagtgtagggaaatttttttgtgcattgaggcctgttttgaaaaagaaaatatcttctgataaaaactagagagaagctttatgagaaactgctctgtgatgtgtacattcttctcccagatttaaacctattaattaaacagtttgggaacactctttttgtagaatctgcaaaggcatacttggtagcacatgaactctatcacgaaaaaggaaataccttcagataaaaactagaaggaatttttttgaggaactgcttttttgtgtatgcattcatctcagagagttaaacttgtttttgattgaatagcttggaaacactctttttgtagaatctgcaaagggatatttgggagtgcatttaagcatatggtgaaaagaaaatatattcagatgaaaactagaaagaagctttttgagaaactactttgttatgtaggcatttatgtcacagagttaatcttttctattcattgagcagtttggaaacactgtttttgcataatctgcaaaatgatgtaagttagtgcaaaaaggcctgtggtgaacaaggaaatatcttcagataaaagctggaaagaatcattatgagaaactgctttctgacgtgtgcattcatctcacagagttaaatccttttttgttggaaaaattcagaaactttttttttgtagaatctgcaaaggtatatttgggagtgcattgaggacctttgtggaaaggaaaattcgtcagagaagaattagacagaagctttctgagaaacagctttctgatgtgttcattattctcacagagttaaacctttcttttgattgagcaatttggaaccgctgattttgtagaatctgcaaagtgatatttggcagtgctttgaagcctctgcagaaaaaggaaatatattcggataaaaactggaaagaagcattatgagaaactgcttcctggtttgttcattcatctcacagaattaagtccttcttttcatggaacagtttggaaacactgttttgtagagactgcaaagtgataattgagagctcattgaggtctatggcagaaaattaaatatcttcagggaagaactagacagaagctttctgagaaactgctttgttagtgtgcattcttctcacagagttaattctgcttttgatttatcagtttggaaagactgcttttgtagaatctgtgaagggatatctgggagtgaacgaggcctatcttgaaaaaggacatgacttcaggtaaaaactagaaggacgctatatgtgaaactagtttgtgatgtgtgcaatcttttcacagagttaaatgtacctttgattgagccgtttggaaacacagtttttgtagtatctgcaatgctctatttgggaatgccctgaggcctattgggaaaaaggaaatatcttcagataaaagctagaaagaagctttttgagaaactgctttgtgatacatatgttcacctcacagagttaaacttttcttttgattgagcattttggaaacactgcttttgtacaatcttcgaagcaatgttattttttgtccaaaacctatggtgaacaaggaaatatcttcagataaaaactggaaagaagcgttatgagaaactgctttctattgtgtgtgttcacctcagagagttaagtccttcttttcacggaacagtttggaaacactgctttttgtagaatctgcaatgggatattgaggagctcattaaggtctatggtggaaaacgaaatatcttcagagaagaactagacagtagctccctaaaaaactgctttgtcttgtgtgccttcatctcacagatttaaacctttcttttgctagagcagtttggaaacactgtttttgtagaatctgtggagggatatttgggagcgcatgaggtctatggtgaaaaatgatataacgtcagataaaaagtagaaagaatttttctgagaaaccactttgagaagtgtgcattcttctcagagagttaagattttcttttggttgggcagtttggaaacactatgtagctgtagaatctgcaaagggatacttggaagagcactgatttctatggtgaaaaagggaaagtcttaagatgaaaagtagaaacaaatttttgagaaactgctttgtgatttatgccttcagctcacagagttgtatcctttttttgatggaacagtttggaaacagtgtttttatagaatctgcgaaggtacatttgggagcacatagaggcttatgttgtaaaaggaaatatcttcagagaagaagtagacagaaactatctgagaaactgctttgttatgtgttccttcatctcacataattaaacctttcttttgattgagcagtgtgtaaatactgtttttgtagaacctgcaaagggatatttgggagcacatggaagcctatggggaaaaaggaaatatgtttggatcaaaactagaaagagggtatatgagaaactgttttgtgatgtgtgcattcatctcatagtgttaagtctttcttttaattaatcagtttggaaacactctttttgtagaatctgccaaggaatatttgcgagtacaagaggcctatggtaaaaaatgatataatatcagataaagagtagaaataatttttctgagaaactgctttgagaagtgtgtattcttcacagagaggtaaaattttcatttgattgggcagtttggaaaaactattcagttgtagaatctgcaaagtgataattgggagagcactgattcctgtggtgaaaaagggaaagtcttcagatgaagagtaaaaagaagtttttgagaaactgctttgttatttatgtgttcagctcacagagtttaatcattcttttgatggaacagttcagaaacattgttttcatagaatctgcaaaggcatatttgggagtgcatagaggcttatggtataaaaggagatatcttcagagaagaagtagacagaaactatctgagatattgctttgctgtgttcatccatctcacagaattaaacctttcttttgattgagcagtttggaaacactgtttttgtagaatctgcaaagggatatttgggagcacagtgaggcctatggtgaaaaaggaagtatcatcagataaaagctagaaagaagtttgtgagatattgttttgtgatgtgttcattcaacatagagaggtaaacctgtttgttgacttaacaattcggaaatactgtttttctagaatctatgaagggatatttgggagtgcccaaggccaatggtgaaaaaggaaataacttcagataaaaattagaaagaagatttctgagaaactgctttgtgatgaatgcattcttctcacagagttaagtccttcttttgatggaacagtttgaaaacactgtttagggggaaactgtgaagggatatttgggagtgcactgaggcctgtggtggaaaaggttatatcttgagagaactagacagaagctttctgagaaactgctttgtgatatgtgccttcaactcacagagttaaaacagttttttgattcagcagttgggaaactgtttttgtagaatctgtgttggtataatttggagaacattgcatcctctggtgataaggaaatagcttcaaataaaaactagaaagaagctttttgagaaactgctttgtgatgtgtgcattcatctcacagagttaaaatttctgttgatagaggagttagaaaacactgtttttgtagaatctgcaatgggatatttgggaatgcattgaagcctgtggtgataaaggacataccttcatataaaaacaagaaggaagtttttgaaaaacttctttgtggtgtgtggattcttttcacagagttaaagctttctttggatggagcagtttggaaacactgtttttgcaaaatttgtgaagcaatatttggtagcacaaaagagtctatggtgaaaaaggaaatatcttcagttaaaaagtggaaagcatcgttatgagaaactgctttttgatgtgtgcatttactacatagagttaaatccctttttgatggaatggtttggaaacagtttttgtagcatctgtgaagtggtattagggagcacatagaatcttatttttgaaaaggaaatatcttaggataaaaactagaaagaagctttttgagaaactgctttctgatgtgtgcattcatctcacagagttaaacctttcttttgacagagcagtttggaaaactgtttttgtataatctgcgaagtgatattaggtagcacaaaaagcttatggtgaaaaaggaaatatcttcagataaaaactggaaagaagctttctgagaccctaatttgtgatgtgcacatacatttcacagtattaaatctttcctttgattgagccctttagaaacaccctttcagcagaatctgtgaagagttatttgggagtggattgaggcctagagtgaaaaaggaaatacgtccagataaaaagcagaaagaagctttctgagaaactaacttgtgaggtttgcattcgtctgacagagttaaacctttcttttgattgagcagtttagaaaaactgttttggtagaatctgcagagggatatttgggagtgcactgaagcctatggtgaaaaacgatttaaattcagataaaaactacaaataacctgaaaaaccgctttgtgatttgtgcattcttttaacagatttaaacctttcttttgattgatcagttaggaaacactgtttttgtagaatctgcaattggatacttgaaagaacagtcaggccaatggtgaaaaaggaaatatctttggataaaatctagaaagaagctttttgagaaactgctttgtgatgtgtacattcatctcacagactttaacttttcattagactgagaagtttggaaacactgtttttgtataatctgtgaaacaatatttggaagctcaaaaaagccaatggtgtaaaaggaaatatcttcagaaaaaaatggaaagaagcattatgagaaaccagttttgatgtgtgcattcatctcacatagttaagaaattattttaatggaactgtttggaaacagtgttctgtagaatctgtaaagggatatttgggagcccattgaggtgaaaggtagaaaaggaaatatcttcagagaactagacaaaagctttttgagaaactgcattgtgatgtgtgcattcatctcacagagttcaacctttctttgagcagtttggaaacacaatttttgtagaatctgcaaagggatatttaggagcacattgaacccaatagtgaaaacagaaatatctttggatgaaaaccagaaagaagctttatgagaaactcctttgtgaaacgtgtattcatctcacagagttaaaccttacttttgatggatcagtgtggaaacgctgtttttgtcgaaactgtgaagggatattttggagagcatgaggcctactgtgaaaaaggaaataacatcagataaaaactagaaagaaggtttctgagaaactactttgtgatgtgtgcattgttctcaaagaattaaatgtttcttttgattgagcagtttggaaacactgtttttgtagtatctgcaaagggatatttgtgagcacagggatatttttgtgagcattgaggcctatgttgaaaaaggaaatatcttcatataaaaaataggcagaagcattctgagaaactgctttgtgatgtgtgcattcttgtcaaagagttagacatttcttttgatggaggagtttggaaacatggtttttataaaatctgcaaagggttattatgaagcacattgaggccttcagtgaaaaaggaaatatctcaaaataaaaattagagaggagctttctgagaaactgctttcgatgtgtgcattcatctgccacaggtaaacctttctttctattgagcagtttgaaaactctgtttttgtagaatctgcaaagggatatttgggagtgcaggaggcctatggtgaaaagggaaatagcttcagataaaaaaaaagaagctttttgagaacctgctttgtgatgtatgcattcatctcacagagttaaactcttcttttgactgatcagtttggaaacacttttgtaatataatctgcaatgcgatgttaggtagcgcaaagaagactccagtgaataatgaaatatcttctgataaaaactggaaagaagggttatgagaaacagctttcagatgtgtgggttcatctcacagaattaaaccttcttttgaaggaacagttcagaaacactgttttcataagatacacaaggggatatttgagagtgcattgaggtctgccatggaaaaggaaatatcttcatagaagagctaaaataatgatacctgagaaactgatttgtgatgtgtgcattcatctcacaaagttaaaattttcttgtgatttagcattttggaaacactgttttttatattttggaaaaacaaaggtatatttgggagcacactgaagcctatggtgaaaacggaaatatcatcagttaaaaactacaaagtagctttttgagaaactgctttgtaatgtgtgcattcaactcacagttaaacctgctttttgattgagcattttggaaacactgtttttgtagaatctgcgatgggatatttgggagtgcattgaagcctacggtggtaaaggaaatatcttcagataaaaactagaaagaaactttttgataacctactttgtgatatgtacattcctctcacagagttaaacctttcttctcatagagcagcttggaaacactgttttggtttaatctgtgaggtgatattaagtagcgcaaagaagcctatggtgaaaaaggaaatatcttcagataaaaactggaaagaagactacggagacactgatttgtgatgtgtgcattcacttcagtgtaaaatgtttcctttgatggagccgtttagaaacatccttttgcaaaatctgcgaagtgttattttggagtgcattgaggcttgcagtgaataagaaaatatttccagatcgaaacaagaaagacactttctgagaaactgctttgtgatgtgtacatacacctcccagagttaaacctatcttttgattgatcagatcggaaacactgtttttgtataatctgccaaatgatattaggtagctcatgaggcttatgatgaaaaaggaaataagttcagaaaaaaaactagaaggaagctttctgagaaactttatagtgatgagtgcattcttctcaaagacttataccttcctctgattgagcagtttggaaacactctttttgttgaatatgcaaagggatattttgcagtgcactgaggtctgtcatgaaaaacgaaatatctttggataaaaactagaaagaagctttttgagaaactgctttctgatgtctgtgttcaactcacagagttgaacttgttttttgatagataattttgaaaacactgtttttgtagaatctgcaaagtgatattaagtaacacaaagaggcctatggtgaaaaaggaaatatcatcagattaaaaactggaaaggagctttctgagacactgatttgtgatgtgtgcatacatttcattgttaaatttttcctttgatggagccatttggaaacaccattttggcagaatctgtgaagggttatttggggtgcattgaggcctatggtgaaaaagaaaatatctctagataaaaactagaaagaagctttctgagaaactgctctgtgatgtgtacgttcatctgagagttaaacatttcttttgattgagcagtttggaaacactgtttttgtagaatccgcaaagggatatttgggagtgcactgaggcctatagtgataaaggaaatatcttgggataaaaactagaaagaagctttttgagaaactgctttgtgttggaggcattcatctcacacaggtaaacttttcttttgactgatcagcttggaaacactgtgtttgtataatctgggaagcgatgttaggaagcgcacaaaggcctatggtgaaaaaggaaatatcttaagataaaaactggaaagaagtgttataagtaactattttccaatgtgtgtcttcaactcagagagttaaaattttcttttgattgaaactttcagaagcactgttttcataggatctgcgaaggaatattttggagcacattgaagcatatggtggaaatgggaatatcttcagagaagaactagacagaagcaatctgagaaaattctttgtaatgtgtgcattcatctcacaaagttaaaactttcttttgattgagcagtttgaaaacactatttttgcaatctgctaagtgatattcagtaatgcaaaaaagcctatggtgaaaatggaaatatcctcagataaaatctggaaagaagcattaagagaaaatgctttctgatatgcgcattaatctcacagagttaagtcattctatcagtggaacagattggaaacattgtttttgtagaatctgtgaagggatatttgggagcgcatcgaggcctatggtgtaaaaggaaatatcttctgataaatactagaaataacctttttgagaaacttccttgtgatgtgtgcattgatttcacagagttaaaaattgttttttgattgatcagtttggaaacactgtttttggaaaacctgtgaagtgatattatgtagagcaaaaaagcctgtggtgacctgagaaatatcttcagataaaaactggaaagaagtgttatgagaaacttcttcctgatgtgtgcattcatctaacagagttaaaccttacttatgattgagcagtttggaaacacagtttttgtagaacctgcaaagttatatttgggagcatactgaggccaatggtggaaaaggaagtatcttcagagaactagatagaagctttttgagaaaatgctttgtgctgtggcattcatcacacagagttaaacctttcttttgatggaagagtttggaaacactgcttttgtagattctgtgaagggatatttgggagcacattgtggcctatggtggaaatggaattatcttcagagaagaactacacagaagctttctgagaaacagcttggtgatgtgggctttcttctcacagtgttaaacatttcttttgattgagcagtttggaaatcctgtttttgtagatctgcaaagggacattttggagcacactgatgcctgtggtaaaaaagcaaacatcttcagataaaaacgagcaagaagctttttgagaatctcttttatgatgcatgcattcatgtcacataaacttttcttttgactgagcactttggaaacactgtttttatgtaatctgtgaagagatgttaggtagcataaaaaacctatggtgaataagaaaatatcttcagataaaaaaaaactggaattaagcattatgaaaaactattttctgatttgtgcattcatctcacagaattaaatccttcttttgatggaaccgtttgaaacactgtttttatagactctgcaaaaggatattttggagcacatagaggtgtatggtggaaaaagaattatctacagagaagaactggacagaaactatctgagaaaatgctttttgaagtgtgccttcatctcacagagttacaactttctcttgattgagcagtttggaaacactttttttgtggaatctgtgatgacatatttgggagcaccctgaggtctgtggtgaaaaaggaaatatcttcgcataaaaactacaatgatgcttaaagagaaaatactttgtggtgggtgcattcaactcacagaattaagcctgttttttgattgagcagtttggaaacagtgttcacgtacaatccttgatgggatatttgagagcccattgtagcctttggtgataaaggaaatatctttgcatgaaaacttgaaagaaacttttttagaaattgttttgtgatgtgtgcgttcatctcacagagttaaaactctttattctgagcagtttggaaacactgtttttgcaaaagctgcacagcaaaattaggtggcacaaaatatcctatgataaacaaacaatgaaatatcttcagataaatactggaaagaagctttataagaaactgcattctgaggtgtgagttgaactcacagagttaagtacttcttttgatggaacagtttgaaaaacactgctttttaaagtatgtgaatggatatttcagagcacattgagccatatggtggaaaaggaaatgtcttcagagaagaactagagagaagatctattagaaactgctttgtgatgtgtgcattcatctcacagatttaaatcttgctttggtttatcagttttgaaacactgtttttgtagaatctccaaaggaatatttgggagcactttgctgcctacggtgaaaaaggaaatatcttcagataaaaactagaaagaaactgtttgagaaactgctttgtaatgtatgcattcatctaaaagagttaagctttttttctcactgagcacttttgaaacactgtttttgtataatgtgtgaaatgatgttacgtagcgcaaaaagcctatggtgaacaagcgaatatcttcatataaaacctggaaagaaccataatgagaaactgctttctgaagtgtgcattcattcatctcacagagttaattccttattttgaaggaacattttggaaacactgtttttgtagaatccgccaagggatatttggaagcacatagaagcctatggtgaaaaaggaaatatcttctgataaaaactagaaagaagcattttcagaatctgctttgtgatgtgtgcattcatctcacagaattaaaccttacttttgatttttcagttaggaaacactgcatttgcaggataagcgtagggatatttgggagcccacaaggtctacagtgaaaaaggaaataacttcatataaaaactagaaaggagctttgtgagaaactgcttcatgatgtgtgcattcaactcacagagagaaaagtttctcttgacagagcagaatggaaacactgtttttgcatatctacaaagtgatattaggtatcgcaaaaagcctatgatgaacaaggaaatatcttcagataaaaggtggaaagaagcattatgagaaacttctttctgatgtgtgcattcatctcacagagttaagtcctggttttgatggaacagtatggaaacagtttttgtagaatctgtgaagggatatttgggagcacattgaagcctgtggtgaaaaaggaaatatcttcagagaagaactagacagaagccttctgagaaactcttttgtaatgtatgcattcatctcactgagttaaaactttcttttgattgggcagtttggaaacagtgtttttgtagaatctgcaaagggatattcggaagcacattgaagagtacggtgaaaaatatctcacataaaaactagagaaaatttacgagaaactgctttgtgaagtgcgcattcttctcacacaggttaacctgttttttgattcatcggtttggaaacactgtttttgtagaatcggcaaggggatatttgggagcacaagaggcccatagtgaaaaagggaatgacttcagaaaatactacaaagaaactttctgagaaaccgctttgtgatgtgtacaatcttctcacagtgttaaacgtctctttggattgagcagtttgcaagcactgttttttgtataatctgaaaatggatattttggagtgcactgagtcctatggtgtaaaaggaaatagttcagaaaaacaacagaaagaagctctttgagaaaacactttgtgatacattcattcatctcacagagctaaacttttgttttgactcagcagtttggaaaccctgtttctgtacaatctgcgaagcaatggtaggtagtgcgaaaaggcctatgttgaacaaggaaacatcttcatataaaaactggaaagaatcgttatgagaaactgctttctgatgtgggcgttcatctcaaagagttaaatccttttgatggaacagtttggaaacactgtttttatagaaactgtgaagggatattttgtagtgctttgagacctatagtgcaaaaggaaatatcttcagagaagaacaagacagaaggtatgtgagaaacttgtttgtgacttgtgcattcatctcacagagttaaaattttcttttgattgagtagtttggaaacactgtttttgtataacctgcaaaggtatatttgggagcccaatgagccctatcatgaaaaaagaagtatctttacataaatactagaaagaagctttttgagaaactgctttgctttctgtgaattcatctcacagagttaaaactttcttttgactgatcagtttggaaacactgtttttgtagaatctatgaagggatatttgggagcccacgataccaatggtgaaaaaggaaataacttcagataaaaactagaaaggagctttctaagaaaccactttgtgatgtgtgcattcttctcacagtgtgaaacgtttcttatgattgagcagtttggaaacactgtttttgtagagtctgtggagggataattgggagcacattgaagcttatggagaaaaaggaaatatcttcagatgaaaactagaaagaagctttctgagaaactgctttgtcatgtgtgcattcaactcagagagttaaacctttcttttgactgagtagtttggaaacactgtttttgaaaaatctacacagcgatattatgtagcacaaaaaaaacctatggtgaacaaggaaattccttcagatataaactcaaaagaagctttataagaaactgcttttgatgtgtgtgttaatctcacagagttaagtccttcttttggtggaagagtttggaaactgtttttatagaatctgtgaagggatatttgggagtgcgttgaggcctgtgctggaaaaggaaatatcttcagagaagaactggacagaaactatctaagaaactgttttgcgatgtgtgcattcatctcacaaagttaaaccttttgtttgatcagtttgtaaacccttttttttacagaatctgtgaaggcatgtttgggagtgctttgaagtctatggtgaaaatggaaatatctttggaaaaaaagtagaaagaacctttttgagaaactgctttctgatgtgtgcattcatctcacagagttaaacctaacttttgacagatcagtttagaaacactgtttctgtagaatctgtgaagaggtatttggaagtgcaccagacctatggtgaaaaaggaaataatgtcagataaaaactagaaagaaactctctgagaaaccagtttggttgtgtgaattcatctcacagagttaaacgtttcttttgatttagcagtttggaaactctgtttttgtagaatctgcaaagggatatttgggagcgcactgatgcctatggttaaaaaggaaatgtctacggatagaaacgagtaagaaggtttttgagaaactgctttgtgatgtatgcattaatgtcccagagtagaacttttcttttgactgagaagtatggaaacactgtttttatataatctgcaaagtgatgttaggtagcataaaaaggattatggtgaacaaggaaatatcttcagataaaaactggaattaagcagtatgataaactgctttctgatttgcatcttcatcttacagagttaaatccttcttttgatcagccagtttgcaaacactgtttttataggctttaagaagggataattgggagtgcgtagaggactatggtggaaaaggaaatatcttcagagtagaactagacagaagctatctaagaaactgaattgtgatgtctgcattcatctcacagagttaagcctttcttttgattgagcagtttggaaactgtttttgtagaatctgcaaaggtatattttggagagccctgaggcctatggtgaaaaaggaaatatcttcacataaaattacaaggaagtttttgagaaactgctttgtgttgtgtgcattcaactcacagagataaatctgttttttgattgagcagttcggaaacagtatttgtgaaagatctgtgacaagacatttgggagtgcattgaagcctattgtgataaaggaaatatcttcgggtgaaaactagaccgaagctatctgagaaagagctttgtgatgtgtgtattaatctcacaaggataaaccattcttttgattgagcaatatggaaacactgttttgtagaatctgcaaagggatatttgggagcacactgaatcctatgatgaaaaaggaaatatctttggacaaaaacgagaaagaaactttttgagaaactcctttgtgatgtatgcattcatcttacagaggcaaatttttctgttgactcatcagtttggaaacactctttttgtataaagtgcaaagcggtgtatggtagcataaaaaggcctatggtgaacaaggaaatatcttcagataaaaactggaaagatgcgttatgagaaactgctttctgacgtgtgcattcatctcatagagttcaatgcttcttttaatggaacagtttggaaaagcactgtttttatagaatctgcaaagggatatttgggagtgcattaaggaaagtggcggaaaaggaaatatcttcagagaagaactagacagaaactatgtgagaaactgctttgtgatgtgtgcattcatctcacagagttaaacctttcttttcatggaacagtttggaaacactgtttttgtagaatctgcaaaggtatatttgggagtgccctgaggactatagtgaaaaaggaaatatcttcacataaaattacaaggaagctttttgagaaactgctttgtgttgtgtgtgtccaactcacagagataaatccgtgtttttattgagcagtttggaaacactgcttgtgaaaaatctgtgacaagatatttgggagcccattggagcctattgtgagaaaggaaatatcttcggtgaaaactaggcagaagctatctgagaaagagctttgtgatgtgtgtattaatctcacaaggttaaaccattcttttgattgagcagtttggaaacactgttttgtagaatctgcaaagggatatttgggagcataatgaatcctatgatgaaaaaggaaatatcttcggataaaaactagaaagaaactttttaagaaactcctttgtgaagcatgcattcatctcacagaagtaaacttttcttttgactcatcagtttggaaacactctttttgtataatgtgcaaagcaatgtttgtataatgtgcacagcaatgtttgtataaggtgcaaaaaagcctatggtgaacaaggaattatcttcagataaaaaatggaaagatgtgttatgagaaactgcttctgacgtgtgcattcatctcatagagtttaatgcttattctaatggaacagtttggaaacactgtttttatagaatctgcaaagggatatttgggagcgcattaaggaaagtgatggaaaaggaaatatcttcagagaacaactagacagaaactatgtgagaaactgctttgtgatgtgtgcattcatctcacagagttaaacctttcttttcatggaacagtttggaaacactgtgtttgtagtgtctgcaaaggtatatttcagagtgcactgaggcctattctgaaaaaggaaatatcttcaagtatgaagcagaaagatacttttagagaaactgctttgtgatgtatgcattcaactcacagagttaaacctgttttttcattgagcagtttggagacatttttgcagaatctgcgtcaggatatttaggagtgtgttgaagcctatggtgataaaggaaatatcttctgataaaaactatcaagaagcattttgagaaactgctttgtgatgtgtgcattcatctcacagagtcaaacttttcttttgactgagcagtttggaaacattgtttttgaaaactctgtgaatcaatattaggtagcacaaaaaagcctatggtgaaaaagtaagtatcttcagataaaatctggtaagatgtgttatgagaaactactttctgatgtgtgcattcatctcacagagttaattccttcctttgatggaacagtttggaaacagtttttagatctgctaaggggtatttggcagtgcatagaagcctatggtaaaaaagaaatatcttcagataaaaactgggaagaagctttctgagacactgatttgtgatgagtgcgttcaatgaacagtgataaatctttcctttgatggagccaattggaaacacctttttggtggaatctgcaaagagttctttgggagcacatttaggcctatggtgaaaaaggaaatatctccagatgaaaaccagaaagaagctttctgaaaaactggtttcttatgtgaacattcatttgacagaatgaaacctttcttttgattgagtagtttggaaacaatgttttggtagaatctgtgaagggatattttggagcacaatgtggcctacagagaaaaaggaaataactttggataaaaactacaaagaagatttatgagaaactgctttgggatgtgtgcattattctcacagatttaaacctttcctttgattgagcagtttggaaacactatttttgtagaatccacaaagggatatttgaaagcactgttaagcctatggtgaaaaaagaaatatattcagataaaaactagaaagaagcttattgagaaactgctttgtggtgtgtccattcatctcacagagttaaaactttcttttgacagagcagtttggaaacactgtttttgtgtaatctgcaaagtgatacttgtgagcgctttgaggcctatggtgaaaaaggaaatatcttcacataaaaactataaaaaactttctgagaaactaatttgtgatgggtgtgttcatctcatagagttcaacgtttctttcaattgagcactttgaaaacagtcttcttttagaatctgcaaagggatatttgtgagcgctttgaggcctatgctgaaaaaggaaatatcttcatataaaaactagacataagctttctgataaacttcttcatgatatgtgcattcatctcacagagttgaaactttgttttgattgagcagtttggaaactctctctttgtagattctgcaaagggatgtttttgagcactttgaggcctatggtaagaaaggaaatatcttcatataaatactagacagaagctttcttagaatcacctttgtgatgcatgcactcatcttacagagttgaaactttcttttgaatgagcagtttgcaaacagtctttttgtaggaccagcaaagggatatttgtgagtcctttgtggcctacagtgaaaaaggaaatatcttcagataaaaaccagacagaagctttctgagaaacttctttgtgacgtgtgcattcagctcccagagttgaacctttattttgattgagcagtttgaaaaccgtctttttaggaatctgcaaagggatatttgtgagtgctttgaggcctatggtgtaaaaagaaataccttcacataaaatttagacagaagtgctcagaaacttctttgtgatgtgtgcattcacctcatggagttgaacatttcttttgattgagaagtctgggaactgtattttgtaaaatctgcaaagggatgtttgagtgcactttgatgcctatgttcaataaggaaatatcatcacataaaaaccaggctgaatctttctgagagatttctttgtgatgtatgctttcatctcacagagttgaaccttcctatcattgaggagtttggaaacagtctctttgcagaatccaaaaagggatgttttaagccctttgaggtctatggtgaaagaggaaatatctttacataaaactagacagaggctttctgagaaacaactttgtgatgcgtgcattcatctcacagagttgaaactttcttttgaatgagcagtttgcaaacagtcttcttccaaaatctgcaaatggatatttgtgggccctttgaggcctgtggtgaaaaaggaagtatcttcacataaaaacgagacagaaactttctgagaaacttcttagggatgtctggattcatctcacggagttgaaactttcttttgattcatctgtttgaaaacagtcttttttaaaatctgcaaagggatatttttgagcactttgaggcctatggtgaaaaaggaaatatcttcacaaaaaatctagacagaagctttctgagaaacttccttgtgatgtgttcattcttctcacaaggttgaaacttttttttgattgagcagtttgaaagccatcttcttgtacaatctgcaaagggatacttgtgagcactttgaggcctatgatgaaaaaggaaatatcttcacataaaaactaaagagactttctgagaaacatctttgtgatgtgtgcattcatctcacagtgttaaacctgttttgtttgagcagtttggaaacagtcttgttgtagtaaccacaaagtgacatttgtgagcccttggaggcctacggagaaaaaggaaatatcgttacatagaaaagagacagaagttttctgagaaactgcttcatgatgtgtgcattcatcccactgaagtaaacatttcttttcattgagcagattggaaactctgtttttgtagaatctgcaaagggataattgtgagcgctttgaggcctatgttgaaaaagtatataccttaatatttaaaccagacagaagctttctgagaaacttctgtgtgatgtgtgtattcatttcacagagttgaacctttcttttgattgagcagtttggaaacagtctttctgtagaatctgcaaatggatgttttgtgagccttttgagccttatggtgaaaaaggaaatatcttcacataaaaattagacagaacctttctatgaaacttctttctgatgagtgcattcatctcacagagttgaaactttcttttgattgatgatcagtttggaagcactctttttgtagaatctgcaaaggggtatttgtgagtgctttgaggcctatggtggaaaagaaaatatcatcacataaaactatacagaagatttctgagaaacttcttggtgatgtatgcatttgtctcacagagttgaaattttcttatcattgagcagtttggaaacaatcttattgtagagactgcaaagggatatctgtgagtgctttgaggcctatggtgagaaacgaaatatcttcacataaaatatagacggaagctttctggaaactgccatgtgattgtgcattcatctcacaaaggtaaatgtttctattcattgagcagattagaaaatctgttctcatagaatctgaaaagtgatatttgtaagcactttgaggcctatggtgtaaaaggaaatatcttcgcataaaaactagacagacactttctgagaaactactttgtgatgcgtgaattcgtttcacagagatgaacttttcttttgaatgagcagtttggaaacaatccctttgtagaatctgcaaagggatatttgtgagcccttgcaggcttatagtgaaaaaggaattatcttcacataaaaaccagacacaagctttctgagaaacttctctgtgatgtgtgcattcacctcacagaattgaataattttttttattgagcagcttgaaaacagtcttcaggcggaatatgcatagggatatttgtgagcactatgaggcctttagtgaaaaaggaagtatcttcacataaaaactgggcagaatgtatctgagaaactgctttgaggcgtgcattcatctcactgaagtaaacgtttcttttcatttaccagattggaaactctgttcttgtagaatctgtaaggggatatttctgagtgattttagacctatggtgaaaaggaaatatcttcacataaaaactagacagaagctttctgagaaatttccttgtgatgtgtgcattcacctcacagagatgattctttccctgattgagcagtttggaaacagtcttttcttacaatctgcaatgtgatatttatgagtgatttgaggcctatgtgaaaaaggaaatatctgcacataaaaactggagagaagcattctgagaaactgctttttgatgtgttcattcatctcacagatttgaagctttcttttgattgagcagtttggaaacagtctttttgtagaaactgcgaactgatatttgtgagcacgttgaggcctatggtgaaaaaggaaatatcttcatgtaaatactagacagaagctttctcagaaacttcattgtgacgtgtgcattcatctcactgagatgatcttttcaattgagtagtttggaaatagtctttttgtagaatctgcaaaagagtatttttgagccctttgaggtcaatggtgaaaaatgaaataacttcacataaaaacttgacagagctttctgagaaactgctttgtgatgtgtacattcgtctcacaaaggtaaacgtttcttttcattgagcagattggacactctgctcttgtagaaactgcaaattgatatttgtgagccctttgaggccagtgatgaaaaaggaaatatcttcacataaaagctagacagaagctttctgaggaacttctttgtgatatgtgcattcatctcacagagttgaacctttcttttgattgaatagtttggaaacagtctttttccagtatctgcaaagggacatttctgagccctttcaggcctatgattaaaaaggaaatatcttcacttaaaaactatacagaatgattctgagaaactgctttaagatgtgtgcattcatttcacacaggtaaacgtgtctttttaaacgtgtcttttcattgagcagattggtaactctgctattgtagaatctgcaaagggagaattgtgaatgctttgaggcctatggtgaaagaggaaatatcttcacatataaactagacagaagctttctgagaaacttctttatgatgtgcgcattcatctcacagtgttgaaactttttttcagtgagctgttgggaaacagtctttttgtagaatcagcaaaatgacatttgtgagccctttgaggcctatggtgaaaaaagatatatctttacataaaaaccagacagaaggtttcttagaaactgctttgtgatgtgtgcagtcatctcacagagttgaacatttcttttgatggagcagcttggaaactctttttttgtagtatctgtaaagggacatttttgagcattttgaggcctatggtgaaaaaggaaatatcttcagataaaaactataaggaagctttctgagaaacttctttgtgatgtttgcattcatctcacagagttgaaactttcttttgatggagccatttggaaaaagtgtttttgtagaatctgcaaagggatatttgtgagacatttgaggcctatgttgaaataggaaatctcttcacataaaaactagacagaatgtttctgagaaactgctttgtgatgtgtgcattcatctcacagatttaaaagtttcttttcattgagcagattggaaactctgttcttgtagtatctgcaaagggatatatgtgagcactttgaggcctatggtgaaagaggaaatctcttcacataaaagctagacagaagctttctgagaaacttctttgtgatgtgtgcattaatcacacagagttgaaagtttcttttgattgagcagtttggaaactgtctttttgtactatctgcaaagggacatttgtgagtggtttgagggtgatggtggaaatggaaatatcttcacataaaaactatacagatgctttctgggaaacttcttcatgatgtgtgcatttgtctcacagatttgaacctttcttttgattgagcagtttggaaacagtctttttgcagaatcagcaaaggaatatttgtgagccttttgaggcctatggtgaaaaaggaaatatcttcacataaaacaatacagaaagtttctgagaaactactttcagatgtgcatattcatctcacagaggtaaaagtttcttttcattgaagagattggagactctgttcttgtagaatctgcaaacggacatttctgagtgctttgaggcccctggtgaaaatggaaatatcttcacataaaaactagaaagaagttttctgagaaacttctttgtgatgtgtgctttcatctcacagatatgaactttcttttgattgagcagttcagaaacagtctttttgtagaatctgcaaaggaatatttggagtgtgtttaggcctatgctgaaaaaggaaatatcatcacataaaaactagagagaagctttctgggaaaatactttaggatgtgtgtattcatctcacagagttgaaactttcttttgatcgaacagtttggaaacagtctttttgtagaatatgcagagtgatatttgtgagcggtttgaggactgtggtgaaaaagaaaatatcttcatataaatactagacagaagatttctgagaaatttatttgtgatgtgtgcattcatctcacagagatgaatctttcttttgattgagcagttttgaaacagtctttttgtagagtctgcaaagggatatttgtgatccctttgagcctatggtggtaaaggaaatattttcacataagaactagacagaagctttctgaaaaacttctttgtggtgtctgctttcatctcacagagttgaatctttctttcgattgagcagtttggaaacactctttttgcagaatctgcaagtggatatttggagagcttttaggccatggtgaaaaaggaaatatcttcacataaaaactagacagaaaaattctgagaaaattctttgtgatgtgtgcattcatctcacagagctgaacatttgttttgattgagtagtttggaaacagtctttttgtagattcttcagggggatatttgtgagcagtttgaggcctagagtgaaaaaggaattatcttcacataaaaaccaaacagatgctttctgagaaacatctttgtgatgtctgcactcatttcacagagttgacctttcttttgtttcagcagtttggaaacattttttgtagaatctgcaagggatatatgtgagcccattgatgcctatggagaaataggaaatatcttcacataaaaactagacagaagctttctgagaaacttctttgtgatgtgtgctttcatctcacagagttgaaactttcttttgattgagcagtttggaaacagtttttttttgtagaaattgcaacgggatatttgtgagctatttgaggcctatgttgaataaggaaatatcttcacataaaaactagacagaagcattcaagtaaacttctttgtgatgtgtgcattcatctcacagagttgaacacctcttttgatggaagagtttggaaactgttgttttgccgattctggagaagaaaatttgtgagtggtttgaggcctatggtgagaaaggaaatatcttcacataaaaaccagacaaaatctttctgagaaacttctttgtgatgtgtgcattcatctcacagagttgaacatttcttttgattgaacagtttggaaacagtctttttctagattctgcagagggatatttgtgagtggtttgaggcttatgatgaaaaaggaaatctcttcaaatgaaaactacacaaaacatttttgagaaaattttttgtgatgtttgcattcatctaacggagttgaaccttccttttcattgagcagcttggaaacagtcattttgtacaatctgcaagggatatttctgagcagtttgaggcctatggtgaaaagaaatatcttcacataaaaatcagaatcattctgagaaacttcttggtgatgtgtgtattcatctcacagagttgaaactttcttttgattgagcagtttggaaacagtctttctgtagaatctgcaaatggatatttggagcactttgaggcctatggtgaaaaaggaaatatcttcgcataaaaactggacaaaaactctctgagaagcttctttgtgatgtctgcattcatttcacagagtcgaacctttctttgtttgagcagtttggaaacagtattcttgtatattctgcagagggatatttgtgagtggtttgaggcctatggtgaaaaaggaattctgagaaacttttttgtgatgtgtgcattcattttaaagagttgaacctttcttttgattgagaagtttggaagcagtctttttgtagaatctgcaaagggatatttgtgagtccattgaggcctgtagtgaaataggaaatatattcacataaaaactaggcagaagctttctgagaaacttctttctgatgtgtgctttcatctcacagagttgaacctttcctttgattgagcagtttggaaacagtctttttgtagaatccacaaatggatatttggatagctttggggcctccagtgaaaaaggaaacatcttcacataaacactagacagaagctttctgagaaacttctttttgatgtgtgctttcatctcacagagttgaacctttcttttgattgagcagtttggaaacagtctttttgtagaatctgcaaatggatatttgggtagctttggggcctccagtgaaaaaggaaacatcttcacataaacactagacagaagctttctgagaaacttctttgtgatgtatgctttcatctcacagagttgaaacttttttttgattgaggagtttggaaacagtttttttgtagaaattgcagtgggatatttgtgagtatttgaggcctatgttgaataaggaaatatcttcacataaaaactagacagaagcattcagagaaacttctttgtgatgtgtgcattcatctcacagacttgaacacctcttttaatggaggagtttggaaactgttgttttgcagattctgcagaaggaaatttgtgagcagattgaggcctatggtgagaaagggaatatcttcacataaaaaccagacagaatctttctgagaaacttctttgtgatgtgtgcatccatctcacagagttgaacctttcttttgattgaacagtttggaaacagtctttttctagattgtgcagacggatatttgtaagtggtttgcagcctatgatgaaaaggaaaactcttcaaatgaaaactacacagaagctttttgagaaaattttttgcgatgcttgcattcatttaatggagttgaacctttcttttcattgagcagcttggatacagtcgttttgtacaatctgcaaagggatatttctgagcggtttgaggcctatggtgaaaaagaaatatcttcacataaaaatcagaagcattctgagaaacttcttggtgatgtgtgtattcatctcacagagttgaaactttcttttgattgagcagtttggaaacagtcttattgttgattctgcaaagggatatttgtgagcccattgaggcctatggtgaaatggaaaatatcttcacatcttctgttggctagactaaatatcctggggatgaattccattgttgagagattacttctatcatgtactaagcatgaacgggctcacagaagaaacacaggggcttctaaatttggatgactcaaacagtaatatccgaataaccattttacaatgtgttaggaaaattgagcacggtgtaccttttgtatttgctgaaatattttatttgattgtacccttaggaggaatgaatgttttgtggacctgtgccatacctagtttctgtaagaaatgcagttggacataagtcagagatgagttttacttcactgccatcatcatgatttaatcatttatcatagataacattgttaagggcttaatatatgtcaggaactgtatttattttaatggtatttgtactttctaatatcactgtggagtacatgttcctattacctctcccttagagaagttcagtgaccagttaatggcacagaactcataatagtagtgccggaatgtgacagtagattgaattcagaatacatctttttagccattatgttatgctatagcattttccaaaataataatgtaactcaggactacagatttgtttatcaggctggtctttgacgaactctagctgatgaatcatgatgatgaaatattggctgattcatttgaaaaatattgagggtagttcaaatttgctgaataatatttttaagttgttcctcaccaattgctattaaaaccttaaaggatcctggccataaatcaaggctatattttgtattaaacaaatccaggaatgctatatgaaagtggctatatatttgtcataaatacaattaatatagataaaaaatgacatatttaatcaagcaagattatggacattatatagtgatttattaattttcttctctattcatgcatcaacttcatgaactatggctattacaagccgagaactgagaaaatcagatcacaaatcatcagaatggatctcatttgaaataattcaaggaattttaagggattcttccgatgtttacttctcttcaacttaatgaaataccatatacctaacagatacatgaattaacatatgagtgtcctacttataaaacctctttcttgtagggattttaggccttgagtgatcctggtagatgcacattaaattcatttaatttgggtttatatgtctgtttttgtttttctctagaaatcagagtccataatttttgtgtcagtggcacctagctagctagccaacaacctctctttcttctgacttccttttcttaattaccttacagttccctcacagctacttggaaatttgttttgaggacactttcatcttagtttctttgcagatgttctctaatgtgtgctgtaatggctactggtgctcaaggttccctcctttactcctttctcattctgttgtgtttaatttggcttagctcactgtatcactgtggcgtcaacttctgcttacatactaatgtctcacactccaacctttaaaaaaattacatgcatagctttaagagggagatgtaactatgcttttttctccttcttttctttgtgtaaatataaggtgtacaaatgcagttttgttaaataaatatattgtgtagtcatgaagtctgagcttttagtgtaatccacacctgaataatgcacactgtacctgttacattgggttgtttaaatattttacatatttttttaatgtacagaagttttaaattgtagttggttgagtctttcagccatctcacatttaggctctgtgaattccactcggagacttccacagaaggggagagaactttgtacttattgggcttccaatttttacaagttttaaactaattcatcctcacaaatcacttcatgagataaataagggagttatttttactcatattttatatttgaggaacctgaggatacacggtataaaacagtacaaaaaacaattagagatcatagcaccttttaagcactcaataaatagttgtataatgtaaatatgacacaaatttgtaggtttcctttccttgaccaagaaattttagattcactcttggcagatcctgagaaagtttgtaataaaatccaggaataaaagtagttgataaatccagcggggccaacctctgacatatcctgactatggtaaagtgttgcacctcaatcagtaaagatagaagttctagtattttccatcccattttcatgtaactgaatgagccttacctgagcaaggactatatggccttctcatcgtatctgtgtatttacccaggattaacatatttgtgttgttaaagttagatttcattaactttatttctgcaaacttataggtaaggtgaactgccttttaagaaaaattaagtgggttggcaaaatttggcaattattctcctacttgcatgttttcattagaagtggtacagaagggtttttttttcctgaggagtgaaatataggttgtattttccattttctatgggttcctatgatgaaataataggtttggatattagcatttgaatacgtacttaaaatgctatacaatgctattccctcattggcacatgctctgactcattttaccaggttactgattacaacctcaaagataaaatcgggtattataatgcacttgaaggcatttagaaaaatataagatattacacatgataaatagacagtatatatatggatggtctaatttttaaatatttatctttatatatagttttgaatatacagtttggtacacagataaaaaatttttaggagtgttagatttttagaagaatttttttttctttatttggcatctggtttaagacagttggcattttcaacacaattcagcatctctgattagaacttcagaaaattgtaatgtagatcagtgatctatagtatttatatgacaaggagcttaaaatgagccgtttagtttaaatatacatgaattttaattgcttcttcaaagagaatcatgttatttttgtgtttccctattatatcttttgtgatacaactgaagaaataacccaaggctccaataaaaatgtaaaatataacttaacaaaaactgatttttcttctggaggtactatttgcctctagcaaaaaaaataatgtttttcttaaccaataaatcctagtataggcacctgggggcagtaaatcttcactatctacaactcaaattcgggaaattaattctttccagtaaaaagctatcatcagaagaggaagataataggaactcctcaccgtcaattttcattttaagaggaagtcatcaattcaggcactttgaacaacagaaacaatattcccagtccccttcatttcggcaatggttccttgttaaagaaatagttaaatctttcctttgcctagacatcgcttcttgctacttgcattatctacataatggatgtgttatcaaagtaatacatagttactttgcattttatgtgctaaatgaaacatttgtaacttcccgtgaaccgaaatttggagtgattgatttattatgaacttggaagagcttacactcactttaagagaactacatgcatggatatatttaataaatcatatgacaccactgttagtttgctttgttattaatgtcatgtccaccccccacatccagtaattcctctcttgatttacgcagttaaaaatgcttgaggccagattgctaaaaccataaacatatcaggaatatacatataatcctattatcccatttgatctgattcaatctcatccccatgaaataaggagatttagatttagcatggactattctaaggctcagaaatatgtgccatgataatcagagaaggggattttaaatgattatttcaacatattttagcattttatctttcagtttattaaaaattgtctttggtaagtaaatgatgttcccaataaagtagtatcagcattattttcaatatagttatggctactaaacatattttccagccagcatttcacaaaataggttatagtaagtatgtgaaataacgttgtttttggtatgtagagaagacctagcgagacattcagtatgtctgattgatttttatgcctcttgggttgctcagaaaatgtgcatcttgttttagttttgaaacagtggtccttaaaggcaatactggttttcctgtacacttgtgggaaacatctacactggtttgtggctgcctaggacatgtctatcgggtagcaacaccatcccagtgttgaccaggatgaatttcagagagcaaagcggaagatcctcttctctgctctcagagagcatagctttctctcagagaccacaacgcagaggaaaattagaaagaatgatagattttctgcttgaagtgaggtttttatcagatcttcatcaggttagactgatcagaagatcaatgtgtggtctacagtttttgtctgcattaaattacacattatttcatgtgctgttgttttaaattatttcctccttcccaatctagtgatatgaatatgctttatttcctaaagccattaaatctctaatatgaggtttccttcctatgtttccacatttatcaaatgcccagcctttaaattttttaagtggcagtggaaattctaaattaccatagtttatataattgagagaatttttttctctcagataatataatagaagagtctccacattgacctggattagaataagcagatgggcattttctaaaatttcttttgcagtttttaaacaattagctttagttacaaaagaagttgcaagtttttgtctatctagtcagataaagtggatgggtgagataattgtctgataagataagcaatgaccaccctaacccccttataggtacagacatgcaggttttttgacctgatttaattgaaatctaaatatctaaatggatcacattcagtagatgaacactataatttgtgcttcactatgcattttcagacaggtcaagtgggaggaccaaagcaaaacatagaaagcttctcccctaggatttgcctacctactctcttaggtaacttagtcttttttactgagctcttttaaagaagatgcttgctgttaaaatacttcttttatttaaagaggcatgtaaccaggccagtggaaaattcaagcgtggtccctaggcatgtgatagcttcaaaggactggtggtccccagagactgaattttcaactttgttaggccagaaactcaattccattattaaacatagatttgatcttactcaggggagctgactcatgctaatgaaactcataagagacttatcatgagccagaaggtgagttcataattaattcataattagaaatagatctgcgaagaggaaggaaatacagctggtcagcacattctctcccagaaagaaaatttacttgcaaatgcaaaaaggtggcttggtggctacagagccagtggaaagagggctgaataatattagtggacagttttatgtatttacactattttcatattccattttccttacagaaaacagactgtgattttccttttcacagcatggagtaccttctaagcttaaaagacactaacccaagtttgctctttggatcattttaaagtcagttttattacagtataattgaatgactaatatttctttacatgaacatgttatgtttagagcatcttgtgaatatagcttgatctttttgatggagactagaagaaacttcatttcaacaagcaataacatatttacaaatcatttctaagaatgagttcctacaagagtgactagtttctcattttacaatgattttaattactttcaatctcagagtatacactctcctaacttaggtgtcatatcttggaagagacactaatattttataaacatttatgttgacatgactattctgtatcaataatcaaccccactggaaaatgaaatattaatcaatgctcttcttatatactttaaggcattgcaaagaaatgccttaaagtatataagagcatactggggttcttgctatcttcagatattttgtgatgtttgtcccgcagcacccatgtgacatacgatagagaaaagaacagaagtgtccagtgtggagagtttaagtttctttccctggctggtgatacattccatgtgtgttcaatgggcactgactattagtgagataatactgataaggtgaggatagaaaggaatgacaactttaattcctactcacaagaaactgacaaatatataatgcaaattttgttcaataaaaatacaaatataattaaaactagtaaaaatataattttctctcttttgggtgacttagaaggaatcctagaggctgtgtcatgaatatacattatcaccctaggcagtagcaatctaatatacattagatagcatgctacatttaaaaacgtgatacagaaaatcaaggggagagagagaaagagagagaagaaggtaattctattagtaggcagcttaatggcaagttctagcacattcacaggtaatttataaattaaaatgtataaattataaattgagaaacaccaataaattccaagaaatttagttctgtcttataaaaagattatgtttaaaaaataaaaaaattaacatttttttgaaatttgatgggcttacagaaaatgagatgattaaaatacatttgaccttaattttgatcagaatttccttaatcataataaaagttttgctgaagtttatatttaatattttatgaaataatattttggaaataattcctgattatttaaaaatgccatacaatctagtgctggggttttatttagctatttaggtttaataaatttttaccacggataattgtagtatgtgaatctgattttgttttaaccacacagctaagaattttaaaagagagattatttttaattcttgcaaattcttcttacatattcaggcttaaaacacaatcatgcctaacacatatatatctaatatatatatctaatatatatatataatatatataaactacgaatttctttgtaaacactaccttagctgtattccacatattttacatattttgctttcattttcattcatgtcaaaatattttaaaaatatatacacatataaaaatatgagagccattttatatgtatgtttatatataaacatatacatatgtttatatatgtatatatataaacatatatatacatatatacatatataatacatatataatacatatatatacatatatatacatatataaaccatttttatatacatacatacatatatacattttatatacatacatatataaagccattttatctgtattgttatatacatataaaatatacagatatatatacatacatataaaattattttccattaataatagagcccagaggataaacattttacacatatacagtatgtatttagatatgtaactatttatatgtataaatactttcatatatatttatatacatgaatacatataaatacatatagtctgtcctctggcctcttctattaatggagagccatttggtagttgtaataaagcaaatacttccatccatactctgttttagtgagggtggatgtcctttcccagaggaaaggacaagcaaaggttggacctgacagttcacactcctggcaacccacactatcagagtttcgctcccacacctgcttgccgcatccctaaccccagctctgtgatattagcggctgctgttggcatctctccaatgtaaggcatttcaagttttggggtgaaaagtcttttagataatagaagtgttgtagtgaatatgcgctttagaaaagaaagtagaaaggagtatgaaacagctttccctatcctgtctgattcattctataatcagcaaaaagtgcatgaggaaactcaacaaatggttctatttactcttgtcttctttacgttccactctccaaaatcgtaagaatacctttgtgtaaattttgctcttattcaggtaaaatatgtttaaaaatctgatgcgtgggaagtggtctggtttaaaagaattcaataacatcaacaacattttaaccctctgctataagtgtgtacaactctgtcactgtgcttattgttttatgtgatctggacttaaattgggtcctcatactactgtatacattttcttcaaggtcagagagacagtgacttctaaatagaatgatatctccctttcttcttagttctggactgtagaattctgctcaggttgcatgaatcagccaatgctgattaaacatctatttgaagagtgagtacaaatcttcacacttgggcttggactaaggaaaaaatatttataaattcatacacagcagaatgaccaactctggatacagggacactctttttttcctcagtattacaattgcagtttgatatttttaatcaatatctcattttttatattgcatccaatttaggagaaagaaaataatttgtattgattaaaaactctttcactctcttcttcaaacagaaggaaaagttgttggcaacacaacggactgcatctagaaaataatttattattattattattattatatcattatttttgagacggagtttacctcttgtcacccaggctggtgtgcagtggccagaattcagttcactgcaactttcaaccaccgggttcaagcgattctcctgtctcagcctccctagtagctagtagcctgccaccacctctggctaatttttgtatttttagtagagatggctttcgctatattggcaaggctggtctcgatctcttgacctcaggtgatccgcccatctctgccttcaaaagtgctggattacaggtgtgagccaccttgcctgcaatgatgatgttgcaggtaaagcagagaaagaggaaatggaaaagaaaatgagataaattaaaagttgttgacggcataagatttgctggtggagataaaagtgtgcacacactcaaaattttgtgccaggcagatagagagaggttagggcctaaaacacattgctttgcttatccactgctctttaaaactctgtctaaattagtggctgaaaacaactgactagtcctcccttgagatacgtcctgtagttgtgatcgtggcaactggatctggagccatttgctggctgtgggctgggcatccaagatggcttcttttcacacgtctcagggtttttctagtgcttcactttccagcagaaaagtctgggtcctttgtttgtttgtttgtttcttaaaataactttactgggctatagtttatatatcaaaaatatcatctattttgaaagtacaagtcaactatttttagcagaaaattataattatacaaaaatcaccacaaccaagttttcaaatattttaatcatctcaacaacttcctgcgagcctgttttcttagggaggaagccaagtttattattttgagagttttttattgatacagatgtttcaaactataaatttctttgtaaacaccacttcagcagtattccacacattttacatatgttgctttcattttcattcagctcagaatatttttaaaaagtttcctgcaattttttctttgactcttgggttatttagaagtcttgtttaattgttaaatatttgtgtgtttttcagtggtttctgttgtaaagctctaatttcattctgttttcatcagagagcttattttgtgttatcgcagtcttttaaaatttatgggcttgttttgcagctggtagttttgtagaaaagaatgtgtattctacaatcactggatggaatattctgtaaatgtcagtgtgtccctttggctgattgagttgctcaagtcatcctctctgttattctgtcagttattgaaaacacgctattgaaactccccactattattgttgaaatgtccgttctttcaacttggtcagtcttcatttcagggctccaatttttgtgactctgctgttctgcttgtgtaagtttatagttcgtatctctgatgctttttttattttttttatttttattatattttaagttttagggtccatgggcacaacgtgcaggtttgttacatatatatacatgtgccatgttggtgtgcagcacccattaacacgtcatttaacattaggtatatctcctaatgctatcccttccccctccccccaccccacaacagaccccagtgtgtgacgttccccttcctgtgtccatgtgttttcattgttcaattcccacctatgagtgagagtatgcagtgtttggtttttttgtccttgcaatagtttaccgagaatgatggtttccagcttcatctatgtccttacaaaggatatgaactcatcctttttcatggctgcatagtattccatggtgtgtatgtgtcacattttcttaatccacagtctatcactgttggacatttggcttggttccaagtctttgctattgtgaatagtgccacaataaacctacttgtgcatgtgtctttatggcagcatgatttataatcccttgggtatatacccagcaatgggatggctgggtcaaatggtatttctagttctagatccctgaggaatcgccacactgacttccacaatggttgaactagtttacactcccaccaagagtgtaaaagtgttcctttttctccacatcctctccagcacctgttgtttcctgacttcttaatgatcgccattctaactggtgtgagatggtatctcattgtggttttgatttgcgtttctctgatggccagtgatgaggagcattttttcatgtgtctgtcttttggctgcataaacgtcttcttttgagaagtgtctcttcatatccttcgcccactttttgatggggttgtttgtttttttcttgtgaatttgttggagttcattgtagattctggatattagccctttgtcagatgagtagattgcaaaaattttctctcatcctgtaggttgcctgttcactctgatggtggtttcttttgctgtgcagaagctctttagtttaatgagatcccatttgtctattttggcttttgttgccattgtttttggtgttttagtcatgaagtccttgcccatgcctgtggcctgaacagtattgcctaggttttcttctagggtttttatggttttaggtctaacatttaagtctttaatccatcttgaattaatttttgtgtaaggtgtaaggaagggatccagtttcagctttctacatatggctagccagtattcccagcaccatttattaaatagggaataatttccccatttcttgtttttctcagatttgtcaaagatcagatagttgtagataagtggcattattactgagggttctgctctgtttcattggtttatatcgctgttttggtaccagtaccatactgtttgggttactgtagccttgtagtatagtttgaagtcaggtagcgtgatgcctccagctttgtaggtagtttttttccaattctgtgaagaaagtcattggtagcttgatggggaaggcactgaatgtataaattattttggtaattatgggctttttcacgatattgattcttcctactcatgagcatggaatgttcttccacttgtttgtatcctcttttatttcattgagcagcgttttgtagttctccttgaacaggtccttcacgtcccttgtaagttgcattcctgtgtattttattctctttgtagcaattgtgaatggaagttcactcatgatttggctctctgtttgtctgttgttggtgtataagaatgcttgtgatttttttacgttgatttgtatcctgagagtttgctgaagttgcttatcagcttaaggagattttgggctgagatgatggggttttctagacacacaatcatgtcatctgcaaacagggacaatttgacttcctcttttcctaattgaataccctttttttccttcttctgcctgattaccctggccagaacttctaacactatgttaaataggagtggtgagagagggcatctttgtcttgtgccagttttcaaagggaatgcttccagcttttgcccattcagtatgatattggccgtgggtttgtcatggagagttcttaatattttgagatatgtcccttcaatacctaatttatggagtttttagcatgaagcgttgttgaattttgtcaaaggccttttctgcatctattgagataatcgtggtttttgtcattggttctgtttatatgctgaattacttttattgatttgtgtatgttgaaccagccttgcatcccagggatgaagtccacttgatcatggtggataagctttttgatgtgctgttggattcagtttgccagcattttattgaggatttttgcatcgatgttcatcaggaatattgatctaaaattctcttttttgtgtgtgcctctgccaggctttggtgtcaggataatgctggcctcataaaatgagttagggaggattccttctttttctgttgattggaatagtttcagaaggaatggtaccaactcctccttgtaccactgatagaattcggctgtgaatccctctgttcctggactctttttggttggtaagctattaattattgcctcaatttcagagcatgttattggtctattcagagtttcaacttcttcctgatttagtcttgggagggtgtatgtgtttaggaatttatccatttcttccagattttctagtttatttgcacagagacgtttgtggtattctctgatggtagtttgtatttctgtgggatcagtggtgatatcctctttatcatttttttattgtgtgtatttgattcttctctcttttcttcttcattaatcttgctagtggtctatcaattttgttgatcttttcaaaaaaccgtctcctggattcattgatttgttgaagggttttttgtgtctctatttccttcagttctgctctgatcttagttatttcttgccttctcctagcttttgaatgtgttttctcttgtttctctatttcttttaattgtgatgttagggtgtccattttagatctttcctccgttccctcatgggtatttagtgctatcaatttccctctacacactgctttgaatgtgtcccacagattctggtatgttgtgtttctgttcttgttgctttcaaagaacagctttaattctgctttcatttcattatgtaccacatagtcattcaggagcaggctgttcagtttccatgtagttgactggttttgagtgagtttcttaatcctgagttctagtttgattgcactgtggactgagagacagtttgttataatttgtgttcttttacatttgcttaggagttcttttcttccaactatgtggtcaattttggcatcggtgtggtgtggtgctgaaaagaatgtatattctcttcatctggggtgatgagttctgtagatgtctattaggtccgcttttgcagagctgagttcacatcgtggatatccttgttaactttcagtctctttgatctgtctaatgttgacagtggggtaataaagtctcccattattattgtgtgggagttcaagtctctttttaggtctccaaggccttgctttatgaatctgggtgctcctgtattgggtgcatatatatttaggatagttagttcttcttgttgaattgatccctttaccattatgtaatggcttctttgtctcttttgacgtttgctggtttaaaatcttttttgtcagagactaggattgcaacccctgccttttttgttttccatttgcttggtagatcttcctccatccttttattttgagcctatgtgtgtctctgcacgtgagatgggtttcctgaatacagcacactgatgggtcttgactctttatccaatttgccagtctgtgtctttcaattggagcatttatcccatttacatttaaggttaatattgttatgtgtgaattttatcctgtcatcatgatgttagctggttattttgctcattagttgatgcagtttcttcctagcctcgatcatctttataatttgccatgtttttgtggctggtaccagtcgttcctttccatgtttagtgcttccttccagagctcttttagggcaggcctggtggtgacaaaatctctcagcatttgcttgtctgtaaacgattttatttctccttcccttatgaaacttagtttggctggatatgaaactctgcattgaaaattcttttatttaagatcatcgaatattggcccccattttcttctggcttgtagagtttctgcggagagatcagctgttagtctgatggacttccttttgcgggtaacctgacctttctgtctggttgcccttcacaatttttccttcatttcaactttggtgaatctgataatttttgtcttgcatttctcttctcgagtcttatctttgtggtgttctctgtatttcctgaatttcaatgttgtcctgccttgctagattggggaagggctcctggataatatcctgcagagtgttttccaacttggttccattctctgcatcactttcaggtacaccaatcagatgtagattttgtcttttcacatagtcccatgtttcttggaggctttgttcatttctttttattcttttttctctcaacttctcttctcgctggatttcattcatttgatcttccatcactgatactctttcttccagttgatcaaatcagctacggaagcttgtgcattcatcacatagttctcgtgccatggttttcagctccaccaggtcctttaaggacttgtgtgtattggttattctagttagccattcgtctaatcttttttcaaggtttttaacttctttgccatggtttcgaacttcctcctttagctcggagtagtttgatcatctgaagccttcttctctcaactcgtcaaagtcattaaccatccagtattgttccaatgctggtgaggagctgcattcctttggaggaggagaggcagtctgatttttaaaattttcagtttttctcctctgttttttccccatctttatggttttatctaccttcggtctttgatgatgatgatgacgtataaatcggttttggtgtggatgtccttcctgtttgttagtttcccaacagtcaggaccctcagctgcaagtctgttggattttgctggaggtccactccagatactgtttgcctggatatcagcagcagaggctgcagaacagcgggtattggtgaccagcaaatgttgctgccagattgttcctctggaagttttgtctcagaagagtaccttgtcgtgtgaggtgtcagtctgctgctactgggggttgccacccagttgggctttttggggttcagggacccacttgaggaagctgtctgttctcagatctgcagctgcatgctgggagaagcactactttcttcaaaagtgtcagacagggacatttaagtctgcagaggtttctgctgccttttgttttgttatgccctgcccccagaggtggagtctactgatgcaggcaggcctccctgaactgtgttgggctccacccagttcgagcttccaggctgctttgtttacttactcaagcctcgacaatggcgggcgcccctccccaagcctcgctgccaccttgctgttcgaactcagactgctgtggtagcaatgagtgaggctccatgggcataggaccctccaaaccaggtacaggatgtaatctcctgatgtgccatttgctaagaccatcagaaaagtgcagtattagggtgagagtgacccgattttccaggtgccatccatcactcctttccttggctaggaaaaggaattctctgacccattgtgcttcctgggtgaggtgatgtctcgccctgctttggctcaggctcagtgccctgaccccactctcctgcacccagtttccaacactccccagtgatatgcacacagcacctcagttggaaatgaagaaatcacacatcttctgcattgctcacgctgggagctgtagactggagctgttcctattcggccatcttggccccacctcctatctgtgattcttcttatattacaacttaggttccaagaagcataaagctaaagattaggtcttgaactgacacagtagcaattctatcttagtgtgttggtcagagaagtcacaggccagtcatatatgaaggactgcagggatagtccccatctttcaatgagggaggttcttgcataaagagagaacgaattgtatttttggatacaagctatttttagatatgtatcttgaggctttttactgtacatttattgtaggtgttaagggctgatggaactttttcctgctactgtttggtgtttcatttacttcaattagaattttgtttatgtgggaacaaaaagaaatggccagaggcagttaaagtcatctaggaccttgctacacaaagtgtggtccaagatgagaaatatgagcatcaagttggagctttctatcaaatgtagaatcgcaggccctaatccagacttgccaagtcagaatctgcattaacaagacccacggtagattcatatgcacattaaagttcaagaagcaccagtccaagattcctcataggttggacaaaatcattattattcaaagaatggatttattactctttttgtggtaatacttggatcattggtacttagaaatcttgccatttaataacgtatctacaaaaagtgaattttactcatttataaaacgcaattgcttccttggtgatttatatcctaggaaacttatttcagtccaaaccatactgtacactatgaagtgatcattactattttctctaagtttctctctctctttccgtatacatgcaatgtgtgtgtgtgtttgtgtgtgtgtgtgtgtatatatatatatatatatatatgtataatgtgtgtacatatagtccttaagtattggttacctgttatacaagaatgaaattgattgagaaattgtataggtattgaaatcgttaatcatgagaggttttatgttcttgacggcattcgatgcattacaaattactgtctcattcatattgtttcattttgcaaaggtggaaaatgtttttgaggatacattttaaaagtaagaacagcagccataggctgtaaaagcaagtatttcttagaatcattgtttatgtttaactgtaacacaagacttagagtcaagtaataaggctgccacttacttaagctgtgattaataatgactaaacagctcttaaagacaccaagttacaattgtttccttcatctctgttcttgaagtattacatttaaacctgctttggatagtcttacttaaattctgttgttttaacaaatgattttttttgttattgtttgtttgttttttgagacaggtctccctccattgcccaggctggtgtgtagcagtgggatcacggagcactgcaacgttgacctttcaggctcaggtgattctccaacctcagcctacagagtagctggaactgcaggtcacaccaccatgcacaggtaattttttttagcgatggaatgtttctatgttgcccaggctggtctcaaactcctgggcacaaatgatcctccccccttagcctccaaaagtagtgagattagaggtgttttgaaccaccatgcctaccataaataatatcttttataaaaagccaatgatgaatattacatttaccatctttttttaagtaaaaagcatcagcaacaatagaacagtgtggctgtatggattgttttgccttgaacacagttctgccttaacacatagcaacaatctttatattgggttctaagtttccgataattgggtttaaataaggaaatgataaaatcacagtatatttgagcaaaatcttattcaaacactttattgtaatcttagattgagttatatagcaaatgcacaatacatttcttagtatagcaggaagaacctaaagggaaaatcaaagacttactgattcactagcaggtattaagtagttacatgggtatgtttttttggatgcttattatctcaatacctggaagaaagtaaatgcccatgaatcattaagtgaataaataaacaactgaataatcatgagtaaataatgatgagtaaggaaatggatggaagacctgttgttagattattgcaagttataaaccatgaggctggtctcttttttgagtagaattggtcaaatttcatattctatatcggagacaatggtagctttcaggctttgagccaatatcagttttttgagtgtcagaacagaagatgacaggaaccaaattggatgatacaacaggtttgggaacagaagccagaggcagtaaacagaagaggcagagaagcttgaaaggatgtgctcaggaagtagatgttgggccgcacaacgaaattcagaaaaacaatgccttgctaaaaaatgacatcttttaaagggcaggatttaggtttttgtgacagctctgtttgattcagccactgagcaggttaaaactgaagcaagtgttttcccatacttttatatttggatcaccatttaaaaagagcttttctgatactctttgttgttag

SEQ ID NO: 37 - DNA, 3239 bp, Homo sapiens
gtattatggaaaagagatgtggcacaaggaaatctgcgaaggaacccacgatgttctgtccaagttgttaacaactagacgttttaaaaggcatttataaaaattaatagtcttaccttttgattatccttccttctctatggtgtgttacaaaaattccacatcttacaagcccatgaaaataaattcccatgagagtttgaaaactttttgcagaataatgtcccaattttagttactggtggccaatatttaccagcttgagaggtggtcttttattacccttactggctggtaacatttatgacacagaaacttgcaataggttggatggaatcctttcaatatgaaaagtaattataaacaggtgaaggtagaatggcaactttcgtgttggctttgttaatgttttgcacgtaatccctctgtcaaagtgtcttaaacaataaaacaacaagcaaaaatctcacacatacacacacacacatgcacacacacattttgttttcaaagaccacggtgtaaaatgaagatacacacacgttatcctgtaagttgtggatctttggttggctagttggttatgatgttttttcccctactcagctctaaaaaaacatcctcggcaaggtgaggtggctcacgcctgtaatcccagcactttgggaggccgaagcgggcggatcacctcaggttgggagttcgagaccagactgaccaatgtggagaagcccagtctctactaaaaatataaaattagcccggcgtggtggcgcatgcctgtaatcccagctactctggaggctgacagaggagaatcgcttgaacccgggaggaggaggttgcggtgagccgagatcacgccattgcactccagcctgggcaacaagagtaaaactccgtctcaaaaaaaaaaaaaaaaaaaaaaaaaaaatcctcaaagccaacccacctgccaagaggagggaaggaggtgatactcgagccttactctcgaatcaagaaaagggagtaggccttggggaaatgtggctttcaaaattcatgccatatttgcccaagccaagtcgctagctggtccctgcaaccacccacacaccccactgccttcttcctaggaaaaaccagactctgccctgttacctacgcgcccgactcgcggggcgctgttcgttcaagactcgccccaaagagcgcaggaacgcgagccgcagcagtttcagggttcagcttaggtgacacaaacgtagctaatgggaggccgccgccgactctcccacccgcccttaccagcatccccgcgcctctccccgccacccttgcccggcgcgccggcgatgccctctgcccgcggggacccgagcctcgcgcgccctccgccctccctaccctggaccctgtacccatcacacctggggcactgccgtccgccgagcttgggcgcgcggcagcgagaaggcactggaggaggagcagccggggcgtacgcgccctggcctccagcaggccggggagggcgcgcatggcgccagagggtccgcctgggtcctcgtggagactgctccctcagctcgccgccgcgggtgtccagagtccctgcgcacactcgcaggtggcccggcgctcgcagccagtgccgcgggtaggacgctgaagaaaaggcggaatgggaggggcccggccgccttgccccactcccccgagacgctcttaccgcgcccggccctccatcagttatgcagccctcagccggctgctggcgttcccggatgtgcggtggcggtgctacttcccggctgcagcctctccggcctccgccctctcggctctagcaggtcgggagagagcttgggcaggtgatgtctagccaatctcgtggggagaggtcgaaactctgcctacagactggcctttgcacttcacctgaggcaggtttcactaatttgctttgatgggacagatgagaaacacttttctcctcccggaccccggacatctttgggctttcttacgagggaggcttatttttgcgcaggtgtaaggttttatccagctgccagacaacttgtgttaatctttctttgctttgcctaccaatcacacacattctctcttctagtctctgaaggcttaactgattttctccggatgaaggttttagagtcccaaggccccataccgtgtctgattttactttatttttgtttgttaagcctaacagcttctgaggagccacctagagctcaagaagcaaaagctactgagagtagatactatgtaaactgcacaagacattgacctttgttaaatccgaacactctttaagataatgctcttacccacaaggctgtagcttggaatattcagtgctctgaaccaaattaaataaattagtgctttatccgggaggggaggagaaatctatattgtaacattgaaacacattgatttgatttctctccaggatgttataacgcattaaaagatatttttaaaatttttcacgagctttgtttcctctccctttatttttttgaagttcagctttcacattcgtaaattcaaaatatatcggcgttaaaaaaaaaaggattggaaataacatgagacaaattttgaaaattgagctatttaacaaaacctgtgtttattccaggcaggaatggttaatttgtaattggtacgtattactaaaacacgtctgtttctggtttagtattatatgcacaaaactttggaaacagaatgtagattcttcaaattggcagtgagataatatgaataatacaattcattcaacaatattatctaccaggtgccaatctaccattgtgttcaaaagaggctagataggcacacatgcacaaatgcacgcatgcacacatgtacacacacacacacacaaattagacaactgtttatctgtgaatgacaaatctcagaaaagcctcttctcagaaaattatggtcaaaattattaaaatcttctgaatgaaactttaaaagatgccttcaaggactaaatcttatacactgttgaccctctgagggcattgactgggcttgctaaacccaaattgcctaatcaatggctgctacatcacacctctttctttcaaccctgcatctggtctcaggactaactgcacacatttccctataattaggtagagtgtcaacagtaagcacttctcacctcaaactaaactctgactgacttttcccagttagtctcataa

SEQ ID NO: 38 - DNA, 16702 bp, Homo sapiens
acccttcaggatgaacttaagaatgaaacagcaatttctttattctccatcccaatagaattttgaaggattcttgctgtattgtgcatggaaagccctcattagcaatgcaagcacttcagaaggcaatgagtgactcatacaaggtccagaaatagtactgaggaaaactgcttttatgtaatttttttctcggaatgtcatgctgtgaatacttatcatctcagcagagacaagtgggaaagatcacatcttcctgggcctgcagggatgttctgtctctcagaatcatgtcactgcctcacaggcctccaggagccaccagaaatttgaaggaagctgtttaagcacaacaggggagtgaataaatgcagggtatatgtaagcagtaactcatctcttcagttttaatagtaatgcattcagcacgtttccttcggtttatattttgttagtcttgtttttgctccctgaggtagacttaaacatttcagaaaaaaattgtgttaaaatatgaatgatacgaaaattaccattttagtaatttttaagtatacttttcaatgacattaagtacatacacttttttttttttgagacagagtctcgctctgtcagccaggctggagtgcagtggcatgatcttggctcactgcagcctctgcctcctgggttcaagcgattctcctgcctaagcctcctgagtagctgggatcacaggcatgtgctgccatgcccaactaattttttgtatttttagtagagtcggggcttcactgtgttagccaggatggtcttgatctcctgcccttgtgatccacccccctcggcctcccaaagtgctgggattacaggtgtgagccaccacgcctggccaagtacatgcacatttttgtgacaccatcaccaacatccatctccagagctttttcatcttcagaaactgaaactctatacccattaaatagtaacttcccattttcctcccctcagtccctggcaatcaccattttgctttctgtttctgtaaatgtgactatttttaggtaccttatatgaggggaatcacacaatatttgtccttttgtgatttgcttattttacttatcataatgtctgcaaggtttagccacgttgtagcatgtgtaggactttcatttcattttagtctgaacgatgttctctcatatgtatataacacattttgtttatccattcacccatccgaggacacttaggttgcttccactttttgactatggtgaagaatgctgctatgaacatgagtatagaagtatctgagactctgctttcactttggggagttatatacccagtggaattgccaaaaatagattcttgaaaagggaagatcctgagggaagtaggtgataaaatttttactccatcagtaaattagagaaagggcagaagtatatgatccaggactctgaacctagtgagatggatggaggcagtcacacagccagggtagggaaggagagaggggcaggcttgatccaaaaggaggtcaagctattggcaggttgagatttaggccttaaaacattccttggagaggctgtagccagcttagaaggagctcttgaaagctgagccagggtcagcacatccaggggccatttgagtgggtactaccaggtgctcattcagaagactgacaccagatctctctccttcactgctgagtgaggtcctgtcatggacagctctgcccatagcccagtgattacccagcagcaggatgtctgccggttttccctaagcgagaaaaagctgtgacctcgaagtgttctgagttgaaagctgtcttggagtggaagggatggacacatttcctgcagcttcctggattcaactggccactgggagtcaaatcagactctggagtttaacacatggtttctaaggagtccccaaagggtgactctgctgtgtgcagcattcccaactgtgaaaagcatgtgggttggaaggcggatgagatgggggtaagcatggaagtcatagcaaaagcttaggatggtcacccttggtggactggactagtctgacctggtgctagaacctgtcctccctggggcaggcccagctggtgccccaaggacttgcattttgttccatgcagcctcttgcattaggcaatgaccatagcaccctggataatgaccagtcttggaaagattagcattctacatacttagtttttgaaaaaaattatgtaactggtgttctactttttcctagaatctttgcctctctaaggacaagtctttgctcttgtaaagggagaaagggatccaaaaaatattggtatgcagtaatttttgattagcatccctagccaagtgataaagatatattacatgctccgaaattctacaatagcccacccaaatccctgattcattgcctgaaggggccctttgcaacacaatagcttacacttcaggcccagatttcaagaggacccattaatcagtgatgtgaggtggtgagcgagagggtttggccccatgacaacttggaaagtttgccatgatttggaaagaacagcagcccacattctgaatagagaaagggaaaaggggacagaattctctgctgaacaataatgagaataagatggaactgcttcaaaaagatgtccatccagcagtagacgagtacacctgtgcatatggcaaatgttggggaccaggcttggtcatggtcacgtctgggaacagactgacagggatcagtgggatgctcactttaagagtatctaggtagctgtcataagaatgtgttttattcagaataaaaaaaaaaatcactgtgtttgtaaaaacaaggatgttcttgtttagttgtctaggtttctgacattttgacttgtggctcctagagacttgagtggcagcggagatattaatttttatgcatgttgggcatgagatataaacaaagtggatatttcctttatgattcacaaagtagtggaaaggattctgctttaagaatcgggcaatggagctaactctgctgccctgctgcaactctgtttgaaactatgatgtattattttacccatcaggccctctgcttcctcacatcattatggggtgggagtggatggaaggtagctgggttagatgtcttttattcatgacccggagggcttcagagatcttgccagccctctggaatagtttataatatgttatgtctttgtggatataaatattttttctcaaaagaaggcttattgcttttatcacattttctaaagtggtctgtggctccccaaatgttcagaactcttgtactagatcgctaaacatctcctctaactcttacagtccttgaatgtgctcttgtacatctgtgactctaaggttaatccggtttattatgagaggtgaccgtgatggtatcttccctaaatctgttttgtttcattgtaatgtgagaaaagtttcaggaatgtgaactttcctagttcattctcattttctggactcagctgacctttcttgggaaaaataatagaaaagtaggaaatgggcatctttagctcctttaatctctgcaactcctggttgtgtctgctcatcccacctcgcagggtctcacacagccccattgtgaaacccaagcagatttctgctctcagctcttttctcattgatccctttctgccttcaccccaccctcactgcagttttccacccagatagatgctccttgacttacagtggaactgcatcctgataagttagtagtagatgttcctttaccagacacagaggggatcccggaggtattaaaaggttgatccactgaaggttgaaaatgcatttaatacacctgacccatcaaacatcaaagcttagcctagtccactttaaatgcactcagaacacaaatttatgattggacaataatcatcgagcaacccagtacactgcagagtatcggtgtttactcttgtgactgggagctgtggctcgctgccactgcccagcatcatgagagagcattgtactgcatgtagctagccagaaaaaagaggaaaattcaacactcaacgatttctatgaacgcgtatttcttttgcgttgacataaagtcaaaaaattgttaagttgaagcattgtaaatcaggggccatcttaatgcccattctacatctattctttaaacaactgactttaattgaaaagctacatggggaatgatctttgagcaggcgaatcttttaatacctccaggatcccctctgcgtctggtaaaggaacatctactactgacttattgacctctgcacgtgcaaaaggaggtggagatggagggatgtgttgtttctgaaggggagagttcctggtgcagatttcttactggctaaacttgctggaaacacccacagaagtggcacatcagaccattctgcccacaagcattttaaaataaaaatgaaatcaaatggtcctctgttcgacatacacaaaattcactgtttcaaaagcactttcaagatgatttttgttcctttagatttctcattccaaggattttgccccacccagcaggggaattactgagtattctgagaactgtgtcttctgccctgagagtgaccttctcagtgtaatgccatgcctcagggatggtcacagacagagcatgggtcttcctaatggaagtgagagagtataagtggtagggggagggtggagagagagttttaccgatactactatctctgttcattagcaatattcacagcttcgctttctttgatttgtgggaaaactctttttgtgaaatgacacctgagactccaattctaaggcacagggtgaagtaaactgatagagaagttgatagggcactgccgttacaagttaccttgtacctgctttgcaaaacttgctgaagtatgagctggatggtgcaatagtgagatcttcctgtgttctctcacaggcaccctgattttgttttcagaggataaaaattcattttaagccatttgaaattctgaaaaccatggaatttcttttttcttctcctttctaaaacaaaagttcttctccatctaagatacattaaatgtataatttttttaaaggaattactttgtgaaaacaagttcatggattcaatttcagacttcttattcttaatgtttccacacctatcaacaggaacacatgtggccccacaattcaccatttatgcaggctgcatttcaacgtagggggcagttaaccttttcccttccatttggtgattctctttaccagctttctttatttcctgtagaatattttaaaaaagaaaatgtgggagacatttctattcacatcacatgttgtcaaagccctcttgtgggatgtggtttaactctttaacagtggccctgtgatagctaaaaatttgatgttcagcaattactgctctttgggaactccaagtacatccagcattgcagtttttttaaacaattggctctttttttctgggtccatttctcatctcacttggctccccatagagttatgagacaggccctctgtttctactgaagtagaacaactgacatttatggctcagctggaagtagagaggtggattgactgattcaggctttcatttttttttttttaactgaaaatgtgatatgggtttgttatgtttgcttaatcttatttcaggctcccctataaaaatcctggtgggagaaagaaagcagagcatcagcatatgtgttgaacttggaataagaaattttaatccttggaaaaatggtattgtgtaaattccaagttgtaactcgtcccaatatattcagacagtggcaggaacattttattttttgtttttatgctccattcacacaatagtgcattaaagtggccttttgaatgcttatttcccttaacttttctttaggcctatatttattttatttgacagaaaccctactgccttatatgaagtaaagcagatgttttgcatttacagatggtgcacctgacagtcagaggttgagcaggtttgctagtggccagctgtttgcttgtgccctcagcatcggtatatattttgactgcagagagaaaataaaaggctctattgattgggcacttatgtgctaagccccgtgctgcacaattcaggttcgctggtgaatttaggacttacaagatcctatgaggcaggtcttcttaacagcctaccactttattgttgaggaaactgtggatcagagaagagaaatagcttttccaaggtcacatttgaagttaggaagcaaagggggtgtctaagtacaaatcactactatgttatatcacttttactcaaatgtcagatggagcccctcttgccacttcaaaataagattgccttgaaatctacccccatccaaaaatctgaggaaaagttcaatagcattgcgtgtgttcatgggatgtatcatcttcaggagaggtggttcagctgagtgatgaagagcctggggtctggagcatgttactcaatctcccaagcctcgcctcccccatctagaacatggaggtcagaatagcttctacgtcagatggttgtcatgaggatgaaactggttctttcatgccacagatattgtgcctcagggcagtccttagcccatggccatgcttgggagtcagccctgttgagtattgtggatgtcacttctagactggctctcctgcctctgcttcagggtatgaatggtctcatccttggtacctgggtctcaccagtgtcaaccctgacaaagagcttagccattttgattttcataaaactaccccgatttctccaggccccaccccctctgtgtgtatgtgtgtgtgttttaggtgttaccaagggtgtgagggaatcagagaagaatgttacattttcacatctcagtaaagcacatgacctcagttgagagttagatgtactttttcttaaaagtccacattgttcatgtcatatttttgattgccttgtctcctgctaacccttgtcctcacattctcctatcctaccttcttaagttgttttcataaagaaacagttttctaaagataattctggagctatctgttaaggtaatttcttttaaactctaacactgacttcaggaaagggaagcctttttgttgttgttgctggttttttccttcttttcttttcccctcctcttcccttcctttcttttctccctccctcccttccttctttctttccatcttctaaaacgtaaggaaagtgcaaaagtaactgattgggtattttctaatatcaagaaaaatatgtgtcttgaaatgtgattttatccctttctagtgctattgaattttcagagatgtttttccttcttctgctaattacctcttggaagagtgtatttatcatactcaccacctagctcaacacagactgatggtggagccactgcagaactgttatctgagagcaagttgctcccctcagcgggacatcctcagtgtgccccccacgcacgatttcatctccccactggctctgtggtgctaaagcaggatggctggcgaggggcgggatgctctttctagatggcctccctcccctcaagataggagcccactgccttggggaagagaagcaggaaaaaaatgaatagatgccggtggcttaaagagaggagggaagagcctggacaaagaagagaggaaatgactatagctggactgacctagcagaagtgtggttaatagtgtgtgtgtgtgtgtgtgtgtgtgtgtgtgtgtgcgtgcacgggcatgcgtacacacacacacacatagttatgtaactatttttctaattgcataattaatacatgtaaaataatttggttaggaaaacatgaaaagaaacccaaaagagatcaataaaaatattcataatttcaccccccagagaaaatctctgctgaaatgttgcaatatttttttgcagttgtcttttggtgactatacacacacaaatataacgtatattttagatcagaaatgaacatacatctgctcactatcggtaacactatttaggacaaagcagaataaatatgtcttttgcctgacaaagggagcttgctccctgctcatcatgatgttctgggagcctctgcttctttcgagtgagctcaccattttgtagaagtcactcagctcagtcatgtgtatctcatcgtttgcttccctactcatcctcctgcatccactctcttcaccctttagttaattctaaatatcctcaactttctgtgcatcatctggcctcatctggagcttcacagattgaagtgcctatttgcaaaagtttttacacatggatgatctgcaagagacacctactgttttttcataggtgcctgtgaaatgtatcatttcaacattcaaaagtaaagcaggataatatccagtttggaggtacaatctctgaaggcaggcagacgtaggtttgggttcctttttttagccacagttttatcatcagcaaaatggtaaattaaaagtgagaactttactctgaattactataaagattcaatgagataacctgggacatgtgctcagtacaacatgtggagagtactcaatttgtgaatataatggttcagctgtaagatcgtagaacaaagtaatgggcagtgtttgtatgatattttcccaaggtgaaccagacgagattgaacttccctgcaaataactgacattgaggtgagctgaagtagttgtaatggtgcaatatgatagtagcaatagctacctgagtacttcatataaccccagcacttcacggcatttcatttaattttcacggcaatcctatgaaaaggttaccagcattttgtcagttaggatatttgaaccagttaggaagctggtttaaatgatgagaaaccatgacaagaagtccagaattagatcagtctgcagagttggttgattcagtaatccaaaatgtcgagtgaagtcctcatcctttctctctgttctgccatctcctccactggcttcactctaaggctagaagcaagatggcggcagcagtttcagtcatcacagccaaacatagcaaagtccagagtgagaccatctgttcatgtgcctctctcttagaagtgagaaatatttctccaaatgtctgcagcagattttttctctctgttttattgtttagaattttgcccatttatgaaccaatcattgggaaagcaaacggaattactcttagatcaatcaggtctactcccttctggagttaagggtgggataagcccctgtggggctcatggctatatgaaaaggggcagatacctgtcaaaactggagttttgttatgaaagaagaatgaaagcagtattggcacccaacttaaaggatctgctctattttttaaatgaggaaatggcagtcaagaaacttaagtagagtgtctgaaatcctgtggccaacaagggacagagacaaaattgtaatccatgattcatctgactctaatgattacatatatctctaaaacaggtaaacctatagcttgtcctgtgtttttgaaaatattcaagccttgagactgcattaagcaagattattttaggaggttgtaaaagcttatggaccaactgaagctaacactttgcaatgtaggatgctgagaagccatgtgcagccagcgtgatctggcatggagccagaaatggagtggcgtctctggagaagccgtggggtgaaaaggtggatacttctacagtgacaggtcatacaaagaacatgtgtggtcttgtcccagagtccaagctgtggcaaggatagcgagacaggaagtagtgtccccattacccatcagtgatgtttccagtaccagcttccaggctccctattcttcacagatgtttactgagctgtttaacaagagagccaatagagagaaacagtcttctcatcaatatgcttggtgaaaaggagagtcaaatgttagcatgaggtccgaattagaaccagagtcccctggccgagtgctctaaccacattcctgtccctctcacagctccatcagctgccccactttgtgttccctgggattccatccttgacctttccttgactttatgtgccctccccaactatcttcaaagacaacctggatgccagtgacatttagtgacatgttgcagactcctgtcttctgcgtaaactctagggcttggtcccacctatctttgtgtgccttcatctgattacttcataggcttttcaaactcagtatgtccaaatacatctgtatctttcaccactcccacccaaaacacaagagaaatgtttgtgtctattccttctggctgttggtccaagaatagaatccttgggctcattttgactctgaagtcctaacagacatctcagtagttgacacttcctggtcgtattcagccgtctccatctttccacctgttgactccatcctagttcaggcttcatcctttcatacttaggctatttcagtagtctttgccttgtcatccctcctttgatctttctgccccatcaaacccatattccacactgtcactaagggtatctttctgaaacatagacatgggcccactacttcactgagtaaactctggaagtgttctccagtgtctacagggtaaagttaatcctcttcagaatatcatatagggccattcacagtattgtcccactttatccttagagaattttcttatcctttaaagaactcatacctatcttttaagactcagcacacatattcctccagatttcccaggtagaactaatcattccttttctgtggtcctccattgctttgtgcacaccctggtgctctgacactgtgcttggggcattatattgtaatgcctcatttttaggctgtgcccctctaaacagtgaggatcatgtttctctttatatttgcatctcccatttagctagtggtacttggaagacaagtgttgttggaaaggaaataacttctttcagctatgtgcggtgaatgttcatagcgaaacactaaactaatcaatgcctgtatttcagttgttcttttacttattttttaaccttcacattgttcatgtaggaaacacataacctttgtaacaactttaatttttggtagtgatcctcacccttagacaagagggtagatggaggcactccttcctccttgtttctagaacattatggctctatactattatagataggtttaaaatcttaaaagctatcagttttaagttcatatcatgtaccagactttgttcctcattgttgtacatgtattacctcatttattttaattatttctataactcaatgaccatagtactactctttctgcaatttacaaatgaggaaattaacgcacagagagattaagtaacttgaccaagatcacacactcaataagtgatgaaacagggatgtgagtccaggctgtcttgtgccagaaccaatgatcttgaccactaatggcctctggaaccactaatgacagccttctttttatcttatagccacagttaatcatttgttttcacaaaagatgtgacacctcaattaaaatcattagtggtcaggagcaaatgtgaatatgtttgaatttcttgcttttggcatcttctagctgggactctgttctaatcaacacattcttctactgatacatggaatcaaggcatttcatctcacactcacttaagttaacaaatgatcacttctcacggatgtgggtaacaagagttctgagtcattaatttgctaaaatgttttccccattgtgaactttaaatcttttctcttttatcctcataataacacacatatttttaccccatgtaccctaataaataacagagaatcttgctacagactagaaattcactgactcggaccttgaggagaaaagtaaagggaatgcactcccaaccaacaaccattaaaggcaaaggaggagaagggctctaattattctgctggaactggaacccatggttacagggttctgagcatttgaaaccctcaggctgaaaaatcacttaactttctgctatgtgtgtgtgtattgtggggctggattatgcggaaggaaaggaataaaataaaatccatttcaaattcagagttcaccatcattttgcttacactctggagagaagaaaaatgatcctgtcactttaaatatagcatagactgccatatagatcttatttttcgttctttcatattttcttccctttccctcctaccatccctccctctctttgcctccctctccctctctttgtatgtcattagctcacagtttttccttgttctgctattgaagtcactttgctgtttctttgcatttgttttgggatcattctgcatgtttgtgtgctctctccttatctagaaggcccaccctttgtatctacttgtttcctctccacactacccacttaggatacaattttgggtatgaaaatatgtgctaagcagcggcttgggaacaaattgcctctgcagatagccaaagccctgcactcctgggccagtggttgaagaattctcctttcatggtgtacagactttcttgttttgtgggtttgcatttttgcctctaatcaagtgtctctgtttaaaatcagtaagactacatgagggctgattctgagaattagaaggcacagggatggaaaaagtcgtaaatgtgtagggctgggcagcccaaggtctgatttgttcaaattaagtgagataaaccccatggaatacttagaagagagatcagcatattcaggcactgaccaatgttttcttcccttcttttaattgctccctcaattatttttctccataaacacttaatatctgctcaagctttccagggggaagagtgcatttttgggggtaggtgggggtgtaaggatgggatagcttacaaaatgcatagatagaaactcattcaagcccacttggtgatgtgatattgtttgttagattctacactgacaagttttcatttttactccatgtcatgggttgattttgggatatttaagtctcattctttctgtaatatttaaatctcaattgttccacctggggaggtagaaggacagagaacatacaaaacatacacacaaaaaaaacccctctgatgaacacaggtagaatgccatgtaaaaaccaaggcagggatatgggtgatgcttgtgtaagccaagaaatgtcaaagattgagagcaaaccaccggcagctgggagtgaggcatggaacagatttctcctcacagccttcagaaggaaccaactttctgacaccttgatctcaggatcctagcctctagaacagggagacaatatatttctgttgtttaagccaaaaaataaaaatagaaaacaaaaataatcctctcatgatttactgttctgtggagcttgaaggggaagagacaccacgtgttagaattcccagcccagtggtcatgagtttctcacatgctgggttgcacaggccttccctatatggtcgaggtctgttgagaaattctgagtgttggaggcctttccagggccgccctcaggagagagaaatcctgctgcagggtaactccctaagattagaaaaatgtagcttcgctggccaactgaagcaaggaatgattcatttcctgtcattaacagagtgagaaagatgtcgttcacaaagttctttaagctggaaaagcacattatgtgaaatactcaatttcctgatggatggcatcaactctcctaacttgcctttcagcagcagcgttgcttctggacagttccagattctgggggctgttgggtcacatgctaactggctcaggtgcctgatgtgcaattagttgggggagaaaggacattatgctaactcaaccctgggttaaaataatgacctcggctatcccctggatgatgtatcgatgtttaatcctcaagttgctatataacatttctaaatatttagcaaccagattgcaagttaaaactttcatgttcaggctcttctggttaaaaatcagctaaaacaaaacaaaacaaactaaaaaacgaaagaccaaaaactcaacctcgcatttaaaattgtgctggttattatttgtagataatcccttcttggtggactaatcttttccctcgaaaaacaagtttacatcacatagtctatttagcttacttgctgatattgccagattatataatcataggtttgaattgatagaacactcctttttaaggagctgaaagaatttaatcttctttcctatttagttgcagaatgcccacaggagaaacaagatggcaactaaatttccttttttacaggtgccaaaaagcctatagttacagagagggtaagtaatttgcctaggatcacacagctagaattgggatgtggtataaaaacctaggtgctgtttgcagtttaatgctgccagcacttggcactgataccccatcttgaatgactaataatctctgtgtatgaagtacctgaagaatatggcctaggctttctatccctggggcttccaaatgataccttacttcatcaccacaagagttttatgatgttggcatttttatccccatttcacaggtgagaaaattgaggctcagggttatatagtgggcagaagtagagatagggtttgaactccaatctacctgaccacgttatccactgcctatgtaacatatataagaaaagatatctggacatgaaacatacaacaagcagtggttcaatgacatccaggagtcagtgttctgggagaaactgaaaagtaaacattttaaataaatgtttattttctggctcctggttataataaaattgttagtttgtgtttccttttagccagagttaatattctaaaaggaagtgagagttgcagctaacagagtttttatataagagggaaaataaaaagagcacaaaaaagaaaggatggtacttgaagacaacttccatgtagtgtggtattggccagtcctgaatggctttggagagatctgattttgggcaaggacactggacagagagggagaaggggtagggaaggcatcactggcaagatataactagacttcacgagcctcagggccctcctcacctcagtcagaaagacagcaataccacctaaatgccaaaatcccagaggggaaacagttaaaacccaagacactcaaggagagaagggttttggaaatgtcaacaggagaaaaaaagattttcctgactcaggccctctttgatgacctaggaaaactggcttgggaatcaaagtagggtgaagtatggtcctggtatcagcatcacttgggagcttcttagaaaccaaatgctcaggccttaccccagacctactgaatcaggaatgttgcgtggggccctgctgtccaggtttgagtcagccctgcaggttttggatgcacctaatctttgagaaacaccactctggaacatacagaggtgagccctgggcaaaacggtgagagagaagcttgtcccaggtacacctttacatttattaatgtgattatttgattcatagccatgtgcccttctaggctgtaagtcagactgtgtggcacacaggaagatacattactcagcttcctttgcagtcagattggagccatgtgattgggttctggccaatggaatgtcatggaagtgaggtcatccatgtcaaagccggggtcctggttggtatagggccagcctgtatgaggactctgagaaataaacttacatgaggtaactgcgatctgggggttgtttttcacagcagcttcatttccctgattaatacaggttatgagcaaaaaattgggcaaggtctgatccgtttttgcttttgattatattcagggtgatcgttgaaatgttaaccaatgctgtgtcagtgggaccagtcactctacacagacactgaccacagggcttatagggtcctgcaggacctctgaattgccatagttaaccctttagatcagggatttgggggagctccagaggttcagagggagagggcattggctgggacagtatagaagaacttcagtattttaacaacccatacagccgtactggtgcatgccaattgtatcactaatattcagtacagtcgtgatacaagtaggcagacaacaaatacttttttgaatcaaaaccagataatttgaacataatgtagttggggtcctactgagcattgaagataacaattgcagacatctgttaggagtctcccctggaataaattgtctacggaatctacaggcatccatgtgggctccattttacccacttccttactctaaaagatggatggagacctccatttagaatggaagtccttggctttgttgggtttttgaatccctttggtgtttaatttgagctcctttcctaaacaaatgcacatatacccataaatataaggatgtggatactgttttagggggttcgtatgtcctttgggctccatctccaggaatgaaaagtaaaacaaggaggaaaaaaattcctggaagtggctaagtgtgaaccaggacctagttgcctttgagcatagaatatgtgtaaattgcaaaac

SEQ ID NO: 39 - DNA, 17103 bp, Homo sapiens
cctgaagcacctgattaaataggtctgaatagtatgttgcagaatttagaagtgggtgtattatgattccagagcttagcactcctctccctcagcagattattcatattttagtttggttgaagttactggagctatacaagctgattgaaattaagcatttcatttatttatatattttaaagaaaaacactaatttctatcagagtgaagggctaggaaaggtttgtgacctagggacgcttacgtccctttccaggtctgcgatgggctagtggtgcgtgcccctctacacctgattctgaaataggttcggaatgaacagccttccagctgcctgtgtgactctaagactctcctctggggtacacagacagaggttattgaaagggaatctatttccatttggaaggactgtttcctacgattaatctgcctgaaaacacacctatggtccaggtgttgtgtgggttttctcacccaccttttctttaaggaccacttcccaccatttaaaaaataaaaacaaaacaaaacaaaaaacaccttccactcaccccaaatctttctatggcacctcaatgtaaaacctgggattgccttgagaggtaaaaaccctgaggtaacacacacgggcagaatcctaaatactggtgctgagaaagtgaatgactttaacgattgattaaatcttcttttttctagatgtggtctcgttctgttgcagtggcacaatcatagctcactataacctcgaactcttaggctcaagcaatcctctcacccagcctccctagttgctaggactacaggtatgtacaaccatgccatgctaatttttaaattttctttgtagagacagggtctcactaggttgcccagactggttaaataatctttttgcaagtcaggtttttcccagttatttgctctcaatataattgaagcaggacatgttagctgatggagcattagttataattcttggtgatatatcattgaattatttctgatgtaaactttggcatgagttcagagaattgagcaatgttatgataacaaaatactcctttcccgtctgcttatttttgtgaacaaggtttctcagaacttacatctataataagcaagcacagaatcaatgctaaaccgtttcattctaacaacaaataatattcaaacatggatacataagttaattgaaaaaatagttccgctgggcgcaatggctcacacctgtaatcccagcactatggtaggccgaggcgggcggatcacaaggtcaggagatcgagaccatcctggctaatatagtgaaaccccgtctctactaaaaatacaaaaaattagctgggcgtggtggcgggcgcctgtagtcccagctactcgggaggctgaggcaggagaatggcgtgaacccgggaggcagagcttgcagtgagccgagatggcgccactgcactccagcctgggcgatagagtgagactcggtctcaaaaaaaaaaaaaaaaaaaaaagaaaagaaaaaaagaaaaaatagttccacccatctaattaagaaatgtatttctggccgggcatggtggctcatgcctgtaagcccagcactttgggaggccgaggcggcagatcacctgaggtcgggagttccagaccaacctgaccaacatgaataaaccccgcctctacttaaaaatacaaaattagccggatgtggtggcgcatgcctgtaatcccagctactcgggaggctggggcaggagaatcacttgaacctgggaggcagaggttgcagtaagccgagatcatgccattgcactccagcctggcaacaagagtgaaactctgtctcaaaaaaaaaatgtatttctaataaaattttactgtccattttataattacatacaaacatgtttcatatatttatatttttgatcatccatatactaataattataataactcaatccagaggaagttttcaacactttgagacttgcaatcaccaaaaatttttcatgtatttattcatttaagatggcatcttgctctgtcgcccaggctggagtgcagtggcaagatctcagctcactgcaacctctgccagctgggttcaaacgattcacttgcctcagcctctcaagtagctgggactataggtgcctgccaccactctggctaatttttgtatttttagtagagatggggtttcatcatgttggccaagctggtctcaaactcctgatctcaagtgatcctcctgcctcagcctcccaaagtgctgagattacaggtgtgagccaccacgcccagcatcaaaaacttcaaacatttaaatttaaatgtatacacatatttcagttgtagaaaaatttcataggtctacccctagaaaacatttggacataaaaatatatgacattgggagtgggaggagaagtggaatgaaaacacaagtttagccagaagcagttactcatgcctgtagttccggctactcacacagcctgggttatatagtgaggccccatctcaaaaaacaacaacaacacaaaacaggattaaggcaaaaaaaaaaaaatggacactataatattttccattgttaaagataagctcgttaatatgttttttaaaggaatgaaagcagaaatcaaattgatttgatatttaatataatttttttaagtatcgatttacactgttagaaattctgtctttgcggtcgggcgctgtggctcatgcctgcaatcccagcactttgggaggccgaggcaggcggatcaggaggtcaggagcttgagaccatcctggctaacatggtgaaaccccatctctactaaaaacacaaaaattagctgggcgtggtggcacgtgcctgtagtcccagctactcaggaggctgaggcaggagaatcacttgaaccctggaggcggaggttgcagtgagccaagattgggccactgcactccagcctggacgacagagtgagactccatctcaacaaaaaaaaaaaaaaaaagaaagaaagaaaaaaagaaattctgtctttgcaaatatttaaacttatgactttaaaaaaatgaataacttgaaaatatgtgagggtgtcaattgttttgttttaaaattatgtggaggactaagggagcaaaaacatttaaaagttgctgttatcaaagatctgaggttcatacaaaccttaaagaatctgtggctttactatttcaaacttctagtcaaagaaatgaacacattgcgagaccagataaaacctaccatttcagaaaattatcccattagtccaattaatgctcatagcactttatatgcaatcaagtttaattaaaatggcacttagaaaaaatcaatattcataaatttcaagaacaaattctagagtttgacattaaatccctctaaaattcattcactcactcactcaacaaattattgagcccctctcctaggcagagcacagtgggaggccccaggaatgcagcttgaaccacagagaccagggccctactccttgccagcagttcggggaaggcagtctgtaaacaggcgagcacatcactaaaataaagtcagaatgtgttaagtgcagaggaaaatgaaaaccaggcagagtgctaacaagtaattgtggagtggagacagagacggacctcctgtgaagctaatgaagctgcagtttcacagctctttatctgcacaggccccttctgcggccccgggagggacatttgcaccccaggatgaaggcacatgtgtacatgcctccacacataccccatgcacacacacacacacaccgaatcacacaccacatataccacacacacaccacacagacacacccaccatacagacacacctacacacactacacaccacaccacacaaccaaagccaacacacttgaaacactctaaagtcttacaactcatatatgaaaaaagcataatagatttctcagatttttacaacaatcctaaaaatttacatgacattaccaacaatgagtaatgaaaccaaagaaacttttctaaactatcaatcacaaaaacactttttagcccaagtgcggtgtctcacacctgtaataccaacaactttgggaggccaaggcaggaggattgcttgcagccaggagttcgagaccagactgggcaaccatgagaccccatcgctaaaaaataaaataaaataaaatgtaaaaaaacaaaacaaaaacaaaaaccacatccttcagccagacacagtagcacagcccgtagtcccagctactggggaggtgaaggcaggaagattgtttgagcccaggagttcaaggctttagtgagctatgactgtgcctgtgaatagccactgtgctcctgcctggttgacatagtgaaattctgtctgtcaaaaacaaacactttccaatcaatgataatatgctgaagactgaattatctctttaattgctgtatagaaaatatcacacaatctttttcttttctttttttttgatggagtctcactctgtagcccaggctggtgtgcagtggtgcagtctcggctcactgcaagctccgcctcctgggttcacgccattctcctgcctcagcctccggagtagctgggactagaagcacccgccaccatgcccccagctaattttttttgtatttttagtagagacggggtttcaccgtggtctcgatctcctgacctcatgatccgcccgcctcggactcccaaagtgctgggattacaggtgtgagccaccgcgcccagcccacacaatcattttcatatgaagaggtgatcagagagaatgcagccaaaattgtaggtaaaaaagtattctgtcaggcagttaattaataaaaatatatgttgttttaatggtttttcaggtagttggggtatttgtcagcttttttattttgttctatgttgagatttattattttaaataagtgctcacttttgtataaatttttatattcataattttgtattcttttttatataagcttcaacttccacaaatcctgtctggtccctgagtagagctactttagaaggaaggatctggaaagcccttactgagttgctgacccaaatgagcagagcattccaggaagagataagaagggacagggtctggagggacaagttgtcgcccctggctggagaagccaacatggctggagtagagaggggcagcagccagctcactcagggccttggagctgggggagaagtttgaatctcataccaaacacaacctgtgaccttctgattcatatttaaacatagcagcattgatgtaaaaattgcagaatattaaaaacagcccaaagtcctaacatgtatatactgaaccatcttcccactcctaagaaatagaaatcattgctttctttgtgaaaagttactgtctctcagtggcttaaaaaaaatagaataacatgatttcttaactaaagtaaaacaaaaatccactgggcttaactaattttttcactaaacaacaagcccaaaataccagtttctgtaaagtataaattctaaggtcacagacttaacaaagtaattttatttttttgagacagagtctcattctgtcacccagacttgagtgcagtggcacgatcacagttcactgcagccttgaccttcctgggttcaagcaatcctcccacttcagcctcccaagtagctgggactgcaggtgcatgccaccatgcccagctaatttttgtattattagtagagatggagttttgtcatgttgcctaagctggtctcaagttcctggactcaaacaatctgccgacctctgccttgaaaagtgctgagattacaggcatgagccactgcacctggccaacaatgtaattttcaagtaaatctgagaatactaatccacaaactaattactaatgaagaacaacacacacagagctatctctttacaatgggctttaaggtcttggtagttatttccttccctcccttctcccttaccagctagatatcttccctacttccttcctcccaccatcattctttccacccttcctttcttctcttcctctctccctcccacaatgtttattgagtgcctgctttgtgctaggtacaggtacacaggcaaccaagacagatatcagcttgcagcctagcaagggaaacagacatcaagcaaataatttattgactgcaacagtggtgtctgctactggaaaaggagtttgggatgccataggagcatctatcagggaactagcctactccgggcaattaggaaaagtcactttgaggaagtgtcctcaaagttgctgtctcaaggaccactaattccaggtagaggaacagcatctgcaaaggccatgagatgggaaaagaatggcctttgagaaactaaagaagattaagccaaaagagagagggactaaagatgaggcaggagaggtaggcaaggattctgtcacaaagcaccttgcaggccataaggattttggacttcatcctaagagcagtgggaaaatggtaaatagttaaacaagtgggtcaaataggactttttgttttgtgagtgaccaaaaccatagctccctgtcacctatctgcctagttgcagaggcagccaatatcactagggttttataaatctattcagagatgctgtgtatacacatgcaagtatgttatcttttcatcttgtaataatacatggcagcatattgtatacactatcttgaatcttgtttttttaacttaatgtattctagcaatcatcccacgtctgtgcatacggatctgcctcgttcttcttcctctggactagattgtctattgtatggaaatactattatgtatttaactagtatttaatagactttaggtcatttccaggcttttgctaccacaaaaaataccacagtgaatgttcttacacatatcattgacacatgtgggagaatatctatcaaattactggaaaagggattgctaggtcaaatggtatggaaacttgatagatattgtgaaaatgccctccctagaagtggtattaatttacataaccaccagcaaggatgcgacagataaaaaaattggtatctcagtagagttttaatttgcacttcttttagtaaaagtgatcctgagcagatttgatctgattaagagctagtgcttcttaggaattaaaaataattaggctgaaagcaaagcaacagctgggagctgaaaatgacatttcattcgttcaacaaattttgataaacaactctgcactaggcactgtcacaggcactgacgaatccagacaggtaagacccagaggagctcacgtctaatgcgagagatggaggtacaattaaatgaaatatgctatttttaaaaaacaagaagatgggccaggtgcagtggctcatgcctgtaatcctagcattttgggaggctgaggtgggcaaatcacttgtggtcaggagttcaaaaccagcctggccaacatagtgaaaccccgtctctgctaaaaatacaaaaattagctgggtgtggtggcaggcacttgtaatcccagcatccccagaggttgaggcaggagaatcgcttgaaccccggagactgaggctacagtgagccgagattactgcactccagcctgggcgaaagagcgagaatccatctcaaaataaacaaacaaacaaacaaacaaacaaacaaacagaggaagaacaagaaggaacacagaaatatgggagcacagagaagagcaactaatgtgccaaacgctcacataaattttcttagaatacctaatttttaaaaggcagggagttgggggaagcagatgattaatgctttttaatttttttaaggcctacttgggtttctttcaaaacttggctctgtacattagcaaaaatattcacagttgctttaatagagctaagatatttttaagtgttttaactaaaaatatgtctgaaattatggcaagatttccatcaaaaaagacagtagaggctggatgtggtggctcacacctgtaatctcagcactttaggaggctaaggtggggagattgcttgagccaaaggagttggaacttcagaccacaacagcagctaaacatacaaaggagactcagccactgctggtaataacactggagcagggagtcaggaagagacaccttggcttctccttctcctacctcctttttggctgttcccaaccaggagccagttgacaagcgagctaggaaacatagtttgcaggggtcttttccccaagatgcagagcagggaaagggcagggaatgggcctgcaacgaatctgagagctaaataattggcatgctagccagccagttgaccttcccagaattttggaaaccatcattcagtcactataacctgtcgattcatcctcccactgtgtcttttctctatcccatagctactaactcagttccagcccttatcctctctcacccagacaatggaaacagatttataacttgtttccccaactctactctgtcccactccaaaatgccctccatgtagtgtggacctccagaattaatttttaaacagagctatgtcccaatctctacctacagcgaaaatccagttcctctgggccttttgcagtctggctccagcatcactttcccccaaatctttctataaatatgctgtgttttagccacaaaaggagaactcaagacttcccaaacatggcatgttatttcatgcccacatcctttgttgcacgacttgaaattctccttttgaaattatttcttcctcctgaaattgtttaaatactaaaagttaccttctaaaggaatactgattcagctccctcaggcaaaatgaattattccttatgctgcattcattcatagcaagtaattcatactgctaatatagtttacttatcacatcacatttgtactgctagtgtagagcactccttttctgtgtgtttttttgtttgttttttgagacagaatcttgctatatcacccaggctggagtgcagtggcatgatcggctcactgctgccttgacttcttgagctcagatgcttctcccacatcagcctcctgagtagctgggaccccaggcatgcaccaccacacccacacagagcactctttatgttacattctagtttgttttaaaagtctcagtgatcttctccatcagggacccatgtcctgcttttgttaataaaattttattggaacacagccacacctatttgttttcatattgtctatgggtgctttcacagacaacagcagagtggggtagttgggacagaaatagcatagttcccaaagcttaaaatacttggtccactaagtttgccaactcctctctttgatggttcattgaagggattcccagatcttagcccaacatctggcagataggtgctctgtaaatgttgattgaattatctagaaagattcaagtatataggttcaagaataagagaaaaggccagaaacacaaaggaacatttaaaaatactggcaaggggaggccagagcaattagtccagagaaaaaaaataaaggacatccagattagaaagcaagaagtcaaattagacttgttcacaaataacataatcatatacttagaaaagcctcctgaagtggaaatgaaaaaaattttttaaaaagaaagaaaagcctaaagactccaccaaaaaaaacttttagaactaataaacaaattcagtaaagttacaggacacaaaaagtcaatagcaactgattgtaaacacagccagtaaacaatgtggaaaagaaaccaagaaagcaattccatttacaatagctacaaagaatataaaatacctaggaatcaatttaaccaaataagtgaaagatctaaaccaggggccaggcgtagtggtgcgtgcctataatcccagctacttgggagtctgaggcaggagaattgcttgaacctgggaggtggaggttgcagtgagccaagactgcgccaccgcactccaacctgggcaacagagtgagactccatctcaaaaaaaaaaaaaccatacaaggaaaactggtgaaatgaacacacacacaaatgaaagggtattccattctcatggactggaagaattaatatggttaaaatgataatagtacacaaagaaatttacagattcaatgcaatccctatcaaactaccaatgacattcttcacagaaatagaaaaaaaaattcctaaaattaatatgaaaccatgaaacaccccgaatagccaaagcaattctaagtaaaaagaacaaagctggaggcatcacaccacctgacttcaaaatatattacaaggctataggccagatgtggtggctcaggcctataatcccagcactttgggaggccgaggtaggaggattacttgagcccaggagttcaagaccagcttggccaacatggcaagacatctctactaaaaatacaaaaattagcccagcgtggtggcacatgcctgtaatcccagctactcaggaggctgatgcacaagaatcacttgaacccaggaggcggaggttgcagtgagctgagattgcgccactgcactccagcctgggcaacagagcgagatcctgtctcaaaaaaaaaaaaaatatatatatatatatatatacacacacacacacacacacattgtatgtatacatatatattacatatatacacatatgtatatgtatacatatacatatgtgttatatataagaaggctatattaaccaaaacaaggctatattaaccaaaacagcatggtatttgtataaaaatagacacacagaccaatagaacagaatagagaacccagaaataaattcacatatttatagtcaactgattttaaacaaaggcactaagaatatacactagggaaaggacaccctcttcaataaatggtgctgggtccaccagcctctggacaagtctttccaccgaaggcccattctcttctgggaggttctctgtatccccttgtcccccgacccccaggcagcaatagaataagtgtttgtatagatttttcaaacataaataagtatactggggaaattggatatccatgttcagaagaatgaaacttggacccctatctctcaccatatacaaaaatcagctcaaaatggaataaagacttaaatgtaagaaacaaactataaaattgctagaagaagacaggcaaaataagacattggtctgggcaaagacttttttgtgtaagatttcaaaagcggccaggtgcggtggctcatgcctgtaatcccagcacttcgggaggccaaggcgggcgaatcacctgaggttgggagctcgagaccagcctgaacaacatggagaaaccacgtctctactaaaaatacaaaattagccgggtatggtgtcacatgcctgtaatcccagctactcagaaggtgaggctgaggcaggaatatcgcttgaaatcagaaggcagaggttgcggtgagcagagatcatgccactgcactccagcctgggcaacaagagcaaaactccatctcaaaaaaaaaaaaaaatttcaaaagcacaggcaacccaagcaaaaatagtcaaacggttatatcaaaaagtgtctgcatagaaaaggaaacaatcaacaaagtgaagagacattctgcagaatgagagaaaatatttgcaaactacccatccaacaaaggattaataactagaatatatgagaaactcaaacaactcaatagcaaaaaaaaaaaaaaaaaaattcaatttaaaaatggacaaaagatctgaatagacatttctcacgagaagacatacaaatggccaacaggaatatggaaaactgctcaccatcaaaaagcatcagagaaatgcaaatcaaaacctcaagaagatatcatctcaccccagttaaaatggcttttatcaaaaagacaggaaataattaatgctggcaaggatgtggagaaaggggaacccttgtatgctgttggtgggaatgtaaattagtacagccattatggaaaactgtatggaggttcctcaaaaaccaaaaatagaaccatggtacgatccagcaataccattactggatatatatatatataaaatatatatatgaaattagtatattgaagagatatctgcactcccatattttactgcagcattattcacaatagccaaaatatgaaatgaatctaagtaccagtcaatgacgattgcataaagaaaatgtggtagaaatacataatggaatagttttctgccataaaaaagaatagagctgggtactgtggctcacgcctgtaatcccagcactttgggaggcagaggttggcggatcgcttgagcccaggaattcaagaccagcctgggcaacatggtgaaaccccatttctaaaaaaaatacaaaaattacccaggcgtggtggggtgccactgtagtcccagctacttgggaggccaaggtgggaggatcacttgaacccagaatccttgatcaagccactacactccagcctgggcaacagaatgagaccctgtctcaaaaaaaaaaaaaaaaaaaaaaaaaaagaaagaactggaggtcattatgttaagtgaaatatgccaagcacagaaagacatgatcacacattctcacttacatgtaggagctgaaaaaaaaaggtggatctcatgaggacagagagtaaactgatgcttaccagaggctaagaagagtaggtagaaggaggggatgaagagaagttgactaatgggtacaaataaacagtctgatagaagaaataagacctagcatttgatagatcagtaggatagctatactttataattatctattgtatatttcttttctttttttcttttttcttttctttttctttttttttttttttttgagacagaattttgctctgtcacccaggctggagtaaagtggcacgatctcagctcactgcaacctccgccccctgggttcaagcgattctcctgcctcagcctccagagtagctgggattataggctcctgccaccacacctggctaatttttgtggttttagtagagacggggtttggccgtgttggccaggctcctgacctcaggtgatccacccgcctcagcctaccaaagtgctaggattacaggcatgagccaccgctcccggcctctattgtatatttcaaaatagcttagaagagattaattggattgtttctagcataaagaaaagacaaatgttctagctgataggtgtcccaattacactgattcagtctttacaaattacatgaatgtattaaattagcatatgtaccctgaaaatatgtacatttattatgtatcaataaaatttaaatttttttaaagcgaggggaaaaggggaacctgttttcattaatgtaaagaattatttttagagaaatgcccatgggtgtttttaaaacagagcacagaaacaattttctaactctcataaagaagtttgttttggcctaaaaaagaatatattcataaagaaaaagttgggaacttttctgcttcagtaagcctagaatatctggaattctagaagatatgggcaagcatcctctgctggacatggcttaaatgggtcaagctgatcgttgaactaaaagcatcttaagagtccctctatggccaagcgcggtggctcacgcctgtaatcccagcactttgggaggccgaggcaggcagatcacctgaggtcaggagttcaagaccagcccgcccaaatggtgaaactccgtctctactaaaaatacaaaattagcctggtgtggtggtgcatgtctgttatcccagctactcgggaggctgaggcaggagaattgcttgaacctgggaggtggaggttgcagtgagccgagatggcaccattgcgctccagcctgggcaacaagagcaaaactccatttaaaaaaaaaaaaaaaaagagtccctctagctcctaggtcaaagaaggcacagatgagccttgcactgacaatgttaaaggtctcattgtctcttttgaatgtttagataggtaatctgaaaattacattaacaaaatagtttgcatgaactgaaaaataactctgcagaacacactctaagcctttgtagttgttttacacacccaagtgaattattcttgcatgcaaaattgactggtgagagatcttcctattgtgtaacaaacacagaaaaatgtgagttgtgttctatttgatgttgtggagtgcagcaaatttattaaaacttagaaaataaggctggactcaaactcctgggttcaagtgatcctcctgcctcaacctcctaggacaacaggcacatgtcaccaggcccagctcagaaaataattcttttggaaaggggagggggtctcatgctgtggcccagacagaagtacagtggcatgatcatagctcattgtagtctcaaactcctggcctcaagcaatcctcccttctcagcctcacaactagctaagactacaggggtgcaccaccacacctggattatttttaaaaaaaatttttttttagagacagggtctcactatgttgtccagactggtctctaactcctgggctcaagtgattctcccacctcagcctctcaaagtgctggaataacaggctcaagccactgtgcccagctatttcttccactaattttttttttttttttttttgagacagagtcgatctgtcgcccaggttggagtgtagtggcacgatctcagctcactgcaacctctgcctcccaggttcaagcaattctcccacctcagcctccagagtagctgggactacaggcaggtgccacgatgcccagctttttgtatttttagtagagatggggtttcaccatgttggccaagctagtctcaaactcctgacctcaagtgatccgcttgcctcagcctcccaaactgctgggattataggcatgggccaccacacctggccgctaacattttttccctttttttgtgttttaatttttttttgttgttgttctttttcttccattaactttgaaaaggtattttaaagtattttaaatacagagatctatatcattatgcactgttagtagaaatgaaaaattatgacagcatttctggcaagcaatttggcaagaacctcaaacgtgtttatttcatttgaaccaatagtttttatttgtttgtttgtttgagacacagtttcactatgttgctcaggctggtctcaaactcctgttctcaagcgatcctcctgccacagcctcctgagtagctgggattacaggcatgcaccatgatgcctgcctaatcagatagttctgttctaggagtctatactttaaaagtttgtgtgtgtgtaattgtaatgaaaaataacgaaaaatttgaacaaatgaatggttaaattgttgcatatgatattatgtaacaataaaattttgaggaatatttagtaataagaatgtgtctaactcatgatttttaaatgtgaatatcctattgagtttttctaatatggttttttgttgttttttttttgttttgttttgtttttgagacagagtctggctctgttgcccaggctggagtgcagtagcaacatctcagctcactgcaacatcctctcccgggtttaaatgattcttgtgcctcagcctccagagttgctgggactacaggcgtgcactaccaggactggctaatttttgtatttttagtagaaatggggtttcgccatgttggccaggctggtctcaaattcctgacctcaggtgatcagcctggcagcctcccaaagtgctaaaattactggcataagccaccgagcccagcctgatatgctccttaaaaattaaaataatggccaggcagagtggttcatgcctgtaatcccaacactttgggaagccaaggtgggcggatcacctgaagtcaggagttcgagaccagcctggccaacatggcgaaatcccgtctctactaaaaacacaaaaaatcagccaggcagctggaggcggtggatcacacctgtaattccagcactttgggaggctgaggtgggtggttcacgaagtcaagagattgagaccatcctggccaacaaggtgaccccatctctattaaaaatacaaaaattagctgggcatggtggtgcgtgcctgtagtcccagctactcgggaggctgaggcaggacaaacgcttgaatctgggaggtggaggttgcagggagccgagatcacgcccctgcactccagcctggccacagagctagattccgtctcaaaaaaaaaaaaaaattagccaggcgtggtggcgggcgcctataatctcagctacttgggaggctgaggcaggtggatcacctgaggtcaggagttggagaccaggctggccaacatggcgaaacccccgtctctactaaaaattccaaaaattagccaggcatggtggcgggcgcctataatcccagctacaccagaggttgaggcaggagaatcgcttgaacccgcgaggcggagggtgcagtgagccaagattgcgccactacactccagctgggcaacagagcgagactgtatctcaaaaaaaaaaaaaaaaaaaaaaattacaaacactattgaggtataactcatttgttggctttattttattttattttattttatttatttttgagacagagtctcgctctgtcgcccaggctggagtgcagctgagcgatctcggctctctgcaacctctgcctcccgggttcaagagattcgcctgcctcagcctcccaagtagctgggattacaggcatgtgccaccacgctcggctaatttttgtaattttagtagagtcggggtttcgccatgttggccaggctggtcttgaactcctgacctcaagcgatccgcctgcctcagcctcccaaagtgttgggattacaggcctgagccgccttgcctggcccttttttttttttaaacctaatatatgatggaatccttacatgaaagtatacatacaaa

SEQ ID NO: 40 - DNA, 33796 bp, Homo sapiens
ataatctacttctatctttcatctttaaaaaaagtttcatagtctttcatgatgcggaagtactttggacttcataaataaataattgattttattatttgcagaattctaattgaatggatgtaacaacatagtaccgtagacaatatttgcagccaggcgcggtggctcacgcctgtaatcccagcactttgggaagctgaggcaggcggatcacgaggccaagagattgagaccatcctggccaacatggcgagaccccgtctctactaaaaatacaaaaactagctgagggtggtagtgcgcgcctgtagtcccagctactctagaggctgaagcaggagaatcgcttgaacctgggaggcggaggttgcagtgagcagagattgcgccactgcactccagcctggcaacagagcaagactccatctcaaaaaaaaaaaaaaaaaaaagaaagaaagaaagaaagaaaggaaagaaagaaaaaagaaaacaatatctgcagtgggttgttgactaattttgtgtgtataggtctgtccatatggatgcatacaagagttttcagaaggatatacacctaaatagtaatagtgattatgtctaagtagtgagattataggtgattttcttcactattctcagctgtatttattcaagtattctgtagaactactatattacttttacattaaagaaaattattagtacgtttctccactgatatggtttggatctgtgtccctagccaaatctcatgccaaaacgtaatcctcaatggccaggtgcagtggctcacgcctgtaatctcagaacttcgggaggctgaggcggaaggatcacaaggtcaggagatcgagaccatcctggctaacacggtgaaaccctgtctccactaaaaacacacacataaaaaattagccgggcgtggtggcaggggcctgtagtcccagctacttggaaggctgaggcaggaaaatggcgtgaacccgagaggcggagcttgcagtgagccgagatcgtgccactgcactccagcctgggcgacagagcaagactccgtctcaaaaaaaaaaaaaaaaaaaaaaaagtcctcaatgttggaggtagggcctagtgggagttgattgctcctggggttggatttctaatgaatggtttcacaccatttcttggtgctgtcctctcaataatgaatgagttctctggcggcgatctggctgtttataagtatggcaccttgccctctttcttgctcggttttcaccatgtggtgtgcctgctcctgattcgccttccaccatgagtaaaagctccttgagacctcctcagaaacagatgccactatgcttcctgtgcagtttgcagaaccatgagccaattaaaccttttttctttataaattacccagtctggccaggcgcggtggctcacgtctgtaaccccaacactttgggaggccgaggcgggaggatcacctgaggtcgggagttcaagaccaacatggggaaaccccgtctctactaaaaatacaaaattagctgggcatggtggcacatgcttgtaatcccagctactcgggaggctgaggcaagagaatcgcttgagcccgggaggcggaggttgcggtgagccgagattgcgccattgtactccagcctgggcaacaagagtgaaactccatctcaaaaaaattaaataaataaataaatacatacataaattacccagtctcaggtatttctttatagcaatgcaagaacagactaataaatccattcagttgagtaaaagagttccaggcactaaatatgagctttagcatcaacatcattaaggaagatactctactggcatagtttcagcaggcagctgggcccatctctttcctgggcttaaccaggctgggtccacctctttcctgggcttaaccaggcccggcctctgctcatagtatgcatccacttgggatgtcccccattctgcccctccaaaccccctccttccttcaaagcccaacccagctcctacctcctccaggcagcctattgggattattctagcctatcttatacttaggtgtatcctcattgctttctggtttcttgtctcttcattccaatcagattataagcatcctgagggtaaaactcttgattatacttattcacattcttcacaatgcctagtactgcagtgaacatgcagcagacacctaacaaatacttgtttgttcttaaaagagataaaggagtatgacacaaggagcattttaaaaacaaacaaaaaagagataataaaggtgaaaataatgtttgccacattataggtaatcaatacatgcttattgtacctgaatggataatttctctactcaaaattaacaaatcataaaagaaataatcaaccactcactggcagagaaggtaagagcaacagccccaggatattgggaaccagatatggagtaaggaagagccacacctctcctagctgtgctggctgttaaagattacattttgggccaggcagaagtggtggtttatgtctgttatctctgccctttgggaggctgaagtgggaggattgcttgagctctggagtttgagaccagcctggccaacatagtgtctctacaaaaattttaaaattagccagatgtggtggtgtgaacctgtagtcccaactactcaggaggctaagacaggaagatcacttgagcccaggagttcgaggctgcagtgagctatgattgcacaccactgcactccaacctgggcaacagagtgagatcttgtctcaaaaaaattaattaattaaagtaaatttgaggccagatgtggtggctcatgcctgtaatcccagcactttgggaggccaaggctggtggatcacctgaggtcaggagtttgagaccagcctggccaatatggtgaagccccatctttactaagaatacgaaaatgaggcatggtggcgtgcacctgtagtctctgctactcaagaggctgaggcaggagaatagcttgaacctgggaggtgaaggttgcagtgagccaacatggcaccactgtactccagcctgggtgaccgagcaagactccatctcaaaaaataaaataagataaaaaatgaagtaaatttgaaagattacatttcaaaggaatgtgaacaccttgacatagaataaatacctttaacttactaaaagacaataggggtgattaattagattgcttaatcagattaattcagtcttcatgcaagaaacatcttcaaactgctttagatcgaaaggacatcttccatcatcttaaccggtttgtttgccaacataggatttaattttctgtgtaggcctctgcattttacctatccttctctccatgcatactatctgcctcccaagcagacagctaaatttgatttttcctaaatattcaaaaaaatatctttcaggctggacatagtggctcatgcctgtaatcccagcactttgggaggccaaagcgagtgaattgcttgaggtcaggagttcgagaccagcctaggcaacacagcaagagcccatctctacgaaaaaaataaaaaaagaattagctgggtgtggtgatgtgcacctgcggtcccagctacacaggaagctgaggcagaggatttcttgagccaaagaggtcaaggttgcagtgagccatgttcacgtcactgcactccagcctaggtgacaaagcgaaaccctgtttcccctgcaccacccgccacttgcaaaacacacacacacacacacacacacacacacacacacaccaaaaactttcatgtcttttcagttaacttttaaacaagcccagcaggattgaattatgtggtataattttagggacatttctgcccaggttcatgagtttatccacctgctctaaaacctgaaagaccttgatcaggaatcaaagtgatatatgctgtacttggagacaaagcttaaaagacacatcctcaaaggaaagcaaaaacatttatttaaattcattataaaatattatcttcccaggtgctctattcaatttcttcatcaccatccacacagagaggactcacaaatttatatctccagtgcaaggctctgtgtcctcaggtttcaaactcgattatacaactcacaacttgccttgtcctcctgggattctcaaagccatccaaacttaacatgagttcatgctctccccactccccacactcactgatactcctaacttggtttctatggtcccgtatcccagtgagctagtcatctggttgaacaagcctgaaaggcagaagtcatccatgacagctctctctctcctccatgcccacaccatccctcaattctgtcagaactctccagtgtcttccatcttctccatatcattcagccaaactttgtctaatttaataacctcctaaccagtctatctagagcccttctaaccccagccacacctatataacatattagagcaaaagctcatgtttttcaaaggttagtcaagtgaagcagtgggagtggagaaggaacaaagaaatctgtaactggttgtgatcaattagttgtaaacaccactgcactcagaccagctgcaaaatttgttgttgttgttgttgttttgagatggagtttcactcttgttgcccaggctggagtgcaatggcgcagtcttggctcattgcaacttccaattcccgggttcaagcagtcctcctgtgtcagcctcccaagtagctggaagtataggtgcccgccaccatgcctggctaatttttgtatttttaatagagacagggtttcaccatgttggccaggctggtctcgaactcctgacctcaggtgatctccctgcctcggcctcccagagtgctgggattacaggcgtgggccaccgcacccggcctgcaaaatttttaatacatattatactccttgacctccactatcacagaaactttgctatatactgttttcttgacttaaaacactattccctccttaataactccaactcctccacatttctgctcaagcatcagtttcccagagaagcttttattggcttttatcaccaggtcaaattcctatctcctagtactttgtacagtccttcatagtgctcatcaagttggaatctgacacatatatatgtgttattatatcatctccctcactagtctaagccataaagtcatggatcatgtgcagttttttttctccccactgcatccaaacacctagcatagtgtctggtacatagaagtggtcaaaaaatatttactgagtaaataaatgcataagttaaaatataaataaccaacataaaatccttttccaagaataagtttttatgacagatatcaaccagcagaaaaataaaacattttctagaatgaaagaacatatgaaaaatgcctggcagataataggttcacaattttgtaaaaattcatctgctttatgattttcatagagccaatatctgcaacctgcctttctatgtatttatggagagcaggaccaaagcaacgtaatttgctgctaggatgccagtactaaagtgtttctttttgtctgttcctgcttcctgaacatattttgctttgtgtaaatttactatgaccacacaaaacatatcagacaaaatgaaagacagagttgcaagaatttccaacttgttagttgggtaggatgccttggaaaacaaagtacagggcttcccactatatataaccaactgtctagtcttaaggtgaagataaataatatgttctaggagctgggcatgatggctcatatttgtgatcctaggactttgggaggccaaggcaggaggatcgctttagcccaggagtttgagaccagcctgggcaacatagagagactcagtctcttaaaaaaaaaaaaaagaatatcttctagaaaaggaattatctttaaatactgtacagataattcaggatttcaagtttagtttccacagtgtgtgagtgagacactcaaagggatagaagatgaaatgtttaatctgcgtgagttcgcttaaggacacatcccaataaggaaaagctgtggggcgtatgattgttttataaaacagtgcgaagagaattgtttggcactgtttgcacatgacaggctcacaattcatttctttaaatatgaagccccaaatcaacccatctaaaattatgtttcctaccaagattgcttagttactacacataggaatgtgcataggcctggaggcagcactctcagctcttctgagataatcagttgctcttttatttacaagaatcctggtcaagacactccattcctgtcccatttctctgccactaattgactctgtggctgtaacagggtctcagttcttcatgtgtaaatcaaggagattggatttttttaagtccttaaagttccctccagctcccagtcctttgattcaggcctgaattctagccagtagagtatcaagccacctacacggtttgtcgagttgcacgagcatttaatgaagagtttccctactctttggaagagtctgttcataggagaaatttatgccaccttaataaaatgagcagaggagaaacctgttatttcctcataggtgcataagcagccccgaaatgggagctgactagaggggtgggctgggagacaggagtctgcagggtcaggctgccatgaggttgatagggaagttttgccccactggccagatttctcttcactattgctgcatgcaggctgctgagctcactggtgtcacattcctcagccttgatcctcaggactcaaccaaagaatatcaagatttccacagcacacttgtcttttttcttttaatggaatgaatgatgccatacatttgtcatgtttatagagcagccttccctgcattaaaacacacacacacacacacacacacacacacacacacacacacacatagatatagatatagatatatcccactggaggctttttataaaaaaaacaaaacaaaaaacccacagatatatctattttagatagatagatagatagatagatagatagatagatagatatagatatatagatatattcttccaagtaacactctggcaggattatcccacaacagaaagtgtcaaaggcaaagagaaatgcctatacaagaagaactttttaaaatagaaagcatagattcaaactgcctcaatcactgtgggcttccttccctggcagaggagagacacttccttcattcctttccaaataaagcaccttggctctattcaaggctttactatgggcaggaagaccaatggcaacttcttgatctataggaaagttttatttgttcgactgacctaccagaaaaatattctaaattgaattactttgccatgttttatagatgatacataaattgccttgcccaggatactttttaaaaaaaagttacacaaaacagagcatgtcaaaataattttcaaatataatacctataagatggctaaaatgtagcaaagtataatttgcctaagattgtaatattataaattgagacatgtacttggctataatctacatttgtcatttcttggacaaacttttggttaactctcttctaaattacgtttgcctatgtgtcttgaattaaaaaatggctttaatcgtaaataaacatgagaaaaaagtatttttctatttcgaaagcccacaaggccgggcgtggtggctcacatctgtaatcccagcactttgggaagccgaggcgggtggttcacgaggtcaggagttcaagaccagtctggcctatatagtgaaatcccgtctctactaaaaatacaaaaaattagtcgggcatggtggtgggtgcctataatcccagctacttaggatgctgaggcaggagaatcgcttgaacccaggagacagaggttgcagtgagcggagatgacgccactgcactccagcctgggtgacagtgcaagactctgtctcaaaaaaaaaaaagaaagcccacaatatgaactcattctttcagtatccagtcctacaacctcacctggagtatttttagcctaagccaatctttcaatatttactttgtgtatgtaaataacaatgttcctgtaagtagtgctacttacattctaaaaaagccttgattctaattgccctagtgttgtcattcacgtcttgagggttccagctcaagtttcctgcgtgactggaggcaccgccctcattctatttgattcattatgaataacacaaggataatgatgcctgtaattactgacagtttgccaccttctttgaagttcccaaaagcaaaatgctccaaatgtatgctcataattgtttattagttggtcagtttacaaagccaatttttgtttcctcaaaattaaatggcatttgttcatttttaaaatttgagtgacaatgtttctaagttaaacccaggaggctgggctcagtggctcatgcctgtaatcccagcactttgggaggccgaggtgggcagatcacttgaggtcaggaattcaagaccagcctggccaacatggcgaaacatcgtctctactaaaaacacaaaaattagccaggtgtggtggtgggtgcctgtaatcccagctacacgggaggctgaggcaggagaatcgcttcaacccaggagaccagggggttgcagtgaaccaggatcgcaacactgcactccagcctgggtgacagagctagactctgtctcaaaaaaaaaaaaacaaaaaaaaaacaaaacaaaccacagtgtatatgcatggatacataaattgaaaagtaccattattaatgaaaagtcagcatgtaacaactgttgttttaggataattattactaatgttgaaaataatcaaatctcaccaaagaaaaagagattattttccttataaggcagattacgtgtctcagtgatagtgattcaaaaataatcatttcaaacttcttatcttaagatttttgaggatccaatgtctaaaggtctctctgctccctggccttctcatttcctactatattatagattaaatctcctaacattgctttgaaaacctttgtctggccttccttctgattctactttccattttttacatagtaaatttattgacagtttgatacctaaagctccatgtctattttaatctgtctccatagtaacaaaaccagtgtttagttacattggtttagttacattaagaacactgtagccaggcacagtggctcatgcctgtaatcccagcactttgggaggtcgaggcagggggatcaactgaggttgggtgttcgagaccatcctgaccaacatggagaaaccccgtctctactaaaaatacaaaattagccgggtgtggtggcacatgcctgtaatcccagctactagggaggctgagacaggagaatctcttgaacctgggaggcggaggttgcggtgagcggagatcgtgccattgcactccagcctgggcaacaagagcaaaactctgtctcaaaaaaaaaaacaaaaaaaacaaccacacacacacacacgcacacgcacacactgtaaaacattagaccaaagacaaaaacatagccaagaagaaactgttttctagcacctactctgagtcagtctggtacatttgatctagattccatcatcaacatttttgtaacagaattagctgtgccctttaaatcacccctcttggagaaatgacataaagttgatggtaaaattgtgcattatcctgaaggactgctcaagatgtaatggtaaagacaaataattgcctagactaaaatccaaagggaagacaaattatgggatcaagaggagcttcccatgacttgagcaaaactattacttccatcaagggagcaattccccttcccagcaggaaactcaccgaaatttccctgagtcacttgcgaacaatgttgttataaatgtgacatgaactctcatccacaatcataatcccataatttttaatgttaattttaagccccccatgattatttcatgggcctacaagttatctggataaagacgacagactccaaatgatattcagccaagtgacagtaatcctgaagaaccctgcctgggacggctgaccaccactgcatagttacttacatgtttacatgtcagtttccccagaacctatcattataatgttcaggtgttgtaacacatcaaatattacaacaggagagactgccaaagacttaacgcatgctacaaagacacaatctccttggcaaatgattcagacaattaaaatgacaataacatcaacaaagttggtaaaccaaacctagtgttaaaaaaaaaaaaatgaagctttactgtatggaaaaagaaaagattctggcctagaatcacagaactctatacaaagttggaaagtgccttagaggtcatccagttcagctacccacttgatgaagaaatctattctacaaagttcttgacaagtggttattcagcctctccttgtttatatccagcatcccaatgcaaactaccgccactgagccaaaatttactttgctgaaacttgcactcattgactctgttttgtagagcttttaaatcaattctgccactccctttactagtttagttgggtttttaaaaaatacattataataataatagcaagcatttattgaatacttactatatgctaagtattggactgggtgtttttatatgaactatcttatttatttagtgattatgagcataaactctggaaccagattgtctgagttagaattccaactctgccatttattagctgtaatcattggacaagtcatttaacctgtctatgcctcagttcctcaacaatacaaaatagggataaacataataataaggtctacctagtaggattatgaaaattaaatgccagtgtatgtaaagtgtttagaacagtgcctagcatatgataaaaactgtaaaaatgttgttgtgctgctcattgttagtatgattattattatttgagacggagtcttgctctgtcacccagactggagtgcagtggcgcgatctcagctcactgcaacccctgcctccagggttcaagtggttctcctgcctcagcctccagagtaactgggactaaaggcatgcaccagtacgcctggctaatttttgtatttttagtggagatggggtttcaccacgttgaccaggctggtcttgaactcctgacctcaggtgatccgcccgccttggcctcccaaagtgctgggattacaggcgtgagccaccatacctggcctattattactcccattttacagataaaaagattgaggtttagtaaaaaggttaggcaacttgaggatgggattttcaattatccttgttagatcacatctgaaatcagtttattactcaaagtgtttgctatttattgtgcatttgctattttatttagctttgcacattagtctattttcttttttttttcttcttttttttcagacagggtctcactatattgcccaggccggtcttaaactcctgagctcaagtgatcctccggcttcaaagcctcccagtagctgagattacaggcacaggccaccaggcctggctttagtctatttttaaacagattcaattccaggaactctttccagtgtttgtcctcccgtgaaacaaaacaatctcgcattaatctagagatggtacaggtatgtttggaaaacaatattgcaaaatatatcaacaatcataaaattgttcaaagcattttttttgagactgagtcttgctgtgttgcctaggcttgactggactgcaacagctgttcacaggcacaatcattgcacactacagcctcgagctcttgggctcaagcaatcgtcctgcctcagtcgcccaagtagctgggactgcagtcacacacatctccatatcccactctcaaagtcttagattcaataatatttcttatgaaaagctatcctccagaaataatttaacaaaatgagtaagctacatattcccaaatttttcttatagcattaccagctgaatttccccaaactatattagagataaatattaggggtatagtgacgtaaattataataaacataaaaagaaattatatagttaattaatcattatgatacataaaatcacggaaagaaatttatgatataatattaaataaaaggccaggcacaatggctcacatatgtaatcccagcattttgggaggccaaggcaggaggactgcttgaggccagaagttcaagacctgggcaacacagcgagaccctatctctaccaaaaaaagcacaaaaataagctgagtgtggtaccccacacctgtagtcctagctacttgagagaatgaggcaggaggatcacttgagcccaaaagtttgaggcagcagtgagctgtggtggcactactgtactccagcctgggcaacagagcaagacactgtctctaaaaaaaaaaaaaaaaattaaaattaaagttaaaatttaaaaatatatatataaggccaggcacggtggctcaagcctataatcccagcactttgggaggctgaggtgggcggatcatgaggtcaggagtttgagaccagcctggccaacatggtgaaaccccatctctgctaaaaatactaaaaaattagccaggtgtgttggcgtgcacctgtaatcccagctacttaggaggctgaggcaggagaatcgcttgaaagccggcaggtggaggttgcagtgagccgagatcatgccactgcactccagcctgggcaacagagcaagactctgtctcaaaaaaaaaaaaaaaatgtatacacacacacacacacacacacacacacacacacaatatataatatatattacatatattatatattatataatatatcacatatattatataatatatcacatatatatcacatatattatataatatatcacatatatatcacatatattatatatcacatatatatcacatatattatataatatatcacatatattatatattacatatattatatatcacatatatattatatattacatatattatatattatattacatatattatatattatattaaatatattgtatattatatataatatattaaatatattgtatattatatataatatatacaccatatattatatattatatataatatatggtgtatatatactatatacattatatatacactatatacactatatattatatataatatactatatataatatagtattatagtatataatactatatataatatgtattatagtattatataatatatatactatatataatatagtatatttattatataatactatatattatatatagtattatattatataatactatatattatatatagtattatattatataatatatattatatatagtatatatattagtatatatactaagtatatatactagtatatatactaagtatatatactatatattatatatataaaaacatacatataggctggtgcagtggctcacttggacaagttttatatatatgtatgtttattgtatatatgtgtatatatgtgtatattattttatatacatttatatatttatattcatatataataattatatatatatataataggaggttgaaactgcagggaaccgtgatcatgccactgcactcctgtctgggcaacagagtgagacactgtctcaaaaaaataaataaataaataaatatttaaaaagaacccagggctgggcacggtggctcatgcctgtaatcccagcacaacactttgggaggccgaggggggcagaacacctgaggtcaggagttcgagaccagcctggtcaacatggagaaaccccgactctactaaaaacgaaaaatacaaaaaaaattagctgggcgtgttagtgggagcctgtaatcccagctactcaggaggctgaggcaggagaatcgcttgaacctgggaggcggaggttgcagtgagtcgagatcgtgccattgcactccagcctgggagacaagagggaaactttgtctcaaaacaaaaagaggccgggcgtggtggctcacgcctgtaatcccagcactttgggaggccgaggcaggcggatcacgaggtcaggagatcaagaccatcctggctaacatggtgaaatctcgtctctactaaaaatacaaaaaattgccaggcgcggtggcgggtgcctgtagtcccagctactcgggaggctaaggcaggagaatggcgttaacccgggaggcagagcttgcagtgagccgagattgcgccactgcactccagcctgggggacagagccagactctgtctcaaaaaaaaaaaaaaaaaaaaaaaatcgaaaaattagctgggcctggtggcgggcgcctatagtcccagctactcgggaggctgagccaggagaatggcgtgaacctgggaggcagggcttgcagtgagccgaggttgagccaccgcactacagcctgggcaacagagcgagactccgtctcaaaaagaacaaaagaaaagaaaggaaaggaaaggaaaggaagggaagggaagggaagggaagggaagggaagggaagggaagggaagggaagggaagggaagggaagggaagggaagggaagggaagggaagggaagggaagggaagggaagggaaggaaaggaagggaagggaagggaagggaagggaagggaagggaagggaagggaagggaagggaagggaagggaagggaagggaagggaagggaagggaagggaagggaagggaagggaagggaaaccgactaccacatgttctcatttataagtgggagctaaatgatgacaaatcgtgaaaacaaagaagtcagcaacagacactggggcttccttaaggatggagggtgggagccaggaggggggcagaaaaaataactattggttagtaagtttaatacctgcgtggtgaaataatctgtacaacaaaccctcgtgacacaagtttacctatataacaaacctacacatgtacccctaaacctaaaataaattaaaaaaataaaaccacttaaaaaagtcacaatccccaggaaaacaaaaagctacacatctggagaatctagtaccccaagattaattatacaatgtggtagaaagtggtgctaagaactattaagctgattttaataaaaagggcaaatatctctgattccattttttccaataaattcctataagcaggtgaaagaacacagtacacttagtttccttgtgttaagaaagagcttccttttttttctttttagaatctttgagccactactgtgattaaaatagcactgtatactgttttgtttttgtcgttcaagagaaatgtaaataatgcattatcaaagtatctaaatatctgaaacaactgttgatatgctgacagattatgtggatgaaaataagccagtctaaatgtaaataaattaataaaatatgtaagaacaattaaaactggcctttaatgttgagatattgtttgagaaataagaatatgagattacatatatatatagtagtctctgcttgactcataaaattagagaaccctacagctctccaagcccagatatctgtgggctctctgctgtccacagtacaaagaatctggcatgtacattatgcaagagtggaaaccaagcccaaacagatcagggaaatagtactgtttaaattgtcatgccagcaataggacaactgaaaatgacacccccacagcattgttttctctgcacagtgaatttcacaagtgctctctcatagagggagacatatatgcctgcagcttcctcctcctctgggcctctctctgagtgtaataaaggaaagaagagagagaagcagatctgttaggtctccatgaggcaggcttgtcagatatccatgataccaggccagcgggtactgtggcaaaatcacactgtgggccaacaagggagataactaaccaattgccttctaaggcagtctgccttgcaaatggtcttgaagttgtgaacagaagccctagggagttgcaatggccaagtcctggctttagattagctagctgaggaagaaggagccctgaagtgttaatgacaatctactccacccactcaccagctactggccctcctcagcctctctttcctctctgtttctttctctcacagtcttgaccatggatttctacctttgcactttccttttctaagttttctttagaaaccaaaatggggagggtgaaaaagatgatcttaggcagagatgaaaaagttagtttagtggcagaaaagaacaataaactaaaggaaatggaataattgagaaagagccaaataaagagaatagccattatggactgaattgtggttccttaacaactcaaaatcaggtgctcttatagagaaaagaaatgcctccttttggcagaaaaatcagtaactcactattgcactgtttattgcacaatttatcatcagtggaacttatgagttaacacaggacatttggcactttaggtcctgttagtccagaatcccagcatgttggactatggaaatatttttactagagtcacaaagggttaagcatggaattaaaaagaaaagggaagagagccaagtacagtggctcacatctgtaattccagctattcagaagggtcccttgagctcaggagttcaaacccagcctgggcaacacagtgagaccctgtctctaaaaaataaagggaagggaagacatatggaatgaaaacagcattgctgaaattcatttttattaaataacccaacatttttaaatggggatatgacaataaaatattctggctgagaggggctaaggagtgctgtgttaaaaacagtgacttctggccgggcacggtggctcacgcctgtaatcccagcactttgggaggccggggcagatggattacctgaggtcaggagttcgagaccagcctggccaacatggtgaaatcctgtctctactaaaaatacaaaaattagtcaggtgtggtggcacatgcctgtagtcccagctactcaggaggctgaagcaggagaactgcttgaacccaggaggtggaggttgcagggaactgagactgtgtcactgcattccagcctggggcaacagagtaagactctgtctcaaaaacaaccaaccaaccaacaacaaaaaaaacagtaacttccttttctcagaaaagggaatttgtgtcagtgaatggttcctatggtccatttatcagaagagattcaattgtaaagactcagaaaagaggcctctcaattatctttagactaaaggaacagtgattaattctgagacattacagatggatgtgtgagtaaacaaacgtgggcaggaggaaggttaagaaatgctaccgctgctattatgcctggcgtataatttttttcttctagagctaatcatcctagcatcaaaaacaaaagctgagggattaagctgtgttccaagaacagttttgataatattaattacgttggtaaataaacgcagaaacaacaaacaaaaataaatcaagccatttttcagctccattgaaaaggcagcatttgccagatggaaaaggtctcagcaacagaggaaaaattgctttcaatcttctaaagaaagtctaatcatgaagaccaaagaagacaaactaaaagtctagaataaagtcttgctttattctatttaataaattttaataaatatggtggtcctttgtaatgaaaaaaaaaaaaacactttaatgactgatgtctgttgattctctggaattatatgacaaagttatgtaacaagaatttgcctcatacatctgtgcagtgaactaaaatagtgaaaaaataaagaaaaagaatttgcctcaaacttagttagtcatttgggcagtcatcaaggaaggaacgccaagactttttaataacctgatgtcttcagaagcaaagaccagtcagacaagtttccagatggagataaaaataaatctaaaaaaaaaaaaaaaaaaaagagatcagcattaaatggataagatggagtttgccaacaaagagaagatgagtaattcttgttccatgtgaattaaaaactcactgttcaattaaaaactcaaattatatatctgaaagaaccattgggttaaaaataataataaaataataaataataataaaaaaataaaaactcaaattaattaaaaactcaacaaatcaatcaaatgaattaaaaacaacacaaactctccattatcatttaggtgtctaaacatgctacctcatcagatcattctggattataaacagaacaataatagctcatacatatgattttctttcacatcaagatgtaaaatggttcattaatctcataccactttgaagaacaggtagtaaaacaagaatttaaagccagcactaccagttcaaaaactgctaacctaaccacctcattggattaaggctgagccaccatttgggtgcattacagtcagtgaaaagatcacccgaggtatagagttcaagaccaccctggccaacaaagcaaaaccccatctctactaaaaatacaaaaattagcctggcatggtggtgcacacctgtaatcccagctacttgggaagctgaggcacaggaataacttgaaccctggaggcagaggctgcagtgttcacggctgagatcataccactgtactccagcctggtgacagagaccctgtcacaaagaaaagattttttaaaaaagtatatacactgtaggcagggcgtggtggctcacgtctataatcccggcactttgggaggccgaggtgggcagatcacctgaagtcaggagttgaagaccaacctggccaacatggtgaaatcctgtctctactaaaaatgcaaaaattagccaggtgtggtgtaatcccagctacccagctgtaatcccagctacccaggaggctgaggcaggtgactcacttgaacctgggaggcgaaggttgcagtcagccaagattgtggcactgcactccagcctgggcaacagagtgagactccatctcaaaaaaaaaaaaaaagtatatacactatacactctagaacattgttttctaagctgtgggccacaagtcttaggtcaaaagccatgttcaagttatcttccttgaagccattgaacgcatctcttgtgtaaccattacagtgcagtcttctctagcctggtggtgtcaaaggtaaaaatgatacattaatatgcaattaatatacattaatataggaaaaggccatctgaggtcccattttgagattccttccatccccggtatagttggaggttgcatcgcagtggtggtgtctgctaagacagaactctggctctgctgtattcattcatttacagattcattcatcggtgacttcaacggctggtttaagggaacattgaccacacccattttattaccatcatttcctttagaaaatccagtttccattcaagcccgctaatctccaattccaactagatgatcacctctaagtcacttttatatcaaaattctagagatactggccaggtgcggtggctcacgccattgcactccagcctgggtgacagagcaagactccgtctagaaaaaaaattctaggctgagcacggtggctcacgcctgtaatcccagcactttgggaggccaaggcgggtggatcacgaggtcaggagtttgagaccagcctggccaacatagtgaaacccgtctccactaaaaatacaaaaaaattagccaggtgtgctggtatgtgcctgtaatcccagatactcaggaggctgaggcaggaggatcacgtgaacccaggaggtggaggttacagtgagccaagatcgcaccattgcactccagtccgggtgacaatgcaagactccgtctcaaaaaatgaaaaaaagaaaaaaaagtataggtcaggcgcagtggctcatgcttgtaatcccaacactttgggaggccgaggtgagtggatcacttgagttcaggaattagggaccagcctggccaacatggtgaaactctgtctctactaaaaataacaaaaaaattagctgggcatgatggtgagtacctgtaatcccagttactcgggaggctgaggcaggaaaatctcgtgaacccgggaggcagaggttgcagtgagccacaactgcactattgcactccagcctgggcaacaagaacaaaactctgtctcaaaaaaaaaaaaaagaaaaagaaaaagaaaaaaattccagagataccattgcatttactttttacaaacatttcttttttaggcactgggctgaacactggttggatggtgcctgcttgggctgaggtggagacaggctggagttaggaagataattcttatttctcccagttgggaaagacctagaaaaggatccaggatgtagatgttcctaggtattctcaattttgcaaagctggaaggtgttactttattagattcccacaatgtgcctttcagaaatgacagttaacaattattgggtgccaaaatacatacatggttttttatttacatgcatctaatactgattctgtccctaatatagagcagacactctacaaacacactgaaacatttgcaatcaggtaaactgtgacttgcaaagaggtgggaataactttcccaagattacacactagtacccctaactcccattctgcatgagctgttgatgctactcttccacatatcctcacattctggaacccttcaaaatgacagtaattactttggaggacaggtcctctatgatgtaataaaaataactcttgactgagaattctgttcttgtctcagctctactaattagccctgtgaacgaggacaaatgtctttacctcaccacctctcagtttcctcaactaaaaaatgctaacatgaaatggaatgctctcaaaagtaccttttgttcctaaaattcaaaggtgtaagaagtatatattccatgctgggtgtgctggctcacgcctgtaatcccagcactttgggaggccaaggcaggtggatcatctcagttgaggagttcaagaccagcctgaccaacatggtaaaacctcgtctctactaaaaatacaaaaattgggccgggcgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaataaataaataaataaaaaaaataaaaataaaaaaaataaaataaaaatacaaaaattagttgggtgtggtggcgtgtgcctataatcccagctactcaggaggctgaggcataagaatggcttgaacccaggaggcagaggttgcagtgaactgagatagtgccactgctctccagcctgggcaacagagcgtgacttcgtctaaaaaaaaaaaaaaaaaaaaagaagtatatattctaaattaaggaatatatatttgaaattatgggacatgtcataatttaaattatgtcttagtctataatgatgtatttgaacatgagtatatcttaaaggaaaacgccaagagtttttgtctgatagagggctttaaaatactggctttaaaaaataaataaaaaattaaacattggcttttaataaaatgaatcaacttaaaaattatctggctgggtgtggtggtgtaggtcaataatcccaaaactttgggaggctgaggcagcagaatcactcggccaggagttcaagaccatggggcaatgtagcaaaaccccatctgtatttttatttttattttttttagactgaatcttgctctgtcacctaggctggagtgcagtggcatgatctcagctcactgcaacctccacctctgggttgaagcaattctcctgcctcagcctcctgagtagctgggattacaagtgcctgccaccacgcccagctaatttttgtagttttagtagagacgaggtttcaccatgttggccaagctggtctcgaactcttgacctcaagtgatccgcccacctcagcctcccaaagtgctgggattacaggtgtgagccactgtgcccagcccccattttattaaaaaaaaattatctcatttcagtcacccttttcaggaggatgagcctagctctggcaatgtcttggatttatgaagttcctctcttgaggctgaacagagataggtactttctgcagtggcatcaggacaccccttgacattgtaacatgaaggtggtggcaatggccagtgttgaggggaaatggagagtatctgaaggacaggaggtaggagtaagacaggtggtagcagaggaatgggtgggacccactgacagagtgacacctccagctggccaagctatcagtgtggactttgtgtataggaaacaagcttcatacgtattggtatgtaaccagttccttgatatgcccatcttgagtatgcccactcagcccttcttctgagcttattgtccctcctcctccttctcttgctcaaactcttgcctttacctgtttgaatccctgcctacgcaataccttaaagttgggagttcctgcttgggcaggagtggagacagactgaaatgagaattctgatttcttaaggctcctaagctaggaaataccaagaaaaaggatccaaagttttgacattttaaaatattcgcagttatgtgaagtttgatcccaaaactacaacagatacccacagtattaaaagctaacatttattgagtgcttactaagtgttgggcactgttttaaagagctcatatatgctaactaattttgttttcccaacagccacacgcaataggaactttttttttttaagagtcagggtctcactccgttgcccaggctggagtgggcagcctacgagtgcagtggctcactcgcagctcattgcagccttaaacttttgggctcaagtgatcctttctccaccatgcccagctaatttttaaatttttttgtagagatgtggcttgaggccaggagtccatgaccagcctaggcaacacagcaagaccctgtctcttaaaaaataatttaaaaattggcccagcatggtggtacatgcctgcagtcccagctactcaggaggctgatgtcagggatctttagagcctgcaagattcgaggctgcagtgctatgatgataccactgtactccagcctgggtgacagagtgaaactcaaaacaaacaaacaaacaaaaaccatgcttttttttgttgttcttgtagagacagggtctcgatatgttgccagggctggtctcaaatttctgggctcaagtaatcctcccacctcagcctcccaaagtgctgggattataggtgttagctgctgtgctcggctgttcttggcccatactaagcatttaatgttagctcttgtcataggtagcgttagttctgcaaaattaactcaccctgagagatgatttataaatgttttgctgaggaaacttgaaaaatttctcaagtccaatcatagggtagcaattaaatgtctgagatagtccaggacagcccagcatgagcttcagtattccaagaaccagggctctccagtctttctgtcagtgtaatctgaaggcatgtcccctcaccctagagcatcctagtgctgtgtattaaatgaaacacacacacacacacacacacacacacaataccttcttctaaggataaacaataatttccaaaggtagcgtacttctagtaaggcatatcaagagtaaaaatagcccttttaatacaagatgatcagcacagagatacagatcacagtggagacggcatgtgacattactgttgagccatactggcatctgttagttgaattggttccaagcttctaaactcacacagcttattatcttgtacacataccaagccaaaatgctaaaattgcagttttttctttctttaagcagcattagtttcagcagcaagacatctgtcatctcctatgttaatttctgcaaaggaatgatcgcaaacatgaggacttactaacttcctgtgctgtactcagcgccgaaggagtcagggggtggaggtaaaagatttgttctccaggttgtatgaacgacaacatttttgtgtgtcttcagaaaaatttcagcattttttgctataatcaaactaaacatttacatgtgcatggtttttcaggtgttggttgatatattaacgtaatcgtaaagcatgccaaacaaaatcatgataagcctactgactcagaggtgattaaacctctcaatgaattcacaattatttgtttcaaatgcttcattttcctgattagagagcaaaaataattggagaaattatcaaaactaattaccacttgaaatgtattgtataggccttccaaaaatgaaacatttatgagttgagaaccatattatagttaaatcaaataagagataggaagctgcaaacattacatttcaccttcctgggtagtaatctaaatctaaatttagtgaattttagatgaattttatttaaatcaattccatcctaaattatgtgcatcactgcagtcatttgaaatagtagactgaacagattcagaaaagtactactcagagattagtagaatgaattttttataaaactgccttgattccccttggaattcttttttttttttttttttttcagatggagtctcgctctgtcacccaggctggagtgcagtggcccaatctcggctcactgcaagctccgcctcccgggttcacaccattctcctgcctcagcctcctgagtagctgggattacaggtgcccgccaccacacccagctaatttttttttgtatttttagtagagacggggtttcactgtgttagccaggatggtctcgatctcctgacctcgtgatccgcccgcctcggcctcccaaagtgctgggattacaggcgtaagccaccacgcccggctccccttggaattcttaaaaaagtaaaataaaaatttaaaaactcatctaggggctgagcgtgatggctccttctcaaaaaaaaaaaaaataataataataataattagctgagtatggtaaatcccagctacttgggaggctgaagcaggagaattgcttgaaaccaggaggcagaggttgcagtgagctggccgagatcataccactgcactccaggctgggcaacagagggagactctgtctcaaaaaagaaaaaaagaaaaaaaagcacatttaaaaaaacccagaaaaacaaaaatagaaactcatcttgttctaattctagaaaaaacattagggaagtaattacttgcaacattttacttggtgctaatcaagttaaatttttaaaatgagtgtatataagaagaaatgcagcttattgatcctgaagtagattaggtgccactgatgctgttgaattgagaactttagccggacatgggagtggaggacgagtaaaagatgctgactgggcctagagatcccaaggaggaggacaagggagaggaatgagtgaatcccctaacagtgagagagcaatgccagcaggtggagaaaagagtaaaggcctgagagcagctacagctctgtgatgagacttcttgtatgcaagcgactactgcatggcccacagcagcttgaaataaatgggcaccagctgcagataagacaagtgataataacagctcgaaataaatgggcagactcattcacgccagccttcatcacctagtcgtcaggatatttccttacggttctgaatatgacatttgtttctagttttataactatgaatttatgtgaaactcatgggttttgatttagacaagtagcttttatgtaattagcggtaattccatctttttttttttttttttttgagacagagtctagctgtgtcacccaggctggagtgcagtagtgtgatatcggctcactgcaacctccacctcctgggttcaagcaattctcctgcctcagcctcctgagtagctgggactacaggtgcccaccaccatgcttggctaaattttttttttttttttgtatttttagtagagacgggagtttcaccaggttggccaggctggtcttgaactcctgacctcaggtgatctgcccgcttggcctcccaaagtgctaggattacaggcgtgagccactgctcccagccatgattccatcttagtaaagttctgtgatctgcaaaaaaactaaaaaaaaaaaaaaaaaaaagaaaaatgcaaaagatacattactttttttttttttttgacatggagtttcgctcttgttgtccagcttggagtgcaatggcgcaatatcagctcaccgcaacctctgcctcccgggtagctgggattacaggcatgcaccaccatgcctggctaattttgcatttttggtagagacggggtttctccaagttggtcaggctggtctcgaactcccgacctcaggtgatcctcccgccttggcctcccaaagtgctgggattacaggcatgaaccaccacgcctggcccagaagatatacttctaagaagttaaatgaattattaattagcattatgaaatttcatcttgtttccatcttagcctatatttcaaattcatatatttgtcttaaaatatgcttcagttttttatcctaagaagccatatcatgtaagtcaataatgaatccatatgaaatagttacatgaagttctaactcagaaaacactcagagaaattattttggcataaagaagccactctttggaggcaacagaaattcagattcatactctgccactgttacagagtatggatatttataaaatttgggtaatatgtctttttataatgtcatttttaaaattatcagcactgccggacgcggtggctcatgcctgtaatcccagcactttgggaggctgaggcaggtggatcacgaggtcaggagatcgagaccatcctggctaacacagtgaaaccccgtctctactgaaaatacaaaaacttagccaggcgggccgggtgcggtggcttacgcctgtaatcccagcactttgggagactgagacgggcggatcacaaggtcaggagatcgagaccatcctggctaatacgtgaaaccccgtctctactaaaaatacaaaaaattagcagggcacggtggcgggcgcctgtagtcccagttactccggaggctgaggcaggagaatagcgtgaacccgggaggcggagcttgcagtgagccgagatcgcgccactgcactccagcctgggcgatagagcgagactccgtctcaaaaaacaaaaaaaaaacaaaaaaacttagccaggcgtggtggcaggtgcctgtagtcccagctacttgggaggctgaggcaggagaatggcgtgaacccgggagacggagcttgcagtgagccgatatcgtgccactgcactccagcctgggcgacagagcgagactctgtctcaaaaaataaataaataaataaataaataaaattatcagcaccagaatcgtatttcattgaatatatatccattttcttgcccacctgtgagcctgatcagtttctgacggcagagacagtcttttgtttgttcagggtgtggtcttatgtcagatagaataacagagcaaaacaggatgcacgtgtgtgacaaaaacaggggaatgctagcaattttatgagttttatacttggtggtgcttcatcttaatttcctgtgatttgatgtcttaatctttaattgctccattttgaaatcagccaccagctgcagctaatacaggtcacagtaacctgatgagtcagcctcacactcctgaggccattctgcacatttgccaacaacattcagagcagacgcgaccaaagtgtcataacaagcagactggtcagttgacaaagttagtttagagctgtagctttctcaaagaaagtgtagaccagcagcatcagcatcacctgggaatgtgttagtaatgcaattattgagccccataccagacctagggcatcagaaactctgaaggtggggaccaacaacttaagttttaacaagccatgcaggtgatcctcatgtacattaggtttgagaatcactggattaggtcaggggtccccagccctcagtactggtccatggcctgttaggaaccgggctgcacagcaggaggtgagccgaaggctagtgagcattactaccctagctccacctcctatcagaacagcagcggcattagattctcataggagcacagaccctactttgaactgcacatgtgagggatctaggttgcatactccttatgagaatctaatgcctgatgatctgaagtggaacagtttcatcctgaaaccaacccctgcccactgccctcccagtccatggaaaaactgtcttccatgaaaccagtccctggtgccaaaaagtttggggaccgctggattaggtgcttctctaatgtcatgattttatagaaatttgtgaaacattgattttgtgacaaagcttcaaaggctacttgaataagtagagtgattaaggaagtgttaataagacaaacctggacaaattacttaacttcagtttcctcggtaaagggagattactaatagttctgatctcataggatctgttgtgaggattcaacaagttaatacacatgaaatgctcacaaacagctctgggtgtcctaagtattcaataaatggtcctagggagggaattttattatcctcagttttcaaatgaaggcccagaagtactaggaaggtaaataatttacccaagtaaataaaaattagaatccacacaaattgcaggcttttctccactctactatacttcccagtgagggtggggaggagtataaactggaagaaatattcgacaaactagtgataggttctccagagttactgtccacaatttaaggggggtaaaacaggaactgaagtgctttttcatttttctcaaaccttagggatcgttgatgcaatagcagaaggaaaacattcttacctcctaaaattattgtcttgctgtcagcagagtttgtggtcacctgtgctggcacacagacagcagccaaggggccctacttccatcctaatggatccagccctctggagggtccccattctgttacaaatggttctttatttctaggtggaagaggctataaattctgcaaaactgttgtaattcattttctgctagaccagttagcaagtgttttctaaatacattatcattgtgggtggttttattgttattatcatattactaatgtttagcaattctgtttcttcattcttgctctactgttttttgagacgtggcgcgatctcggctcactgcaacctccaactccctggttcaaacgattctcctgcctcagcctcctgagtagctgggattacaggcatgtaccaccatgcccagctactttttgtattttcagtagagacggggtttcaccatattggccaggctggtctcgaactcctgacctcgtgatctgcctgcctcggcctcccaaagtgctgggattacaggtgtaagccaccgcgcctggcctctagtttgttttctaggagaagtaagatagtagaaatatctaatattctcttccttcctcctcaatctgaccaaattttgcaaaatctaaagtctaaaaagtgccagttgggtgaatgttaatgacaatagggaagtattgctaatccttcagggcatgatcaatggcacatctagtttatctgatacctagaattaatcatttttaaatccctacttttttcatacgacaaaattactttcagtaacaatcatgaaatcaaattaataataaccagaaaaatacagtaaaatttaatttcttttttactttaaaaatattttttagaaacagggtcttgctctgttacccaggctggaatgcaattgtgagatcatagttcactgcaaccttgaactcctatgctcaagagatctccctgcttcagcctccaggcctgaaattttattttattgaacttcatatatatataaaatttcatatgtataaaacatgccaggaggccagcagtggtggtttatgcctataatcccactttgagaggccaaggagggaggattgcttgaggtcaggagtttgagaccagcctggataacatagcaagacctcatctctaccaaaaattaaaaaaaaaaaaaaaaaccaggcgacacacgatggctcacacctgtaatcctagcactttgggatgaaaaggtcaggagtttgagaccagcctggccaacacagtgaaatcccatctctactaaaactacaaaagttagccgggcatggtggcacatgcctgtagtcccagctactcaggaggctgaggcgggagcctgaggcaggataatcgcttgaatccaggaggcggaggttgtggtgagccaagatcgcaccactgcactctagcctggacaacagagtgagactccgtctcaaaaaaaaaaaacaacaaaaaaacaaatgcaatacaattaaaaaaaaaattacacacatacacgaaattataaagcattaatactatttactgtaatcgcattaattgttaaggtgaaaattatacctacatattggttgtttatagtaatgaataatgatgttagcatttcattgcaattaaataagaagaattccagctaatataaagatattatttatgttaaccaggatagtctatttatcaactaaaactagttagctttctgtgcaggagttccagcctctctaaagttatgtgttctggtatttgtccccaaacacttcatgagacccagcccttacaaaactaggcctgacccatggctgaattccatccacaaaaagatgtttagactttagaaaatgttgtaaaattaccaaacaaaaatattgcacctctgtttcactgtacttaattttactctcgaataaaatatccaagtggtcgtgctgagtgacagaattgctgtaattcacattctttttcttatcgttacaatgaccatgccatcattgctcctttcaaacctaccatctagatgcaggaatattagtactacaggggttggaaacacaaactgtgtttccctctccccatacccactcactctagttccacaattccaagccatttccatttagaatttattttcaaaactaatgcttgtatttcaatcccaggacaccaaggggccaagtttgtatttaaaactctttagttggcctggcttggtggctcatgcctgtaatcccagcgctttggaaggccaaggtgggtggatcacgaggtcaggagttccagatcagcctgaccaacgtggtaaaaccccgtctctactaaaaacgcaaaattagccaggcgtggtggcacgtgcctgtaatcccagctactcaggaggctgaggcaggagaatctcttgaacccaggaggtggaggttgcagtgagccaagatggcgccactgcattccagcctgggagacagagtgagactccgtctcaaaaataaataaaataaaataaaataaaataaaataaaactctttagttgccattggaacacaatgtttactttaaaataataaaaagtgctcacttggccaggcacggtggctcactcctataatcccagcactttgggaggcccaggtgggtggatcacttgaggtcaggatttcgagaccaacctggccaacatggtgaaaccccgtctctaccaaaaaatgtaaaaactagctgggtgtggtggtgcgcacctgtagtcccagctactcaggaggctgaggcacgaaaattgcttgaacccgggaggtggaggcttcagtgagctgtggcaccactgcactctagcctgggtaacagaatgagattctgtctcaaaaaaaaagaggtcacttgaagcttatatgtattattcaacagaatgcaacaattgttgacagtgtaaaccaaaaaaaaaaaaaaatttcttagcaagaagtattttgttagtgacatttttagaattgctggtgtatggtcggtttttattacatgtatttttaattctttatagacagtgtatccaattattccctgcacccagagcagactacttccaccgcttccctctccactggcatatgattaagtagaccagtccccttattcttggttgatacatgctgaaatatttaaagatgaagtttcaaaatgtctacaacttaatttcaaatggctaagaaacacacccataaacaaagcacatagagattgataatgaaaatatggggaaacattaacgattgctgaatataaataatcatcattgtaccattctttaaattattttgaaattgtttatgataaaaatattgtaaaaagtactatttttaccctttggctaatacatgagaaaaaaatatgtacatacacatatttatacttttatgttatggataatgtaaggttttttcacttttttttttttttttttgagatagggtctcactctgtcacctaggttggagtgctgagtggtggcaggggtttcagctcactgcaacgtctgcctcccgggctcaggtgatcctcccgcctcagcctctggaatagctgggaccacaggcgtgcaccaccatatccggctaatttttttgtatttttagttgcccaggctggtctcaaactcctggactcaactgatctgcctgcctcagcctcccaaactgctgcaattacaggcatgagccaccacacctggaccaccaattttctaacacacaaatatatttttgtgtttttttgagacagagtctcgctctgttctccaggctggagtgcagtggcacaatcttggctcactgcaacctccgcctcccaggttcaagcgattctcgtgcttcagcctccacagtagctgagattacaggcgtgcacccccacacccagctaatttattttattttatttttatttatttactttttgtgtatgtgaaaaagagtctcgcactgtcaccgaggctggaatgcagtggtgtgatattggttcactgcaatctctgcctcccgggttcaagtgattctcctgcctcagcctcccgagtagcagggactacaggcatgtgccaccatgcccagctaatttttgtatttttagtagaaacggggtttcactatgttggccaggctggcctcaaactcctgacctcaagtgatctgcccacctcggcctcccaaagtgctgggattacaggcgtgagccactgtgcttggcctaaatatatattttaattaaatgataataagtaaatacattagattttttttaaaaaagaaaaaagtaattaaatgatgagaaattgaactctta

SEQ ID NO: 41 - DNA, 24113 bp, Homo sapiens
ataatctacttctatctttcatctttaaaaaaagtttcatagtctttcatgatgcggaagtactttggacttcataaataaataattgattttattatttgcagaattctaattgaatggatgtaacaacatagtaccgtagacaatatttgcagccaggcgcggtggctcacgcctgtaatcccagcactttgggaagctgaggcaggcggatcacgaggccaagagattgagaccatcctggccaacatggcgagaccccgtctctactaaaaatacaaaaactagctgagggtggtagtgcgcgcctgtagtcccagctactctagaggctgaagcaggagaatcgcttgaacctgggaggcggaggttgcagtgagcagagattgcgccactgcactccagcctggcaacagagcaagactccatctcaaaaaaaaaaaaaaaaaaaagaaagaaagaaagaaagaaaggaaagaaagaaaaaagaaaacaatatctgcagtgggttgttgactaattttgtgtgtataggtctgtccatatggatgcatacaagagttttcagaaggatatacacctaaatagtaatagtgattatgtctaagtagtgagattataggtgattttcttcactattctcagctgtatttattcaagtattctgtagaactactatattacttttacattaaagaaaattattagtacgtttctccactgatatggtttggatctgtgtccctagccaaatctcatgccaaaacgtaatcctcaatggccaggtgcagtggctcacgcctgtaatctcagaacttcgggaggctgaggcggaaggatcacaaggtcaggagatcgagaccatcctggctaacacggtgaaaccctgtctccactaaaaacacacacataaaaaattagccgggcgtggtggcaggggcctgtagtcccagctacttggaaggctgaggcaggaaaatggcgtgaacccgagaggcggagcttgcagtgagccgagatcgtgccactgcactccagcctgggcgacagagcaagactccgtctcaaaaaaaaaaaaaaaaaaaaaaaagtcctcaatgttggaggtagggcctagtgggagttgattgctcctggggttggatttctaatgaatggtttcacaccatttcttggtgctgtcctctcaataatgaatgagttctctggcggcgatctggctgtttataagtatggcaccttgccctctttcttgctcggttttcaccatgtggtgtgcctgctcctgattcgccttccaccatgagtaaaagctccttgagacctcctcagaaacagatgccactatgcttcctgtgcagtttgcagaaccatgagccaattaaaccttttttctttataaattacccagtctggccaggcgcggtggctcacgtctgtaaccccaacactttgggaggccgaggcgggaggatcacctgaggtcgggagttcaagaccaacatggggaaaccccgtctctactaaaaatacaaaattagctgggcatggtggcacatgcttgtaatcccagctactcgggaggctgaggcaagagaatcgcttgagcccgggaggcggaggttgcggtgagccgagattgcgccattgtactccagcctgggcaacaagagtgaaactccatctcaaaaaaattaaataaataaataaatacatacataaattacccagtctcaggtatttctttatagcaatgcaagaacagactaataaatccattcagttgagtaaaagagttccaggcactaaatatgagctttagcatcaacatcattaaggaagatactctactggcatagtttcagcaggcagctgggcccatctctttcctgggcttaaccaggctgggtccacctctttcctgggcttaaccaggcccggcctctgctcatagtatgcatccacttgggatgtcccccattctgcccctccaaaccccctccttccttcaaagcccaacccagctcctacctcctccaggcagcctattgggattattctagcctatcttatacttaggtgtatcctcattgctttctggtttcttgtctcttcattccaatcagattataagcatcctgagggtaaaactcttgattatacttattcacattcttcacaatgcctagtactgcagtgaacatgcagcagacacctaacaaatacttgtttgttcttaaaagagataaaggagtatgacacaaggagcattttaaaaacaaacaaaaaagagataataaaggtgaaaataatgtttgccacattataggtaatcaatacatgcttattgtacctgaatggataatttctctactcaaaattaacaaatcataaaagaaataatcaaccactcactggcagagaaggtaagagcaacagccccaggatattgggaaccagatatggagtaaggaagagccacacctctcctagctgtgctggctgttaaagattacattttgggccaggcagaagtggtggtttatgtctgttatctctgccctttgggaggctgaagtgggaggattgcttgagctctggagtttgagaccagcctggccaacatagtgtctctacaaaaattttaaaattagccagatgtggtggtgtgaacctgtagtcccaactactcaggaggctaagacaggaagatcacttgagcccaggagttcgaggctgcagtgagctatgattgcacaccactgcactccaacctgggcaacagagtgagatcttgtctcaaaaaaattaattaattaaagtaaatttgaggccagatgtggtggctcatgcctgtaatcccagcactttgggaggccaaggctggtggatcacctgaggtcaggagtttgagaccagcctggccaatatggtgaagccccatctttactaagaatacgaaaatgaggcatggtggcgtgcacctgtagtctctgctactcaagaggctgaggcaggagaatagcttgaacctgggaggtgaaggttgcagtgagccaacatggcaccactgtactccagcctgggtgaccgagcaagactccatctcaaaaaataaaataagataaaaaatgaagtaaatttgaaagattacatttcaaaggaatgtgaacaccttgacatagaataaatacctttaacttactaaaagacaataggggtgattaattagattgcttaatcagattaattcagtcttcatgcaagaaacatcttcaaactgctttagatcgaaaggacatcttccatcatcttaaccggtttgtttgccaacataggatttaattttctgtgtaggcctctgcattttacctatccttctctccatgcatactatctgcctcccaagcagacagctaaatttgatttttcctaaatattcaaaaaaatatctttcaggctggacatagtggctcatgcctgtaatcccagcactttgggaggccaaagcgagtgaattgcttgaggtcaggagttcgagaccagcctaggcaacacagcaagagcccatctctacgaaaaaaataaaaaaagaattagctgggtgtggtgatgtgcacctgcggtcccagctacacaggaagctgaggcagaggatttcttgagccaaagaggtcaaggttgcagtgagccatgttcacgtcactgcactccagcctaggtgacaaagcgaaaccctgtttcccctgcaccacccgccacttgcaaaacacacacacacacacacacacacacacacacacacaccaaaaactttcatgtcttttcagttaacttttaaacaagcccagcaggattgaattatgtggtataattttagggacatttctgcccaggttcatgagtttatccacctgctctaaaacctgaaagaccttgatcaggaatcaaagtgatatatgctgtacttggagacaaagcttaaaagacacatcctcaaaggaaagcaaaaacatttatttaaattcattataaaatattatcttcccaggtgctctattcaatttcttcatcaccatccacacagagaggactcacaaatttatatctccagtgcaaggctctgtgtcctcaggtttcaaactcgattatacaactcacaacttgccttgtcctcctgggattctcaaagccatccaaacttaacatgagttcatgctctccccactccccacactcactgatactcctaacttggtttctatggtcccgtatcccagtgagctagtcatctggttgaacaagcctgaaaggcagaagtcatccatgacagctctctctctcctccatgcccacaccatccctcaattctgtcagaactctccagtgtcttccatcttctccatatcattcagccaaactttgtctaatttaataacctcctaaccagtctatctagagcccttctaaccccagccacacctatataacatattagagcaaaagctcatgtttttcaaaggttagtcaagtgaagcagtgggagtggagaaggaacaaagaaatctgtaactggttgtgatcaattagttgtaaacaccactgcactcagaccagctgcaaaatttgttgttgttgttgttgttttgagatggagtttcactcttgttgcccaggctggagtgcaatggcgcagtcttggctcattgcaacttccaattcccgggttcaagcagtcctcctgtgtcagcctcccaagtagctggaagtataggtgcccgccaccatgcctggctaatttttgtatttttaatagagacagggtttcaccatgttggccaggctggtctcgaactcctgacctcaggtgatctccctgcctcggcctcccagagtgctgggattacaggcgtgggccaccgcacccggcctgcaaaatttttaatacatattatactccttgacctccactatcacagaaactttgctatatactgttttcttgacttaaaacactattccctccttaataactccaactcctccacatttctgctcaagcatcagtttcccagagaagcttttattggcttttatcaccaggtcaaattcctatctcctagtactttgtacagtccttcatagtgctcatcaagttggaatctgacacatatatatgtgttattatatcatctccctcactagtctaagccataaagtcatggatcatgtgcagttttttttctccccactgcatccaaacacctagcatagtgtctggtacatagaagtggtcaaaaaatatttactgagtaaataaatgcataagttaaaatataaataaccaacataaaatccttttccaagaataagtttttatgacagatatcaaccagcagaaaaataaaacattttctagaatgaaagaacatatgaaaaatgcctggcagataataggttcacaattttgtaaaaattcatctgctttatgattttcatagagccaatatctgcaacctgcctttctatgtatttatggagagcaggaccaaagcaacgtaatttgctgctaggatgccagtactaaagtgtttctttttgtctgttcctgcttcctgaacatattttgctttgtgtaaatttactatgaccacacaaaacatatcagacaaaatgaaagacagagttgcaagaatttccaacttgttagttgggtaggatgccttggaaaacaaagtacagggcttcccactatatataaccaactgtctagtcttaaggtgaagataaataatatgttctaggagctgggcatgatggctcatatttgtgatcctaggactttgggaggccaaggcaggaggatcgctttagcccaggagtttgagaccagcctgggcaacatagagagactcagtctcttaaaaaaaaaaaaaagaatatcttctagaaaaggaattatctttaaatactgtacagataattcaggatttcaagtttagtttccacagtgtgtgagtgagacactcaaagggatagaagatgaaatgtttaatctgcgtgagttcgcttaaggacacatcccaataaggaaaagctgtggggcgtatgattgttttataaaacagtgcgaagagaattgtttggcactgtttgcacatgacaggctcacaattcatttctttaaatatgaagccccaaatcaacccatctaaaattatgtttcctaccaagattgcttagttactacacataggaatgtgcataggcctggaggcagcactctcagctcttctgagataatcagttgctcttttatttacaagaatcctggtcaagacactccattcctgtcccatttctctgccactaattgactctgtggctgtaacagggtctcagttcttcatgtgtaaatcaaggagattggatttttttaagtccttaaagttccctccagctcccagtcctttgattcaggcctgaattctagccagtagagtatcaagccacctacacggtttgtcgagttgcacgagcatttaatgaagagtttccctactctttggaagagtctgttcataggagaaatttatgccaccttaataaaatgagcagaggagaaacctgttatttcctcataggtgcataagcagccccgaaatgggagctgactagaggggtgggctgggagacaggagtctgcagggtcaggctgccatgaggttgatagggaagttttgccccactggccagatttctcttcactattgctgcatgcaggctgctgagctcactggtgtcacattcctcagccttgatcctcaggactcaaccaaagaatatcaagatttccacagcacacttgtcttttttcttttaatggaatgaatgatgccatacatttgtcatgtttatagagcagccttccctgcattaaaacacacacacacacacacacacacacacacacacacacacacacatagatatagatatagatatatcccactggaggctttttataaaaaaaacaaaacaaaaaacccacagatatatctattttagatagatagatagatagatagatagatagatagatagatatagatatatagatatattcttccaagtaacactctggcaggattatcccacaacagaaagtgtcaaaggcaaagagaaatgcctatacaagaagaactttttaaaatagaaagcatagattcaaactgcctcaatcactgtgggcttccttccctggcagaggagagacacttccttcattcctttccaaataaagcaccttggctctattcaaggctttactatgggcaggaagaccaatggcaacttcttgatctataggaaagttttatttgttcgactgacctaccagaaaaatattctaaattgaattactttgccatgttttatagatgatacataaattgccttgcccaggatactttttaaaaaaaagttacacaaaacagagcatgtcaaaataattttcaaatataatacctataagatggctaaaatgtagcaaagtataatttgcctaagattgtaatattataaattgagacatgtacttggctataatctacatttgtcatttcttggacaaacttttggttaactctcttctaaattacgtttgcctatgtgtcttgaattaaaaaatggctttaatcgtaaataaacatgagaaaaaagtatttttctatttcgaaagcccacaaggccgggcgtggtggctcacatctgtaatcccagcactttgggaagccgaggcgggtggttcacgaggtcaggagttcaagaccagtctggcctatatagtgaaatcccgtctctactaaaaatacaaaaaattagtcgggcatggtggtgggtgcctataatcccagctacttaggatgctgaggcaggagaatcgcttgaacccaggagacagaggttgcagtgagcggagatgacgccactgcactccagcctgggtgacagtgcaagactctgtctcaaaaaaaaaaaagaaagcccacaatatgaactcattctttcagtatccagtcctacaacctcacctggagtatttttagcctaagccaatctttcaatatttactttgtgtatgtaaataacaatgttcctgtaagtagtgctacttacattctaaaaaagccttgattctaattgccctagtgttgtcattcacgtcttgagggttccagctcaagtttcctgcgtgactggaggcaccgccctcattctatttgattcattatgaataacacaaggataatgatgcctgtaattactgacagtttgccaccttctttgaagttcccaaaagcaaaatgctccaaatgtatgctcataattgtttattagttggtcagtttacaaagccaatttttgtttcctcaaaattaaatggcatttgttcatttttaaaatttgagtgacaatgtttctaagttaaacccaggaggctgggctcagtggctcatgcctgtaatcccagcactttgggaggccgaggtgggcagatcacttgaggtcaggaattcaagaccagcctggccaacatggcgaaacatcgtctctactaaaaacacaaaaattagccaggtgtggtggtgggtgcctgtaatcccagctacacgggaggctgaggcaggagaatcgcttcaacccaggagaccagggggttgcagtgaaccaggatcgcaacactgcactccagcctgggtgacagagctagactctgtctcaaaaaaaaaaaaacaaaaaaaaaacaaaacaaaccacagtgtatatgcatggatacataaattgaaaagtaccattattaatgaaaagtcagcatgtaacaactgttgttttaggataattattactaatgttgaaaataatcaaatctcaccaaagaaaaagagattattttccttataaggcagattacgtgtctcagtgatagtgattcaaaaataatcatttcaaacttcttatcttaagatttttgaggatccaatgtctaaaggtctctctgctccctggccttctcatttcctactatattatagattaaatctcctaacattgctttgaaaacctttgtctggccttccttctgattctactttccattttttacatagtaaatttattgacagtttgatacctaaagctccatgtctattttaatctgtctccatagtaacaaaaccagtgtttagttacattggtttagttacattaagaacactgtagccaggcacagtggctcatgcctgtaatcccagcactttgggaggtcgaggcagggggatcaactgaggttgggtgttcgagaccatcctgaccaacatggagaaaccccgtctctactaaaaatacaaaattagccgggtgtggtggcacatgcctgtaatcccagctactagggaggctgagacaggagaatctcttgaacctgggaggcggaggttgcggtgagcggagatcgtgccattgcactccagcctgggcaacaagagcaaaactctgtctcaaaaaaaaaaacaaaaaaaacaaccacacacacacacacgcacacgcacacactgtaaaacattagaccaaagacaaaaacatagccaagaagaaactgttttctagcacctactctgagtcagtctggtacatttgatctagattccatcatcaacatttttgtaacagaattagctgtgccctttaaatcacccctcttggagaaatgacataaagttgatggtaaaattgtgcattatcctgaaggactgctcaagatgtaatggtaaagacaaataattgcctagactaaaatccaaagggaagacaaattatgggatcaagaggagcttcccatgacttgagcaaaactattacttccatcaagggagcaattccccttcccagcaggaaactcaccgaaatttccctgagtcacttgcgaacaatgttgttataaatgtgacatgaactctcatccacaatcataatcccataatttttaatgttaattttaagccccccatgattatttcatgggcctacaagttatctggataaagacgacagactccaaatgatattcagccaagtgacagtaatcctgaagaaccctgcctgggacggctgaccaccactgcatagttacttacatgtttacatgtcagtttccccagaacctatcattataatgttcaggtgttgtaacacatcaaatattacaacaggagagactgccaaagacttaacgcatgctacaaagacacaatctccttggcaaatgattcagacaattaaaatgacaataacatcaacaaagttggtaaaccaaacctagtgttaaaaaaaaaaaaatgaagctttactgtatggaaaaagaaaagattctggcctagaatcacagaactctatacaaagttggaaagtgccttagaggtcatccagttcagctacccacttgatgaagaaatctattctacaaagttcttgacaagtggttattcagcctctccttgtttatatccagcatcccaatgcaaactaccgccactgagccaaaatttactttgctgaaacttgcactcattgactctgttttgtagagcttttaaatcaattctgccactccctttactagtttagttgggtttttaaaaaatacattataataataatagcaagcatttattgaatacttactatatgctaagtattggactgggtgtttttatatgaactatcttatttatttagtgattatgagcataaactctggaaccagattgtctgagttagaattccaactctgccatttattagctgtaatcattggacaagtcatttaacctgtctatgcctcagttcctcaacaatacaaaatagggataaacataataataaggtctacctagtaggattatgaaaattaaatgccagtgtatgtaaagtgtttagaacagtgcctagcatatgataaaaactgtaaaaatgttgttgtgctgctcattgttagtatgattattattatttgagacggagtcttgctctgtcacccagactggagtgcagtggcgcgatctcagctcactgcaacccctgcctccagggttcaagtggttctcctgcctcagcctccagagtaactgggactaaaggcatgcaccagtacgcctggctaatttttgtatttttagtggagatggggtttcaccacgttgaccaggctggtcttgaactcctgacctcaggtgatccgcccgccttggcctcccaaagtgctgggattacaggcgtgagccaccatacctggcctattattactcccattttacagataaaaagattgaggtttagtaaaaaggttaggcaacttgaggatgggattttcaattatccttgttagatcacatctgaaatcagtttattactcaaagtgtttgctatttattgtgcatttgctattttatttagctttgcacattagtctattttcttttttttttcttcttttttttcagacagggtctcactatattgcccaggccggtcttaaactcctgagctcaagtgatcctccggcttcaaagcctcccagtagctgagattacaggcacaggccaccaggcctggctttagtctatttttaaacagattcaattccaggaactctttccagtgtttgtcctcccgtgaaacaaaacaatctcgcattaatctagagatggtacaggtatgtttggaaaacaatattgcaaaatatatcaacaatcataaaattgttcaaagcattttttttgagactgagtcttgctgtgttgcctaggcttgactggactgcaacagctgttcacaggcacaatcattgcacactacagcctcgagctcttgggctcaagcaatcgtcctgcctcagtcgcccaagtagctgggactgcagtcacacacatctccatatcccactctcaaagtcttagattcaataatatttcttatgaaaagctatcctccagaaataatttaacaaaatgagtaagctacatattcccaaatttttcttatagcattaccagctgaatttccccaaactatattagagataaatattaggggtatagtgacgtaaattataataaacataaaaagaaattatatagttaattaatcattatgatacataaaatcacggaaagaaatttatgatataatattaaataaaaggccaggcacaatggctcacatatgtaatcccagcattttgggaggccaaggcaggaggactgcttgaggccagaagttcaagacctgggcaacacagcgagaccctatctctaccaaaaaaagcacaaaaataagctgagtgtggtaccccacacctgtagtcctagctacttgagagaatgaggcaggaggatcacttgagcccaaaagtttgaggcagcagtgagctgtggtggcactactgtactccagcctgggcaacagagcaagacactgtctctaaaaaaaaaaaaaaaaattaaaattaaagttaaaatttaaaaatatatatataaggccaggcacggtggctcaagcctataatcccagcactttgggaggctgaggtgggcggatcatgaggtcaggagtttgagaccagcctggccaacatggtgaaaccccatctctgctaaaaatactaaaaaattagccaggtgtgttggcgtgcacctgtaatcccagctacttaggaggctgaggcaggagaatcgcttgaaagccggcaggtggaggttgcagtgagccgagatcatgccactgcactccagcctgggcaacagagcaagactctgtctcaaaaaaaaaaaaaaaatgtatacacacacacacacacacacacacacacacacacaatatataatatatattacatatattatatattatataatatatcacatatattatataatatatcacatatatatcacatatattatataatatatcacatatatatcacatatattatatatcacatatatatcacatatattatataatatatcacatatattatatattacatatattatatatcacatatatattatatattacatatattatatattatattacatatattatatattatattaaatatattgtatattatatataatatattaaatatattgtatattatatataatatatacaccatatattatatattatatataatatatggtgtatatatactatatacattatatatacactatatacactatatattatatataatatactatatataatatagtattatagtatataatactatatataatatgtattatagtattatataatatatatactatatataatatagtatatttattatataatactatatattatatatagtattatattatataatactatatattatatatagtattatattatataatatatattatatatagtatatatattagtatatatactaagtatatatactagtatatatactaagtatatatactatatattatatatataaaaacatacatataggctggtgcagtggctcacttggacaagttttatatatatgtatgtttattgtatatatgtgtatatatgtgtatattattttatatacatttatatatttatattcatatataataattatatatatatataataggaggttgaaactgcagggaaccgtgatcatgccactgcactcctgtctgggcaacagagtgagacactgtctcaaaaaaataaataaataaataaatatttaaaaagaacccagggctgggcacggtggctcatgcctgtaatcccagcacaacactttgggaggccgaggggggcagaacacctgaggtcaggagttcgagaccagcctggtcaacatggagaaaccccgactctactaaaaacgaaaaatacaaaaaaaattagctgggcgtgttagtgggagcctgtaatcccagctactcaggaggctgaggcaggagaatcgcttgaacctgggaggcggaggttgcagtgagtcgagatcgtgccattgcactccagcctgggagacaagagggaaactttgtctcaaaacaaaaagaggccgggcgtggtggctcacgcctgtaatcccagcactttgggaggccgaggcaggcggatcacgaggtcaggagatcaagaccatcctggctaacatggtgaaatctcgtctctactaaaaatacaaaaaattgccaggcgcggtggcgggtgcctgtagtcccagctactcgggaggctaaggcaggagaatggcgttaacccgggaggcagagcttgcagtgagccgagattgcgccactgcactccagcctgggggacagagccagactctgtctcaaaaaaaaaaaaaaaaaaaaaaaatcgaaaaattagctgggcctggtggcgggcgcctatagtcccagctactcgggaggctgagccaggagaatggcgtgaacctgggaggcagggcttgcagtgagccgaggttgagccaccgcactacagcctgggcaacagagcgagactccgtctcaaaaagaacaaaagaaaagaaaggaaaggaaaggaaaggaagggaagggaagggaagggaagggaagggaagggaagggaagggaagggaagggaagggaagggaagggaagggaagggaagggaagggaagggaagggaagggaagggaagggaaggaaaggaagggaagggaagggaagggaagggaagggaagggaagggaagggaagggaagggaagggaagggaagggaagggaagggaagggaagggaagggaagggaagggaagggaagggaaaccgactaccacatgttctcatttataagtgggagctaaatgatgacaaatcgtgaaaacaaagaagtcagcaacagacactggggcttccttaaggatggagggtgggagccaggaggggggcagaaaaaataactattggttagtaagtttaatacctgcgtggtgaaataatctgtacaacaaaccctcgtgacacaagtttacctatataacaaacctacacatgtacccctaaacctaaaataaattaaaaaaataaaaccacttaaaaaagtcacaatccccaggaaaacaaaaagctacacatctggagaatctagtaccccaagattaattatacaatgtggtagaaagtggtgctaagaactattaagctgattttaataaaaagggcaaatatctctgattccattttttccaataaattcctataagcaggtgaaagaacacagtacacttagtttccttgtgttaagaaagagcttccttttttttctttttagaatctttgagccactactgtgattaaaatagcactgtatactgttttgtttttgtcgttcaagagaaatgtaaataatgcattatcaaagtatctaaatatctgaaacaactgttgatatgctgacagattatgtggatgaaaataagccagtctaaatgtaaataaattaataaaatatgtaagaacaattaaaactggcctttaatgttgagatattgtttgagaaataagaatatgagattacatatatatatagtagtctctgcttgactcataaaattagagaaccctacagctctccaagcccagatatctgtgggctctctgctgtccacagtacaaagaatctggcatgtacattatgcaagagtggaaaccaagcccaaacagatcagggaaatagtactgtttaaattgtcatgccagcaataggacaactgaaaatgacacccccacagcattgttttctctgcacagtgaatttcacaagtgctctctcatagagggagacatatatgcctgcagcttcctcctcctctgggcctctctctgagtgtaataaaggaaagaagagagagaagcagatctgttaggtctccatgaggcaggcttgtcagatatccatgataccaggccagcgggtactgtggcaaaatcacactgtgggccaacaagggagataactaaccaattgccttctaaggcagtctgccttgcaaatggtcttgaagttgtgaacagaagccctagggagttgcaatggccaagtcctggctttagattagctagctgaggaagaaggagccctgaagtgttaatgacaatctactccacccactcaccagctactggccctcctcagcctctctttcctctctgtttctttctctcacagtcttgaccatggatttctacctttgcactttccttttctaagttttctttagaaaccaaaatggggagggtgaaaaagatgatcttaggcagagatgaaaaagttagtttagtggcagaaaagaacaataaactaaaggaaatggaataattgagaaagagccaaataaagagaatagccattatggactgaattgtggttccttaacaactcaaaatcaggtgctcttatagagaaaagaaatgcctccttttggcagaaaaatcagtaactcactattgcactgtttattgcacaatttatcatcagtggaacttatgagttaacacaggacatttggcactttaggtcctgttagtccagaatcccagcatgttggactatggaaatatttttactagagtcacaaagggttaagcatggaattaaaaagaaaagggaagagagccaagtacagtggctcacatctgtaattccagctattcagaagggtcccttgagctcaggagttcaaacccagcctgggcaacacagtgagaccctgtctctaaaaaataaagggaagggaagacatatggaatgaaaacagcattgctgaaattcatttttattaaataacccaacatttttaaatggggatatgacaataaaatattctggctgagaggggctaaggagtgctgtgttaaaaacagtgacttctggccgggcacggtggctcacgcctgtaatcccagcactttgggaggccggggcagatggattacctgaggtcaggagttcgagaccagcctggccaacatggtgaaatcctgtctctactaaaaatacaaaaattagtcaggtgtggtggcacatgcctgtagtcccagctactcaggaggctgaagcaggagaactgcttgaacccaggaggtggaggttgcagggaactgagactgtgtcactgcattccagcctggggcaacagagtaagactctgtctcaaaaacaaccaaccaaccaacaacaaaaaaaacagtaacttccttttctcagaaaagggaatttgtgtcagtgaatggttcctatggtccatttatcagaagagattcaattgtaaagactcagaaaagaggcctctcaattatctttagactaaaggaacagtgattaattctgagacattacagatggatgtgtgagtaaacaaacgtgggcaggaggaaggttaagaaatgctaccgctgctattatgcctggcgtataatttttttcttctagagctaatcatcctagcatcaaaaacaaaagctgagggattaagctgtgttccaagaacagttttgataatattaattacgttggtaaataaacgcagaaacaacaaacaaaaataaatcaagccatttttcagctccattgaaaaggcagcatttgccagatggaaaaggtctcagcaacagaggaaaaattgctttcaatcttctaaagaaagtctaatcatgaagaccaaagaagacaaactaaaagtctagaataaagtcttgctttattctatttaataaattttaataaatatggtggtcctttgtaatgaaaaaaaaaaaaacactttaatgactgatgtctgttgattctctggaattatatgacaaagttatgtaacaagaatttgcctcatacatctgtgcagtgaactaaaatagtgaaaaaataaagaaaaagaatttgcctcaaacttagttagtcatttgggcagtcatcaaggaaggaacgccaagactttttaataacctgatgtcttcagaagcaaagaccagtcagacaagtttccagatggagataaaaataaatctaaaaaaaaaaaaaaaaaaaagagatcagcattaaatggataagatggagtttgccaacaaagagaagatgagtaattcttgttccatgtgaattaaaaactcactgttcaattaaaaactcaaattatatatctgaaagaaccattgggttaaaaataataataaaataataaataataataaaaaaataaaaactcaaattaattaaaaactcaacaaatcaatcaaatgaattaaaaacaacacaaactctccattatcatttaggtgtctaaacatgctacctcatcagatcattctggattataaacagaacaataatagctcatacatatgattttctttcacatcaagatgtaaaatggttcattaatctcataccactttgaagaacaggtagtaaaacaagaatttaaagccagcactaccagttcaaaaactgctaacctaaccacctcattggattaaggctgagccaccatttgggtgcattacagtcagtgaaaagatcacccgaggtatagagttcaagaccaccctggccaacaaagcaaaaccccatctctactaaaaatacaaaaattagcctggcatggtggtgcacacctgtaatcccagctacttgggaagctgaggcacaggaataacttgaaccctggaggcagaggctgcagtgttcacggctgagatcataccactgtactccagcctggtgacagagaccctgtcacaaagaaaagattttttaaaaaagtatatacactgtaggcagggcgtggtggctcacgtctataatcccggcactttgggaggccgaggtgggcagatcacctgaagtcaggagttgaagaccaacctggccaacatggtgaaatcctgtctctactaaaaatgcaaaaattagccaggtgtggtgtaatcccagctacccagctgtaatcccagctacccaggaggctgaggcaggtgactcacttgaacctgggaggcgaaggttgcagtcagccaagattgtggcactgcactccagcctgggcaacagagtgagactccatctcaaaaaaaaaaaaaaagtatatacactatacactctagaacattgttttctaagctgtgggccacaagtcttaggtcaaaagccatgttcaagttatcttccttgaagccattgaacgcatctcttgtgtaaccattacagtgcagtcttctctagcctggtggtgtcaaaggtaaaaatgatacattaatatgcaattaatatacattaatataggaaaaggccatctgaggtcccattttgagattccttccatccccggtatagttggaggttgcatcgcagtggtggtgtctgctaagacagaactctggctctgctgtattcattcatttacagattcattcatcggtgacttcaacggctggtttaagggaacattgaccacacccattttattaccatcatttcctttagaaaatccagtttccattcaagcccgctaatctccaattccaactagatgatcacctctaagtcacttttatatcaaaattctagagatactggccaggtgcggtggctcacgccattgcactccagcctgggtgacagagcaagactccgtctagaaaaaaaattctaggctgagcacggtggctcacgcctgtaatcccagcactttgggaggccaaggcgggtggatcacgaggtcaggagtttgagaccagcctggccaacatagtgaaacccgtctccactaaaaatacaaaaaaattagccaggtgtgctggtatgtgcctgtaatcccagatactcaggaggctgaggcaggaggatcacgtgaacccaggaggtggaggttacagtgagccaagatcgcaccattgcactccagtccgggtgacaatgcaagactccgtctcaaaaaatgaaaaaaagaaaaaaaagtataggtcaggcgcagtggctcatgcttgtaatcccaacactttgggaggccgaggtgagtggatcacttgagttcaggaattagggaccagcctggccaacatggtgaaactctgtctctactaaaaataacaaaaaaattagctgggcatgatggtgagtacctgtaatcccagttactcgggaggctgaggcaggaaaatctcgtgaacccgggaggcagaggttgcagtgagccacaactgcactattgcactccagcctgggcaacaagaacaaaactctgtctcaaaaaaaaaaaaaagaaaaagaaaaagaaaaaaattccagagataccattgcatttactttttacaaacatttcttttttaggcactgggctgaacactggttggatggtgcctgcttgggctgaggtggagacaggctggagttaggaagataattcttatttctcccagttgggaaagacctagaaaaggatccaggatgtagatgttcctaggtattctcaattttgcaaagctggaaggtgttactttattagattcccacaatgtgcctttcagaaatgacagttaacaattattgggtgccaaaatacatacatggttttttatttacatgcatctaatactgattctgtccctaatatagagcagacactctacaaacacactgaaacatttgcaatcaggtaaactgtgacttgcaaagaggtgggaataactttcccaagattacacactagtacccctaactcccattctgcatgagctgttgatgctactcttccacatatcctcacattctggaacccttcaaaatgacagtaattactttggaggacaggtcctctatgatgtaataaaaataactcttgactgagaattctgttcttgtctcagctctactaattagccctgtgaacgaggacaaatgtctttacctcaccacctctcagtttcctcaactaaaaaatgctaacatgaaatggaatgctctcaaaagtaccttttgttcctaaaattcaaaggtgtaagaagtatatattccatgctgggtgtgctggctcacgcctgtaatcccagcactttgggaggccaaggcaggtggatcatctcagttgaggagttcaagaccagcctgaccaacatggtaaaacctcgtctctactaaaaatacaaaaattgggccgggcgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaataaataaataaataaaaaaaataaaaataaaaaaaataaaataaaaatacaaaaattagttgggtgtggtggcgtgtgcctataatcccagctactcaggaggctgaggcataagaatggcttgaacccaggaggcagaggttgcagtgaactgagatagtgccactgctctccagcctgggcaacagagcgtgacttcgtctaaaaaaaaaaaaaaaaaaaaagaagtatatattctaaattaaggaatatatatttgaaattatgggacatgtcataatttaaattatgtcttagtctataatgatgtatttgaacatgagtatatcttaaaggaaaacgccaagagtttttgtctgatagagggctttaaaatactggctttaaaaaataaataaaaaattaaacattggcttttaataaaatgaatcaacttaaaaattatctggctgggtgtggtggtgtaggtcaataatcccaaaactttgggaggctgaggcagcagaatcactcggccaggagttcaagaccatggggcaatgtagcaaaaccccatctgtatttttatttttattttttttagactgaatcttgctctgtcacctaggctggagtgcagtggcatgatctcagctcactgcaacctccacctctgggttgaagcaattctcctgcctcagcctcctgagtagctgggattacaagtgcctgccaccacgcccagctaatttttgtagttttagtagagacgaggtttcaccatgttggccaagctggtctcgaactcttgacctcaagtgatccgcccacctcagcctcccaaagtgctgggattacaggtgtgagccactgtgcccagcccccattttattaaaaaaaaattatctcatttcagtcacccttttcaggaggatgagcctagctctggcaatgtcttggatttatgaagttcctctcttgaggctgaacagagataggtactttctgcagtggcatcaggacaccccttgacattgtaacatgaaggtggtggcaatggccagtgttgaggggaaatggagagtatctgaaggacaggaggtaggagtaagacaggtggtagcagaggaatgggtgggacccactgacagagtgacacctccagctggccaagctatcagtgtggactttgtgtataggaaacaagcttcatacgtattggtatgtaaccagttccttgatatgcccatcttgagtatgcccactcagcccttcttctgagcttattgtccctcctcctccttctcttgctcaaactcttgcctttacctgtttgaatccctgcctacgcaataccttaaagttgggagttcctgcttgggcaggagtggagacagactgaaatgagaattctgatttcttaaggctcctaagctaggaaataccaagaaaaaggatccaaagttttgacattttaaaatattcgcagttatgtgaagtttgatcccaaaactacaacagatacccacagtattaaaagctaacatttattgagtgcttactaagtgttgggcactgttttaaagagctcatatatgctaactaattttgttttcccaacagccacacgcaataggaactttttttttttaagagtcagggtctcactccgttgcccaggctggagtgggcagcctacgagtgcagtggctcactcgcagctcattgcagccttaaacttttgggctcaagtgatcctttctccaccatgcccagctaatttttaaatttttttgtagagatgtggcttgaggccaggagtccatgaccagcctaggcaacacagcaagaccctgtctcttaaaaaataatttaaaaattggcccagcatggtggtacatgcctgcagtcccagctactcaggaggctgatgtcagggatctttagagcctgcaagattcgaggctgcagtgctatgatgataccactgtactccagcctgggtgacagagtgaaactcaaaacaaacaaacaaacaaaaaccatgcttttttttgttgttcttgtagagacagggtctcgatatgttgccagggctggtctcaaatttctgggctcaagtaatcctcccacctcagcctcccaaagtgctgggattataggtgttagctgctgtgctcggctgttcttggcccatactaagcatttaatgttagctcttgtcataggtagcgttagttctgcaaaattaactcaccctgagagatgatttataaatgttttgctgaggaaacttgaaaaatttctcaagtccaatcatagggtagcaattaaatgtctgagatagtccaggacagcccagcatgagcttcagtattccaagaaccagggctctccagtctttctgtcagtgtaatctgaaggcatgtcccctcaccctagagcatcctagtgctgtgtattaaatgaaacacacacacacacacacacacacacacaataccttcttctaaggataaacaataatttccaaaggtagcgta

SEQ ID NO: 42 - DNA, 26086 bp, Homo sapiens
cttcatgcaagaaacatcttcaaactgctttagatcgaaaggacatcttccatcatcttaaccggtttgtttgccaacataggatttaattttctgtgtaggcctctgcattttacctatccttctctccatgcatactatctgcctcccaagcagacagctaaatttgatttttcctaaatattcaaaaaaatatctttcaggctggacatagtggctcatgcctgtaatcccagcactttgggaggccaaagcgagtgaattgcttgaggtcaggagttcgagaccagcctaggcaacacagcaagagcccatctctacgaaaaaaataaaaaaagaattagctgggtgtggtgatgtgcacctgcggtcccagctacacaggaagctgaggcagaggatttcttgagccaaagaggtcaaggttgcagtgagccatgttcacgtcactgcactccagcctaggtgacaaagcgaaaccctgtttcccctgcaccacccgccacttgcaaaacacacacacacacacacacacacacacacacacacaccaaaaactttcatgtcttttcagttaacttttaaacaagcccagcaggattgaattatgtggtataattttagggacatttctgcccaggttcatgagtttatccacctgctctaaaacctgaaagaccttgatcaggaatcaaagtgatatatgctgtacttggagacaaagcttaaaagacacatcctcaaaggaaagcaaaaacatttatttaaattcattataaaatattatcttcccaggtgctctattcaatttcttcatcaccatccacacagagaggactcacaaatttatatctccagtgcaaggctctgtgtcctcaggtttcaaactcgattatacaactcacaacttgccttgtcctcctgggattctcaaagccatccaaacttaacatgagttcatgctctccccactccccacactcactgatactcctaacttggtttctatggtcccgtatcccagtgagctagtcatctggttgaacaagcctgaaaggcagaagtcatccatgacagctctctctctcctccatgcccacaccatccctcaattctgtcagaactctccagtgtcttccatcttctccatatcattcagccaaactttgtctaatttaataacctcctaaccagtctatctagagcccttctaaccccagccacacctatataacatattagagcaaaagctcatgtttttcaaaggttagtcaagtgaagcagtgggagtggagaaggaacaaagaaatctgtaactggttgtgatcaattagttgtaaacaccactgcactcagaccagctgcaaaatttgttgttgttgttgttgttttgagatggagtttcactcttgttgcccaggctggagtgcaatggcgcagtcttggctcattgcaacttccaattcccgggttcaagcagtcctcctgtgtcagcctcccaagtagctggaagtataggtgcccgccaccatgcctggctaatttttgtatttttaatagagacagggtttcaccatgttggccaggctggtctcgaactcctgacctcaggtgatctccctgcctcggcctcccagagtgctgggattacaggcgtgggccaccgcacccggcctgcaaaatttttaatacatattatactccttgacctccactatcacagaaactttgctatatactgttttcttgacttaaaacactattccctccttaataactccaactcctccacatttctgctcaagcatcagtttcccagagaagcttttattggcttttatcaccaggtcaaattcctatctcctagtactttgtacagtccttcatagtgctcatcaagttggaatctgacacatatatatgtgttattatatcatctccctcactagtctaagccataaagtcatggatcatgtgcagttttttttctccccactgcatccaaacacctagcatagtgtctggtacatagaagtggtcaaaaaatatttactgagtaaataaatgcataagttaaaatataaataaccaacataaaatccttttccaagaataagtttttatgacagatatcaaccagcagaaaaataaaacattttctagaatgaaagaacatatgaaaaatgcctggcagataataggttcacaattttgtaaaaattcatctgctttatgattttcatagagccaatatctgcaacctgcctttctatgtatttatggagagcaggaccaaagcaacgtaatttgctgctaggatgccagtactaaagtgtttctttttgtctgttcctgcttcctgaacatattttgctttgtgtaaatttactatgaccacacaaaacatatcagacaaaatgaaagacagagttgcaagaatttccaacttgttagttgggtaggatgccttggaaaacaaagtacagggcttcccactatatataaccaactgtctagtcttaaggtgaagataaataatatgttctaggagctgggcatgatggctcatatttgtgatcctaggactttgggaggccaaggcaggaggatcgctttagcccaggagtttgagaccagcctgggcaacatagagagactcagtctcttaaaaaaaaaaaaaagaatatcttctagaaaaggaattatctttaaatactgtacagataattcaggatttcaagtttagtttccacagtgtgtgagtgagacactcaaagggatagaagatgaaatgtttaatctgcgtgagttcgcttaaggacacatcccaataaggaaaagctgtggggcgtatgattgttttataaaacagtgcgaagagaattgtttggcactgtttgcacatgacaggctcacaattcatttctttaaatatgaagccccaaatcaacccatctaaaattatgtttcctaccaagattgcttagttactacacataggaatgtgcataggcctggaggcagcactctcagctcttctgagataatcagttgctcttttatttacaagaatcctggtcaagacactccattcctgtcccatttctctgccactaattgactctgtggctgtaacagggtctcagttcttcatgtgtaaatcaaggagattggatttttttaagtccttaaagttccctccagctcccagtcctttgattcaggcctgaattctagccagtagagtatcaagccacctacacggtttgtcgagttgcacgagcatttaatgaagagtttccctactctttggaagagtctgttcataggagaaatttatgccaccttaataaaatgagcagaggagaaacctgttatttcctcataggtgcataagcagccccgaaatgggagctgactagaggggtgggctgggagacaggagtctgcagggtcaggctgccatgaggttgatagggaagttttgccccactggccagatttctcttcactattgctgcatgcaggctgctgagctcactggtgtcacattcctcagccttgatcctcaggactcaaccaaagaatatcaagatttccacagcacacttgtcttttttcttttaatggaatgaatgatgccatacatttgtcatgtttatagagcagccttccctgcattaaaacacacacacacacacacacacacacacacacacacacacacacatagatatagatatagatatatcccactggaggctttttataaaaaaaacaaaacaaaaaacccacagatatatctattttagatagatagatagatagatagatagatagatagatagatatagatatatagatatattcttccaagtaacactctggcaggattatcccacaacagaaagtgtcaaaggcaaagagaaatgcctatacaagaagaactttttaaaatagaaagcatagattcaaactgcctcaatcactgtgggcttccttccctggcagaggagagacacttccttcattcctttccaaataaagcaccttggctctattcaaggctttactatgggcaggaagaccaatggcaacttcttgatctataggaaagttttatttgttcgactgacctaccagaaaaatattctaaattgaattactttgccatgttttatagatgatacataaattgccttgcccaggatactttttaaaaaaaagttacacaaaacagagcatgtcaaaataattttcaaatataatacctataagatggctaaaatgtagcaaagtataatttgcctaagattgtaatattataaattgagacatgtacttggctataatctacatttgtcatttcttggacaaacttttggttaactctcttctaaattacgtttgcctatgtgtcttgaattaaaaaatggctttaatcgtaaataaacatgagaaaaaagtatttttctatttcgaaagcccacaaggccgggcgtggtggctcacatctgtaatcccagcactttgggaagccgaggcgggtggttcacgaggtcaggagttcaagaccagtctggcctatatagtgaaatcccgtctctactaaaaatacaaaaaattagtcgggcatggtggtgggtgcctataatcccagctacttaggatgctgaggcaggagaatcgcttgaacccaggagacagaggttgcagtgagcggagatgacgccactgcactccagcctgggtgacagtgcaagactctgtctcaaaaaaaaaaaagaaagcccacaatatgaactcattctttcagtatccagtcctacaacctcacctggagtatttttagcctaagccaatctttcaatatttactttgtgtatgtaaataacaatgttcctgtaagtagtgctacttacattctaaaaaagccttgattctaattgccctagtgttgtcattcacgtcttgagggttccagctcaagtttcctgcgtgactggaggcaccgccctcattctatttgattcattatgaataacacaaggataatgatgcctgtaattactgacagtttgccaccttctttgaagttcccaaaagcaaaatgctccaaatgtatgctcataattgtttattagttggtcagtttacaaagccaatttttgtttcctcaaaattaaatggcatttgttcatttttaaaatttgagtgacaatgtttctaagttaaacccaggaggctgggctcagtggctcatgcctgtaatcccagcactttgggaggccgaggtgggcagatcacttgaggtcaggaattcaagaccagcctggccaacatggcgaaacatcgtctctactaaaaacacaaaaattagccaggtgtggtggtgggtgcctgtaatcccagctacacgggaggctgaggcaggagaatcgcttcaacccaggagaccagggggttgcagtgaaccaggatcgcaacactgcactccagcctgggtgacagagctagactctgtctcaaaaaaaaaaaaacaaaaaaaaaacaaaacaaaccacagtgtatatgcatggatacataaattgaaaagtaccattattaatgaaaagtcagcatgtaacaactgttgttttaggataattattactaatgttgaaaataatcaaatctcaccaaagaaaaagagattattttccttataaggcagattacgtgtctcagtgatagtgattcaaaaataatcatttcaaacttcttatcttaagatttttgaggatccaatgtctaaaggtctctctgctccctggccttctcatttcctactatattatagattaaatctcctaacattgctttgaaaacctttgtctggccttccttctgattctactttccattttttacatagtaaatttattgacagtttgatacctaaagctccatgtctattttaatctgtctccatagtaacaaaaccagtgtttagttacattggtttagttacattaagaacactgtagccaggcacagtggctcatgcctgtaatcccagcactttgggaggtcgaggcagggggatcaactgaggttgggtgttcgagaccatcctgaccaacatggagaaaccccgtctctactaaaaatacaaaattagccgggtgtggtggcacatgcctgtaatcccagctactagggaggctgagacaggagaatctcttgaacctgggaggcggaggttgcggtgagcggagatcgtgccattgcactccagcctgggcaacaagagcaaaactctgtctcaaaaaaaaaaacaaaaaaaacaaccacacacacacacacgcacacgcacacactgtaaaacattagaccaaagacaaaaacatagccaagaagaaactgttttctagcacctactctgagtcagtctggtacatttgatctagattccatcatcaacatttttgtaacagaattagctgtgccctttaaatcacccctcttggagaaatgacataaagttgatggtaaaattgtgcattatcctgaaggactgctcaagatgtaatggtaaagacaaataattgcctagactaaaatccaaagggaagacaaattatgggatcaagaggagcttcccatgacttgagcaaaactattacttccatcaagggagcaattccccttcccagcaggaaactcaccgaaatttccctgagtcacttgcgaacaatgttgttataaatgtgacatgaactctcatccacaatcataatcccataatttttaatgttaattttaagccccccatgattatttcatgggcctacaagttatctggataaagacgacagactccaaatgatattcagccaagtgacagtaatcctgaagaaccctgcctgggacggctgaccaccactgcatagttacttacatgtttacatgtcagtttccccagaacctatcattataatgttcaggtgttgtaacacatcaaatattacaacaggagagactgccaaagacttaacgcatgctacaaagacacaatctccttggcaaatgattcagacaattaaaatgacaataacatcaacaaagttggtaaaccaaacctagtgttaaaaaaaaaaaaatgaagctttactgtatggaaaaagaaaagattctggcctagaatcacagaactctatacaaagttggaaagtgccttagaggtcatccagttcagctacccacttgatgaagaaatctattctacaaagttcttgacaagtggttattcagcctctccttgtttatatccagcatcccaatgcaaactaccgccactgagccaaaatttactttgctgaaacttgcactcattgactctgttttgtagagcttttaaatcaattctgccactccctttactagtttagttgggtttttaaaaaatacattataataataatagcaagcatttattgaatacttactatatgctaagtattggactgggtgtttttatatgaactatcttatttatttagtgattatgagcataaactctggaaccagattgtctgagttagaattccaactctgccatttattagctgtaatcattggacaagtcatttaacctgtctatgcctcagttcctcaacaatacaaaatagggataaacataataataaggtctacctagtaggattatgaaaattaaatgccagtgtatgtaaagtgtttagaacagtgcctagcatatgataaaaactgtaaaaatgttgttgtgctgctcattgttagtatgattattattatttgagacggagtcttgctctgtcacccagactggagtgcagtggcgcgatctcagctcactgcaacccctgcctccagggttcaagtggttctcctgcctcagcctccagagtaactgggactaaaggcatgcaccagtacgcctggctaatttttgtatttttagtggagatggggtttcaccacgttgaccaggctggtcttgaactcctgacctcaggtgatccgcccgccttggcctcccaaagtgctgggattacaggcgtgagccaccatacctggcctattattactcccattttacagataaaaagattgaggtttagtaaaaaggttaggcaacttgaggatgggattttcaattatccttgttagatcacatctgaaatcagtttattactcaaagtgtttgctatttattgtgcatttgctattttatttagctttgcacattagtctattttcttttttttttcttcttttttttcagacagggtctcactatattgcccaggccggtcttaaactcctgagctcaagtgatcctccggcttcaaagcctcccagtagctgagattacaggcacaggccaccaggcctggctttagtctatttttaaacagattcaattccaggaactctttccagtgtttgtcctcccgtgaaacaaaacaatctcgcattaatctagagatggtacaggtatgtttggaaaacaatattgcaaaatatatcaacaatcataaaattgttcaaagcattttttttgagactgagtcttgctgtgttgcctaggcttgactggactgcaacagctgttcacaggcacaatcattgcacactacagcctcgagctcttgggctcaagcaatcgtcctgcctcagtcgcccaagtagctgggactgcagtcacacacatctccatatcccactctcaaagtcttagattcaataatatttcttatgaaaagctatcctccagaaataatttaacaaaatgagtaagctacatattcccaaatttttcttatagcattaccagctgaatttccccaaactatattagagataaatattaggggtatagtgacgtaaattataataaacataaaaagaaattatatagttaattaatcattatgatacataaaatcacggaaagaaatttatgatataatattaaataaaaggccaggcacaatggctcacatatgtaatcccagcattttgggaggccaaggcaggaggactgcttgaggccagaagttcaagacctgggcaacacagcgagaccctatctctaccaaaaaaagcacaaaaataagctgagtgtggtaccccacacctgtagtcctagctacttgagagaatgaggcaggaggatcacttgagcccaaaagtttgaggcagcagtgagctgtggtggcactactgtactccagcctgggcaacagagcaagacactgtctctaaaaaaaaaaaaaaaaattaaaattaaagttaaaatttaaaaatatatatataaggccaggcacggtggctcaagcctataatcccagcactttgggaggctgaggtgggcggatcatgaggtcaggagtttgagaccagcctggccaacatggtgaaaccccatctctgctaaaaatactaaaaaattagccaggtgtgttggcgtgcacctgtaatcccagctacttaggaggctgaggcaggagaatcgcttgaaagccggcaggtggaggttgcagtgagccgagatcatgccactgcactccagcctgggcaacagagcaagactctgtctcaaaaaaaaaaaaaaaatgtatacacacacacacacacacacacacacacacacacaatatataatatatattacatatattatatattatataatatatcacatatattatataatatatcacatatatatcacatatattatataatatatcacatatatatcacatatattatatatcacatatatatcacatatattatataatatatcacatatattatatattacatatattatatatcacatatatattatatattacatatattatatattatattacatatattatatattatattaaatatattgtatattatatataatatattaaatatattgtatattatatataatatatacaccatatattatatattatatataatatatggtgtatatatactatatacattatatatacactatatacactatatattatatataatatactatatataatatagtattatagtatataatactatatataatatgtattatagtattatataatatatatactatatataatatagtatatttattatataatactatatattatatatagtattatattatataatactatatattatatatagtattatattatataatatatattatatatagtatatatattagtatatatactaagtatatatactagtatatatactaagtatatatactatatattatatatataaaaacatacatataggctggtgcagtggctcacttggacaagttttatatatatgtatgtttattgtatatatgtgtatatatgtgtatattattttatatacatttatatatttatattcatatataataattatatatatatataataggaggttgaaactgcagggaaccgtgatcatgccactgcactcctgtctgggcaacagagtgagacactgtctcaaaaaaataaataaataaataaatatttaaaaagaacccagggctgggcacggtggctcatgcctgtaatcccagcacaacactttgggaggccgaggggggcagaacacctgaggtcaggagttcgagaccagcctggtcaacatggagaaaccccgactctactaaaaacgaaaaatacaaaaaaaattagctgggcgtgttagtgggagcctgtaatcccagctactcaggaggctgaggcaggagaatcgcttgaacctgggaggcggaggttgcagtgagtcgagatcgtgccattgcactccagcctgggagacaagagggaaactttgtctcaaaacaaaaagaggccgggcgtggtggctcacgcctgtaatcccagcactttgggaggccgaggcaggcggatcacgaggtcaggagatcaagaccatcctggctaacatggtgaaatctcgtctctactaaaaatacaaaaaattgccaggcgcggtggcgggtgcctgtagtcccagctactcgggaggctaaggcaggagaatggcgttaacccgggaggcagagcttgcagtgagccgagattgcgccactgcactccagcctgggggacagagccagactctgtctcaaaaaaaaaaaaaaaaaaaaaaaatcgaaaaattagctgggcctggtggcgggcgcctatagtcccagctactcgggaggctgagccaggagaatggcgtgaacctgggaggcagggcttgcagtgagccgaggttgagccaccgcactacagcctgggcaacagagcgagactccgtctcaaaaagaacaaaagaaaagaaaggaaaggaaaggaaaggaagggaagggaagggaagggaagggaagggaagggaagggaagggaagggaagggaagggaagggaagggaagggaagggaagggaagggaagggaagggaagggaagggaagggaaggaaaggaagggaagggaagggaagggaagggaagggaagggaagggaagggaagggaagggaagggaagggaagggaagggaagggaagggaagggaagggaagggaagggaagggaagggaaaccgactaccacatgttctcatttataagtgggagctaaatgatgacaaatcgtgaaaacaaagaagtcagcaacagacactggggcttccttaaggatggagggtgggagccaggaggggggcagaaaaaataactattggttagtaagtttaatacctgcgtggtgaaataatctgtacaacaaaccctcgtgacacaagtttacctatataacaaacctacacatgtacccctaaacctaaaataaattaaaaaaataaaaccacttaaaaaagtcacaatccccaggaaaacaaaaagctacacatctggagaatctagtaccccaagattaattatacaatgtggtagaaagtggtgctaagaactattaagctgattttaataaaaagggcaaatatctctgattccattttttccaataaattcctataagcaggtgaaagaacacagtacacttagtttccttgtgttaagaaagagcttccttttttttctttttagaatctttgagccactactgtgattaaaatagcactgtatactgttttgtttttgtcgttcaagagaaatgtaaataatgcattatcaaagtatctaaatatctgaaacaactgttgatatgctgacagattatgtggatgaaaataagccagtctaaatgtaaataaattaataaaatatgtaagaacaattaaaactggcctttaatgttgagatattgtttgagaaataagaatatgagattacatatatatatagtagtctctgcttgactcataaaattagagaaccctacagctctccaagcccagatatctgtgggctctctgctgtccacagtacaaagaatctggcatgtacattatgcaagagtggaaaccaagcccaaacagatcagggaaatagtactgtttaaattgtcatgccagcaataggacaactgaaaatgacacccccacagcattgttttctctgcacagtgaatttcacaagtgctctctcatagagggagacatatatgcctgcagcttcctcctcctctgggcctctctctgagtgtaataaaggaaagaagagagagaagcagatctgttaggtctccatgaggcaggcttgtcagatatccatgataccaggccagcgggtactgtggcaaaatcacactgtgggccaacaagggagataactaaccaattgccttctaaggcagtctgccttgcaaatggtcttgaagttgtgaacagaagccctagggagttgcaatggccaagtcctggctttagattagctagctgaggaagaaggagccctgaagtgttaatgacaatctactccacccactcaccagctactggccctcctcagcctctctttcctctctgtttctttctctcacagtcttgaccatggatttctacctttgcactttccttttctaagttttctttagaaaccaaaatggggagggtgaaaaagatgatcttaggcagagatgaaaaagttagtttagtggcagaaaagaacaataaactaaaggaaatggaataattgagaaagagccaaataaagagaatagccattatggactgaattgtggttccttaacaactcaaaatcaggtgctcttatagagaaaagaaatgcctccttttggcagaaaaatcagtaactcactattgcactgtttattgcacaatttatcatcagtggaacttatgagttaacacaggacatttggcactttaggtcctgttagtccagaatcccagcatgttggactatggaaatatttttactagagtcacaaagggttaagcatggaattaaaaagaaaagggaagagagccaagtacagtggctcacatctgtaattccagctattcagaagggtcccttgagctcaggagttcaaacccagcctgggcaacacagtgagaccctgtctctaaaaaataaagggaagggaagacatatggaatgaaaacagcattgctgaaattcatttttattaaataacccaacatttttaaatggggatatgacaataaaatattctggctgagaggggctaaggagtgctgtgttaaaaacagtgacttctggccgggcacggtggctcacgcctgtaatcccagcactttgggaggccggggcagatggattacctgaggtcaggagttcgagaccagcctggccaacatggtgaaatcctgtctctactaaaaatacaaaaattagtcaggtgtggtggcacatgcctgtagtcccagctactcaggaggctgaagcaggagaactgcttgaacccaggaggtggaggttgcagggaactgagactgtgtcactgcattccagcctggggcaacagagtaagactctgtctcaaaaacaaccaaccaaccaacaacaaaaaaaacagtaacttccttttctcagaaaagggaatttgtgtcagtgaatggttcctatggtccatttatcagaagagattcaattgtaaagactcagaaaagaggcctctcaattatctttagactaaaggaacagtgattaattctgagacattacagatggatgtgtgagtaaacaaacgtgggcaggaggaaggttaagaaatgctaccgctgctattatgcctggcgtataatttttttcttctagagctaatcatcctagcatcaaaaacaaaagctgagggattaagctgtgttccaagaacagttttgataatattaattacgttggtaaataaacgcagaaacaacaaacaaaaataaatcaagccatttttcagctccattgaaaaggcagcatttgccagatggaaaaggtctcagcaacagaggaaaaattgctttcaatcttctaaagaaagtctaatcatgaagaccaaagaagacaaactaaaagtctagaataaagtcttgctttattctatttaataaattttaataaatatggtggtcctttgtaatgaaaaaaaaaaaaacactttaatgactgatgtctgttgattctctggaattatatgacaaagttatgtaacaagaatttgcctcatacatctgtgcagtgaactaaaatagtgaaaaaataaagaaaaagaatttgcctcaaacttagttagtcatttgggcagtcatcaaggaaggaacgccaagactttttaataacctgatgtcttcagaagcaaagaccagtcagacaagtttccagatggagataaaaataaatctaaaaaaaaaaaaaaaaaaaagagatcagcattaaatggataagatggagtttgccaacaaagagaagatgagtaattcttgttccatgtgaattaaaaactcactgttcaattaaaaactcaaattatatatctgaaagaaccattgggttaaaaataataataaaataataaataataataaaaaaataaaaactcaaattaattaaaaactcaacaaatcaatcaaatgaattaaaaacaacacaaactctccattatcatttaggtgtctaaacatgctacctcatcagatcattctggattataaacagaacaataatagctcatacatatgattttctttcacatcaagatgtaaaatggttcattaatctcataccactttgaagaacaggtagtaaaacaagaatttaaagccagcactaccagttcaaaaactgctaacctaaccacctcattggattaaggctgagccaccatttgggtgcattacagtcagtgaaaagatcacccgaggtatagagttcaagaccaccctggccaacaaagcaaaaccccatctctactaaaaatacaaaaattagcctggcatggtggtgcacacctgtaatcccagctacttgggaagctgaggcacaggaataacttgaaccctggaggcagaggctgcagtgttcacggctgagatcataccactgtactccagcctggtgacagagaccctgtcacaaagaaaagattttttaaaaaagtatatacactgtaggcagggcgtggtggctcacgtctataatcccggcactttgggaggccgaggtgggcagatcacctgaagtcaggagttgaagaccaacctggccaacatggtgaaatcctgtctctactaaaaatgcaaaaattagccaggtgtggtgtaatcccagctacccagctgtaatcccagctacccaggaggctgaggcaggtgactcacttgaacctgggaggcgaaggttgcagtcagccaagattgtggcactgcactccagcctgggcaacagagtgagactccatctcaaaaaaaaaaaaaaagtatatacactatacactctagaacattgttttctaagctgtgggccacaagtcttaggtcaaaagccatgttcaagttatcttccttgaagccattgaacgcatctcttgtgtaaccattacagtgcagtcttctctagcctggtggtgtcaaaggtaaaaatgatacattaatatgcaattaatatacattaatataggaaaaggccatctgaggtcccattttgagattccttccatccccggtatagttggaggttgcatcgcagtggtggtgtctgctaagacagaactctggctctgctgtattcattcatttacagattcattcatcggtgacttcaacggctggtttaagggaacattgaccacacccattttattaccatcatttcctttagaaaatccagtttccattcaagcccgctaatctccaattccaactagatgatcacctctaagtcacttttatatcaaaattctagagatactggccaggtgcggtggctcacgccattgcactccagcctgggtgacagagcaagactccgtctagaaaaaaaattctaggctgagcacggtggctcacgcctgtaatcccagcactttgggaggccaaggcgggtggatcacgaggtcaggagtttgagaccagcctggccaacatagtgaaacccgtctccactaaaaatacaaaaaaattagccaggtgtgctggtatgtgcctgtaatcccagatactcaggaggctgaggcaggaggatcacgtgaacccaggaggtggaggttacagtgagccaagatcgcaccattgcactccagtccgggtgacaatgcaagactccgtctcaaaaaatgaaaaaaagaaaaaaaagtataggtcaggcgcagtggctcatgcttgtaatcccaacactttgggaggccgaggtgagtggatcacttgagttcaggaattagggaccagcctggccaacatggtgaaactctgtctctactaaaaataacaaaaaaattagctgggcatgatggtgagtacctgtaatcccagttactcgggaggctgaggcaggaaaatctcgtgaacccgggaggcagaggttgcagtgagccacaactgcactattgcactccagcctgggcaacaagaacaaaactctgtctcaaaaaaaaaaaaaagaaaaagaaaaagaaaaaaattccagagataccattgcatttactttttacaaacatttcttttttaggcactgggctgaacactggttggatggtgcctgcttgggctgaggtggagacaggctggagttaggaagataattcttatttctcccagttgggaaagacctagaaaaggatccaggatgtagatgttcctaggtattctcaattttgcaaagctggaaggtgttactttattagattcccacaatgtgcctttcagaaatgacagttaacaattattgggtgccaaaatacatacatggttttttatttacatgcatctaatactgattctgtccctaatatagagcagacactctacaaacacactgaaacatttgcaatcaggtaaactgtgacttgcaaagaggtgggaataactttcccaagattacacactagtacccctaactcccattctgcatgagctgttgatgctactcttccacatatcctcacattctggaacccttcaaaatgacagtaattactttggaggacaggtcctctatgatgtaataaaaataactcttgactgagaattctgttcttgtctcagctctactaattagccctgtgaacgaggacaaatgtctttacctcaccacctctcagtttcctcaactaaaaaatgctaacatgaaatggaatgctctcaaaagtaccttttgttcctaaaattcaaaggtgtaagaagtatatattccatgctgggtgtgctggctcacgcctgtaatcccagcactttgggaggccaaggcaggtggatcatctcagttgaggagttcaagaccagcctgaccaacatggtaaaacctcgtctctactaaaaatacaaaaattgggccgggcgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaataaataaataaataaaaaaaataaaaataaaaaaaataaaataaaaatacaaaaattagttgggtgtggtggcgtgtgcctataatcccagctactcaggaggctgaggcataagaatggcttgaacccaggaggcagaggttgcagtgaactgagatagtgccactgctctccagcctgggcaacagagcgtgacttcgtctaaaaaaaaaaaaaaaaaaaaagaagtatatattctaaattaaggaatatatatttgaaattatgggacatgtcataatttaaattatgtcttagtctataatgatgtatttgaacatgagtatatcttaaaggaaaacgccaagagtttttgtctgatagagggctttaaaatactggctttaaaaaataaataaaaaattaaacattggcttttaataaaatgaatcaacttaaaaattatctggctgggtgtggtggtgtaggtcaataatcccaaaactttgggaggctgaggcagcagaatcactcggccaggagttcaagaccatggggcaatgtagcaaaaccccatctgtatttttatttttattttttttagactgaatcttgctctgtcacctaggctggagtgcagtggcatgatctcagctcactgcaacctccacctctgggttgaagcaattctcctgcctcagcctcctgagtagctgggattacaagtgcctgccaccacgcccagctaatttttgtagttttagtagagacgaggtttcaccatgttggccaagctggtctcgaactcttgacctcaagtgatccgcccacctcagcctcccaaagtgctgggattacaggtgtgagccactgtgcccagcccccattttattaaaaaaaaattatctcatttcagtcacccttttcaggaggatgagcctagctctggcaatgtcttggatttatgaagttcctctcttgaggctgaacagagataggtactttctgcagtggcatcaggacaccccttgacattgtaacatgaaggtggtggcaatggccagtgttgaggggaaatggagagtatctgaaggacaggaggtaggagtaagacaggtggtagcagaggaatgggtgggacccactgacagagtgacacctccagctggccaagctatcagtgtggactttgtgtataggaaacaagcttcatacgtattggtatgtaaccagttccttgatatgcccatcttgagtatgcccactcagcccttcttctgagcttattgtccctcctcctccttctcttgctcaaactcttgcctttacctgtttgaatccctgcctacgcaataccttaaagttgggagttcctgcttgggcaggagtggagacagactgaaatgagaattctgatttcttaaggctcctaagctaggaaataccaagaaaaaggatccaaagttttgacattttaaaatattcgcagttatgtgaagtttgatcccaaaactacaacagatacccacagtattaaaagctaacatttattgagtgcttactaagtgttgggcactgttttaaagagctcatatatgctaactaattttgttttcccaacagccacacgcaataggaactttttttttttaagagtcagggtctcactccgttgcccaggctggagtgggcagcctacgagtgcagtggctcactcgcagctcattgcagccttaaacttttgggctcaagtgatcctttctccaccatgcccagctaatttttaaatttttttgtagagatgtggcttgaggccaggagtccatgaccagcctaggcaacacagcaagaccctgtctcttaaaaaataatttaaaaattggcccagcatggtggtacatgcctgcagtcccagctactcaggaggctgatgtcagggatctttagagcctgcaagattcgaggctgcagtgctatgatgataccactgtactccagcctgggtgacagagtgaaactcaaaacaaacaaacaaacaaaaaccatgcttttttttgttgttcttgtagagacagggtctcgatatgttgccagggctggtctcaaatttctgggctcaagtaatcctcccacctcagcctcccaaagtgctgggattataggtgttagctgctgtgctcggctgttcttggcccatactaagcatttaatgttagctcttgtcataggtagcgttagttctgcaaaattaactcaccctgagagatgatttataaatgttttgctgaggaaacttgaaaaatttctcaagtccaatcatagggtagcaattaaatgtctgagatagtccaggacagcccagcatgagcttcagtattccaagaaccagggctctccagtctttctgtcagtgtaatctgaaggcatgtcccctcaccctagagcatcctagtgctgtgtattaaatgaaacacacacacacacacacacacacacacaataccttcttctaaggataaacaataatttccaaaggtagcgtacttctagtaaggcatatcaagagtaaaaatagcccttttaatacaagatgatcagcacagagatacagatcacagtggagacggcatgtgacattactgttgagccatactggcatctgttagttgaattggttccaagcttctaaactcacacagcttattatcttgtacacataccaagccaaaatgctaaaattgcagttttttctttctttaagcagcattagtttcagcagcaagacatctgtcatctcctatgttaatttctgcaaaggaatgatcgcaaacatgaggacttactaacttcctgtgctgtactcagcgccgaaggagtcagggggtggaggtaaaagatttgttctccaggttgtatgaacgacaacatttttgtgtgtcttcagaaaaatttcagcattttttgctataatcaaactaaacatttacatgtgcatggtttttcaggtgttggttgatatattaacgtaatcgtaaagcatgccaaacaaaatcatgataagcctactgactcagaggtgattaaacctctcaatgaattcacaattatttgtttcaaatgcttcattttcctgattagagagcaaaaataattggagaaattatcaaaactaattaccacttgaaatgtattgtataggccttccaaaaatgaaacatttatgagttgagaaccatattatagttaaatcaaataagagataggaagctgcaaacattacatttcaccttcctgggtagtaatctaaatctaaatttagtgaattttagatgaattttatttaaatcaattccatcctaaattatgtgcatcactgcagtcatttgaaatagtagactgaacagattcagaaaagtactactcagagattagtagaatgaattttttataaaactgccttgattccccttggaattcttttttttttttttttttttcagatggagtctcgctctgtcacccaggctggagtgcagtggcccaatctcggctcactgcaagctccgcctcccgggttcacaccattctcctgcctcagcctcctgagtagctgggattacaggtgcccgccaccacacccagctaatttttttttgtatttttagtagagacggggtttcactgtgttagccaggatggtctcgatctcctgacctcgtgatccgcccgcctcggcctcccaaagtgctgggattacaggcgtaagccaccacgcccggctccccttggaattcttaaaaaagtaaaataaaaatttaaaaactcatctaggggctgagcgtgatggctccttctcaaaaaaaaaaaaaataataataataataattagctgagtatggtaaatcccagctacttgggaggctgaagcaggagaattgcttgaaaccaggaggcagaggttgcagtgagctggccgagatcataccactgcactccaggctgggcaacagagggagactctgtctcaaaaaagaaaaaaagaaaaaaaagcacatttaaaaaaacccagaaaaacaaaaatagaaactcatcttgttctaattctagaaaaaacattagggaagtaattacttgcaacattttacttggtgctaatcaagttaaatttttaaaatgagtgtatataagaagaaatgcagcttattgatcctgaagtagattaggtgccactgatgctgttgaattgagaactttagccggacatgggagtggaggacgagtaaaagatgctgactgggcctagagatcccaaggaggaggacaagggagaggaatgagtgaatcccctaacagtgagagagcaatgccagcaggtggagaaaagagtaaaggcctgagagcagctacagctctgtgatgagacttcttgtatgcaagcgactactgcatggcccacagcagcttgaaataaatgggcaccagctgcagataagacaagtgataataacagctcgaaataaatgggcagactcattcacgccagccttcatcacctagtcgtcaggatatttccttacggttctgaatatgacatttgtttctagttttataactatgaatttatgtgaaactcatgggttttgatttagacaagtagcttttatgtaattagcggtaattccatctttttttttttttttttttgagacagagtctagctgtgtcacccaggctggagtgcagtagtgtgatatcggctcactgcaacctccacctcctgggttcaagcaattctcctgcctcagcctcctgagtagctgggactacaggtgcccaccaccatgcttggctaaattttttttttttttttgtatttttagtagagacgggagtttcaccaggttggccaggctggtcttgaactcctgacctcaggtgatctgcccgcttggcctcccaaagtgctaggattacaggcgtgagccactgctcccagccatgattccatcttagtaaagttctgtgatctgcaaaaaaactaaaaaaaaaaaaaaaaaaaagaaaaatgcaaaagatacattactttttttttttttttgacatggagtttcgctcttgttgtccagcttggagtgcaatggcgcaatatcagctcaccgcaacctctgcctcccgggtagctgggattacaggcatgcaccaccatgcctggctaattttgcatttttggtagagacggggtttctccaagttggtcaggctggtctcgaactcccgacctcaggtgatcctcccgccttggcctcccaaagtgctgggattacaggcatgaaccaccacgcctggcccagaagatatacttctaagaagttaaatgaattattaattagcattatgaaatttcatcttgtttccatcttagcctatatttcaaattcatatatttgtcttaaaatatgcttcagttttttatcctaagaagccatatcatgtaagtcaataatgaatccatatgaaatagttacatgaagttctaactcagaaaacactcagagaaattattttggcataaagaagccactctttggaggcaacagaaattcagattcatactctgccactgttacagagtatggatatttataaaatttgggtaatatgtctttttataatgtcatttttaaaattatcagcactgccggacgcggtggctcatgcctgtaatcccagcactttgggaggctgaggcaggtggatcacgaggtcaggagatcgagaccatcctggctaacacagtgaaaccccgtctctactgaaaatacaaaaacttagccaggcgggccgggtgcggtggcttacgcctgtaatcccagcactttgggagactgagacgggcggatcacaaggtcaggagatcgagaccatcctggctaatacgtgaaaccccgtctctactaaaaatacaaaaaattagcagggcacggtggcgggcgcctgtagtcccagttactccggaggctgaggcaggagaatagcgtgaacccgggaggcggagcttgcagtgagccgagatcgcgccactgcactccagcctgggcgatagagcgagactccgtctcaaaaaacaaaaaaaaaacaaaaaaacttagccaggcgtggtggcaggtgcctgtagtcccagctacttgggaggctgaggcaggagaatggcgtgaacccgggagacggagcttgcagtgagccgatatcgtgccactgcactccagcctgggcgacagagcgagactctgtctcaaaaaataaataaataaataaataaataaaattatcagcaccagaatcgtatttcattgaatatatatccattttcttgcccacctgtgagcctgatcagtttctgacggcagagacagtcttttgtttgttcagggtgtggtcttatgtcagatagaataacagagcaaaacaggatgcacgtgtgtgacaaaaacaggggaatgctagcaattttatgagttttatacttggtggtgcttcatcttaatttcctgtgatttgatgtcttaatctttaattgctccattttgaaatcagccaccagctgcagctaatacaggtcacagtaacctgatgagtcagcctcacactcctgaggccattctgcacatttgccaacaacattcagagcagacgcgaccaaagtgtcataacaagcagactggtcagttgacaaagttagtttagagctgtagctttctcaaagaaagtgtagaccagcagcatcagcatcacctgggaatgtgttagtaatgcaattattgagccccataccagacctagggcatcagaaactctgaaggtggggaccaacaacttaagttttaacaagccatgcaggtgatcctcatgtacattaggtttgagaatcactggattaggtcaggggtccccagccctcagtactggtccatggcctgttaggaaccgggctgcacagcaggaggtgagccgaaggctagtgagcattactaccctagctccacctcctatcagaacagcagcggcattagattctcataggagcacagaccctactttgaactgcacatgtgagggatctaggttgcatactccttatgagaatctaatgcctgatgatctgaagtggaacagtttcatcctgaaaccaacccctgcccactgccctcccagtccatggaaaaactgtcttccatgaaaccagtccctggtgccaaaaagtttggggaccgctggattaggtgcttctctaatgtcatgattttatagaaatttgtgaaacattgattttgtgacaaagcttcaaaggctacttgaataagtagagtgattaaggaagtgttaataagacaaacctggacaaattacttaacttcagtttcctcggtaaagggagattactaatagttctgatctcataggatctgttgtgaggattcaacaagttaatacacatgaaatgctcacaaacagctctgggtgtcctaagtattcaataaatggtcctagggagggaattttattatcctcagttttcaaatgaaggcccagaagtactaggaaggtaaataatttacccaagtaaataaaaattagaatccacacaaattgcaggcttttctccactctactatacttcccagtgagggtggggaggagtataaactggaagaaatattcgacaaactagtgataggttctccagagttactgtccacaatttaaggggggta

SEQ ID NO: 43 - DNA, 4676 bp, Homo sapiens
ctactcctccaaatatctagtcattttatgtccccacaaactcatttattataaaacccataaaactattccctgtggtgcctataacaaaggaacaaactgaacaataaaaaggaacaatgtacatttttattatgttttaacgatatccccattgccagtacatacacaaccaagtggaaacgttttagccactggcatttccagagatccactttttgccactctgcaatacaaattcacgggtgaaaacatccattaacagaaaagttaaaaggcaatatctatctattataaataaacagtacatttatgagttaatccatcttaggtcactacatgaaagccaggcacagtcattgttacaggtatttctcttcctgctgcataaaattctgattgaaattttatcgtgtttcaaaaatcatacgtagaccaagtgtgtaggtagaaaatggtgtctttaaattagctagaatcagaaaatatgatttatataaatgtaataaaactcatttattggttactcttataagttcaagcttacctgaccccatatattgttaagtatatttttttcattcaacaaatacacattctagtcctttctagccatagtctcaaaacacttgatcatatatcccagtagtaaaattttaactgtggcacacactttcaataaatatatacttaagaatttataaattatatacaataattaacaaatgaataattatgttcataataaactgtatataggaaacataaattttaaaataatgagatatggttacaataaacatttttaaagcatgttcccaattgcaatggcttcatgttatcattaactaatacctaaaagcataaaacacagtattccctctgggttagtttatcaacaataatggtggacgtaaacacatattatagatcatgttgataatttcaactttgggatccaatctcttgttacatataattactttggcactgctttatctcataatattttgtatttagttcataatagaataaatgctagctattttctcaccgcttgtgttgttggcattttcttcattctgacatttctctgcagatttcttttcaggccaattgtggatttggttagaattaatttaatagataacataatagtcacattgtgataaaagggttctgctttgtagaactactactccttcttcagaacctttgtactggtttttttgacagacaactccagtgaggtgcctctgtcaatacatgaggtaaactgcaatgcacttaatacatgtacttgttaacaataaataaacatacaagcaagttatcttattttctttccacttctcaggggattatctcttgaacttttctggggtgtatacatcacaacatggaaacaactactctataagtagtgtctaggaagatgaatctggggatttaaaatataacctatttgtttttaagcataaaaccatgttcaactatttataactcctagagaataatgaatggttgatagaacttgatttttcttattttaatactttattttattttattgctggaatattaacgacattaaaacatgaattttgtgttttattttttgctacattccctcttccagaacagtgcctgacaaacagcagctgcacgtgaagcagtttttaaatgaatcaaagcttattcagctgcaggtaatggttctttccattgctcccagttattcccagtttacccagcactttccaacatcctctccacagtcctgagaggtgtcattttcattttcttcttttttttcttttcttttctttcctttcctttcctttcctttcctttcctttcctttcctttcctttcctttcctttcctttcctttcctttccctttccttttcctttccttttcctttcctttcttttcttttctttcaatagttttggggaaaccaatggttttggttacatggataagttctttagtggtgatttctgagatttggtgcacccatcactgcatggtgtacagtacccattatgtagtcttttgtccctcactccccacccttcttcacaagcccctatggttcattatatcattcttaagcttttgtgtcctcacagcttagctcccacttacaaatgagaacatacaatagttggttttccattcctgagtttctacacttagaataatggtctctaataccatccaggctgttgtgaatgccatgactttgttccttttttatgtctgagtagtattccatggtgtgtatataccacattttctttatctactcattgattgataggtgttaaatagataaactgttcccaacataaagaaggaaaaaaatatattcctttgactagcttcaagacgaatgcctttttaaaacctgggtttgttatgactaatgcttaactcgggtctagttatctggacaaataataagattacaggacaactgtaagataaagattcaccccaaccaaagaatgagcactggggtttctcattaaaaaaagagcttcacagtctataatatttcaaacaaaacaaaagcatcctttacctaatactagatatttgtttctacctgatcctgaatcaaatcttgaggaagctgccattgtttttctgattatttctaggtaataaaaatgccctaagcttacttttagctactagacaatcgcctgtaccttccttactaaaataagtctagttttgtagcatctaaaaattcatagtgatatccaagttggaactcctcattcccagcttaggcctacctgggaaaattgcagtggagaagtgggacctcacctaaaattcacagtctgggtcacaatggaaactctcttatgggtctaaatcattaaaagttatcataaggctaataaattatttaaaacatttgtcacctatctttctaacaatgtggaagactaggttggaatttagaactctaaatttagaactaggttggaatttagaatttagaattgaggaccataagagaaacagctttcaacccactcttctctacagatatccaagcccaagcacctgatcactgtctttcccaagcagtaatcagatattccatggcatgtcactgatcccaggtgtgtgcccactagtgacacagtgacacatgggaggacagatatggagaaggggctcacatggggcctagaagtatgctgggtaccatttgggcagaccattctgggttctggattatcttcagcatggtctagaaaggggaataagtctccaggtgggcatgttcccttgtacccatggatgtcttgctccatagagaggagtggttccagaagaaagccagagcaagatctccaatgtgagatccaggacaaggggtccctcctggcagtgtctaaggaaggaactgggaagtgagttaaggcgatattctcttctctcattccaccttatcctccattctctagtttcttttgacatcttcagtaccaaagtggatgagatgaaatccttgatggtcaggttgaaacatggctttggtgatctggatttggcagatgtgctttgtgggctctttttttcctgggacaatggaaggttctgtgatgacatttcatcactgggaattctttacctctagctgccttcttttatgggcctttatgctctgtgccctggatccccttggagcaccatgttgattgcacagggaccttctctggattttcctcttgggctcccaagataacagagcttcttggttttgagaagtccacatctggcccacaggaaatccacacatattctttccctgccatattctagaactgtactccattccccatacctttctctgtccttgatctgtatccagtgaggacagcttaggccatagccccttgtctttgggcctcccaagaaaggcactgaagcagcagtccatatgtaactgattatatgacatcatcataataaaaggaaaagcttagtgttttatttctttctgaccttcccacagtccttttcttcctttttcagtaataacatacttaatatcaatcatatttttaaaagtaaatatttagggaaaacagacagtgggcttttaaatcgaccaagactcttgagctttgtatttgagaaagctttaaaaataaaagttgggcaagaaatttgaacctcaaagagtgactctacttttagatgacaaacccaaatcatgtttaaagtccctgaaaaacagaaaatgaccaggaagttcattttaaatatactctctaaaccatttgagaattgcaggccataaactatggcagaaagatagctggcaataaatttttcctcaatttggttgctctgaagaggaaagagaaagactatgttctcagacaaaaatgtcacttacattcctatgagactataccttaaagagaaactgaaatacgttatattcctatgagtttaaaatatcaattaaaaaataaagctcactaagaattaagttactttaaggaaataaggtaatttcatgtttatttactttttaacatataagaccatcaatgcaaaaatacactaaatatcttggatgactttattaataaaaaagtcatggatagctcagaaattcatctaatcaaacttaa

SEQ ID NO: 44 - DNA, 7657 bp, Homo sapiens
actatttcattttagggagtttttggtttttgtcttatctctaacttacagccttagggcttctactgtagatatttatcaaagtggaaagcagccaatttatgatcagaatcataaacctattccacccccctttcaagaacataggatgaaacactcccaactcttctcttttcagagccagatgtccctggatttctatgtggtttcttagcattgtctgtgctaagtaccagagcttgaagatgaagttcatgaaggcagaaatggtagtcatttatgtaaattaatttttaaagagaaagatattctgcttgtaaccagcatcaattaattggattataaagttgcattgtcataaaacctaactttccaatcattttccagtgaactcctcagactagagtctgggtaggaagaatcaagatggcgtgtttgtggtcaaggatctcaggccacactccccacactgtgccctgacactcagcatccagggaaggacccagctgggcctccaggttctgagtgacagcagtaatctcttggggaaacaggacagaaagcatcccaaggtaaacacaattgataatattctcctgcatatcccaaaacatgaggtgtcctagatctaatctaaaacaattccaagaagctccaacatcatagctatgatttttaagaattttgtatatatatacacagagagacaaatattggaaagaaatgtattaagtattaatgaagtatttatgggaatttatcaattcttttttttttttttttttttttttttgagatggagtctctctctgtagcccaggctggagtacggtggcatgatcttggctcactgcaacctccgcctcccaggtcctggttcaagcaattctgcctcagcctcccaagtagctgggattacaggtacacgacaccatgcccagctaatttttgtatttttagtagagatggggtttcaccatgttggccaggctggtctcaaactcctgaccttgtgatctgccggcctccgcctcccaaagtgctgggattacaggtgtgagccactgcacccagccagaattgatcaattcttataaattgaaacataattattaagttgtgtttctatttatgagactatgagtgattttttcctttggctctttttacatttcccaaatattcttttgtttgtttgttttgttttgttttgttttttgagacagagtctccctctgtcacccaggctggagttcagtggcaccatctcgggtcactgcaacctccacctcccgagttaagctattctcatgcctcagcctcccaagtagctgtgactacaggtgcgtgccaccacgtctggctaatttttgtatttttagtagagatgtggttttgccacgttggccaggctggtctcaaactcctaacctgaagtaatcaacctgtcttggcctcccaaagtgctgggattacaggcatgagccaccaggcccagcctccaaatatgctttaatgaggacataataccttgattataaaaagagcgaacttttttcagctttaagaaagtcatatgaggttcatcaggagatgtgtaaagtgatacaatccttctgaaaagcaattaggctatatgcgatcagaatcataatcctattccaccccccttgatgctgggaacccacgctaagaccatcattgtaagtatggggaatgcctgctgcaggaaaatggacagcagcccaggacggaacacaacctggtttccagcttgggcatattgaatcactcacaaccttgaggaaatatggttacaaaaacttcctgtgggggtccgggcgtggtggctcacacctgtaatcccagcactttgggaggctgaggcgggcagatcacctgagatcaggagtttgagaccagcctggtcaacatgatgaaaccctgcctctactaaaaatacaaaaattagccaggcatagtggtaggcgcctgtaatcccagctactcgggaggctgaagcaggagaatggcttgaacccgagatgcagaggttgcagtgagccgagatcacaccattgcactccagcctgggggacaagagcgagactttgtctcaaaacaacaacaacaacaacaaatttcctgtggggaaatatttctgttacaatgttaatggaaggcaatctatgttcagtattacttcaaccccaacattaaaaactgtggaggcaaactatggtaagtacaacaatggccccccaaggatatccacatcctactcactggaacctgtgaatgtaaaaaacaaacaaaacaaaacaaaaactacttcattgggataggattgcatacaaaaagctgtacatatttaatatatatatgttgatgagtttggagataagtatatttccatgaaaccatcaccaccgtaaagcatataaacatacccaacacctcccaaagtttcctcccctacccccattccctttttttttttttgtaggggcacttaagatctatcctcttggcaaatctaagtatacagtgcagtattgttagctgtaggcactgtgatgtatagtagatgatgattagtgatgatgaacattttttaatatgtttcttggccacttgtatgtcttcttttgagaagcacctgttcatgtcctctgcccacatttttttctttgtttttagtagagatgggattttgccatgttgcccaggctggtctcaaacttctgagctcaggcagtctgcctgcctcagcctcccaaagtgctaggattacaggtgtgagccactgcgcccagccccctctgccctctttttaatggggttatttgtttttttgcttgttgaactctttaagttccttatagattctagatattataccttttgtcagatgcatagatctccagaatttatttatctggcgtaactaaaccttataccctttgatcatcacctctccattttcccttccctccagccctgaagattaccattgtactctctgcttctatgagtgtgattattctagattgtacatttaagtgagatcatacagatgttacggatcttgacatggggggattgtcctagatcatccaagtgtgcccaatgtaatcccaagaatgtcatcacaagttctttttttttttttttttttagacagagttttactctgtcaccctggctggagtgcagtggcgtgatctcagctcactgcaacctccgcctcctgggttccagcaattcttatgcatcagcctcccaagtagctgggattacaggtgcccaccaccaggcccggctaatttctgtatttttagtagagacgaggtttcaccatgttggccaggctggtctcaaactcctgacctcagatgatccacccacttcagcctcccaaagtgctgggattacaggcatgagccaccatgcccggcctacagttcttataagaggaagacaagagggtcagagtgagagaaggtgatttaatgacagaagcagagcagggcaggggtggggagagagacagagagagaaagaaagaaaaagagaaagaaagaaaaaaagaagaaagaaagagagagattggagatgctacaccgctagctctgaagatgtaagaaggagccatgagccaaggaatgcaggcaacctatagaagctgaaaaagacaaggaaacagattctcctcccaaggcctccagaaggagggagccctgatgcccacttaattttagcccagagagactgatttcagactcctgacctctagaactgtaaaatgataaatctgagttgtttaaaccactgagtctgtggttcacagttacaacacaataggaagtgttacaacagcaataggaaactaatatacaacctctaaaagacaattctagaaatgatttattagaatggggctatagtatgaatgtttactcccaaaattgatatgttgaaatcctgagtcccaagatgacggtattagaaggcagaggttttgaaatgtaattatcattagggcagaggcctgagagcttgttcaccctttccaccatgtaaagacacagttagaaagcatcatctatgtgacacaagcaaatggaaaaacactccatgctcatggattggaagaatcaatatcattaaaatgtccatactgccaaaagcaatctgcagatttaatcctgttcctatcaaactaacaacatcatttttcacagaattagaaaaaaaactattataaaatttatattaaacaaaaaaaagagccagaataaccaaaggatcctaagcaaaaataacagaattggaggcatcacattacctgacttccaactatactaaaaggctacaataacccaaacagcatagtactggtacaaaaacagacacatagaccaatggaacagaatagagaacacagaaataaagccaccctcctacaaccaactaatcttcaacaagttggacaaaaataagcaatggggaaaggactccctatttaataaatggtgctggaataactggctatccatatgcagaagaatgaaactggacccctgcctatcaccatatacaaaaattaactcaagacggattaaagacttaaatgtaagacttcaaacaattaaaatcctagaagaaaacctaggaaataccctcctgggcatcaaccgcggcaaagaatttataaataactaagtcctccaaagcagttacagcaaaacaaaaatcagcctgaacaacatggcaaaaacccgtctgtacaaagaatacaaaaattagcctggcatggtggtgcacacctgtagtctcagctactcaggaaactgaggtgggaggatcacttgagtccaggaggtcgaggctgcagtgagctatgatcgcacctctgcactccagccttggtgacagagtaagactgtgtctcaaaaacaaacaaacaaacaaacaaaattgacaagtgggacctaattaaacttaagagcttctgcacagcaaaagaaactatcaacagagtaaacagacagcctgcagaatgggagaaaatatttacaaactacgcatctaacaaagctctaatatccagaatctataaggaatgtaaacaattcaacaagcaaaaaacaaagacccccattaaaaagtgggcagagggctgggcacggtggctcacacctgtaatcccagcactttaggaggccaaggcaggcagatcacctgaggtcaggagttcaagaccatcctggccaacatggtgaaaccccatctctactaaaatacaaaaattagccaggcatggttgcgggcacctgtaatcccagctactcgggaggctgaggcaggagaatcacttgaatccgggaggcggaggttgcagtgagctgagatcgtgccactgcactccagcctgggtgacagagtgagactccgtctcccatcccaccccccgaaaaaaagtgggcagaggacatgaacaggcacttctcaaaagaagacatacagccaggcatggtggctcacgcctgtaatcccagcactttggggggccaaggtgggcggatcacctgaggtcaggagtttgagacaacctggccaacatggtgaaaccccgagtctactaaaaatacaaaaattacccaggtgtggtggcacgcgcttgtaatcccagctactcaggaagctgaggcaggagaatcacttgaatccggggcggtggaggttgcagtgagtcgagatcgtgccaccacactccagcctggatgacagagtgagactccgtctcaaaaaaataaaaataaaaagacatacaagtggtcaacaaacatgaaaaaatgctcatcatcactaatcatcagataaatgcaaatcaaaaccacaatgagtgccacctcacgccggtcagaatgggtattattaaaaagttaaaaaatagttgttggaaaggctgcagagaaaagaggatgcttatacactgctggtgggaatgtaaattagttcagccagtgtagagagcagtttggatatttctcaaagaactaaaaatagaactaccattccacccaaaggaaaataagtcatggctgagtgcggtggctcacacctgtaatcccaacactttgggaggctgaggcaggcggatcacaaggtcaggagttcaagaccagcctagccaacatagtgaaaccccgtctctactaaaaatacaaaaattagccgggcatggtggtacacgcctgcagtctcagctgctcaggaggctgaggcaggagaatcgcttgaacctgggaggtggaggtttcagcgagccaagatcgtgccactgcactccaacttgggcaacagagtgagacttcatctcaaaaaaagaaaataaatcattctaccaaaaagacaaatgcacatgtaggtttgtcacagcgtgattcacaatagcagagacatggagtcaacctaggtgcccatcagtggtggatggaataaagaaaatatggtacatatatatggcggaatactacacagtcataaaaaataatgaaatcatgtcctttgcagcaacatggatgcagctggaggccattattctgagtgaatgaatgcaggaatagaaaaccaaatactgcatgttctcacttataagtgggagctaaacattggatacacatggacataaatatgggaacaatagacactgtggactacaagagaggggagggagggagagaggggggcaagggttgaaaaactacctgttgggtactatgctcaatacctggatgacaggttcaatcataccccaaacctcagcaccatgcaatatacccttgtaacaaatctgcacacgtaacccctgaatctaaaagaaaaattgaaaaaagaaaaataaagtgccatctatgaaccagagagcaagcccacaacacacattgaatcttctggaacattgatcttaaacttccagcctccagaactgtgagaaataactttgttatttataagccacccagtctatggcattttgtcatagcagtctggatgaactaaggcaaatggcaaggttgtaaggagcacctgtaatcccagctattcggggggctgaggcaggagaattgcttgaacgattttttttttcttttttgaatcacttttttattttttgagacggagtctcgctctgtcacccaggctggagtgcaatggcaccatctcagctcactgcaacctccgcctcccgggttcaagcgattctcctgcctcagcctcccgagtagctgggactacaggcacacgccaccacacccagctaatttttgtatttttagtagagacggggtttcaccatattggccaggctggtcttgaactcctgaccttgtgatctgcctgcctcggcctcccaaagtgctgggattacaggcatgagccacggtgccccgtctacacccaggcaatttttgtattttttgtagagatgggggtttgccatgttgcccaggctggtctcaaacttgtaagctcaagcaatctgcccatctcggctttccaaagtgctaagattacaggcatgagcccccacacctggcctccaacttttaaaggaggcctccaacttttaaaggaggccgggtgtggt

SEQ ID NO: 45 - DNA, 6844 bp, Homo sapiens
ttgcacccaaatagcaaatctaaccctctacttcagtaatttttctctcagtctccttatctccattactaggacctaggagagcctctgtggctaagcttacttcagatgacctcttaggtcagatcggtggcccagcaactcagatgcaagtaaaatctcatttccctttccagggagttctctccatcaagcccattctccttagcacttagggttttaaaaattattattacaactctattgagggctgtgtatggtggctcacacctgtaattactgcactttgggaggctgaggctagagattgcttgagcccaggagttcaagaccagcctgggcaacatagggagaccccgtctctacaaaaaaataaaataaaccaggcatggcagcccatgcctgtagttccagatactcgagacgctgaggtaggaggattgcttgagcctgggacatcaaggctgcagtgagctgagattgtgcctcttcactccagcttgggcagcagagcaagacctggtttcaaaaaaagtttttttaaactatttttgtattttttaagccaggtgcggtagctcatgactgtaatcccagcactttgaggggccgaggcaggtggatcatctgaggtcaggagttcaagaccagcctggccaacatggtgaaatctggtctctactaaaaatacaaaaattagccaggcatcgtggcaggcacctgtagtcccagctactcaggaggctgaagcaggagaatcgcttgaaccccggaggcagaggttgcagtgagccaagattgcaccactgcactccagtttgggcaacaagagcaaaactccatctcaaaaaaagaaagaaaagaaagaaaggcaaggaggaagcttatctgtgaaaaagaaaagcactatcacaaggaatataggcagatgtacagaactgaaattcgaatggcgaggatggcaagaaaagctggcaacttctatgtacctgcagaacccaaattggcgtttgtcatcaggatcagaggcatcaatggtgtgagcccaaaggtctgaaaggtgttgcagcttctttgcctttgtcaaacttcagtggaaactttgtgaagctcaacaggcttcagttaacatgctgaggattgtagacccatatattgcatggggatacccaaatctgaagtcagtaaatgaactaatttacaagcatggttatggcaaaatcaataagaagcgaattgctttgatacataacactttgattgcttgatctcttggtaaatatggcatcatctgcctggaggatctgattcatgagatctatactgttggaaaatgcttcaaagaagcaaataactacctgtggcccttcaaattatcttctccacgaggcggaatgaagaaaaagaccacccattttgtagaaggtggagatgctagcaacagggaggaccagatcaacaggcttattagaagaatgaactaaggtgtctaccatgattatttttctaaggtggtcagttaataaacagtacctactcttggctgggcgtggtggctcattcctgtaatcccagcactttgggaggcagaggcgggtagatcacaaagtcaggagttcgataccatcctgcctaacacggtgaaaccccacctctactaaaaatacaaaaaaattagctgagcatggtggcgggcgcctgtagtcccagctactggggaggctgaggcaggagaatggtgtgaacccaggaggcagggcttgcagtgagctgagattgcaccactgcactccagcctgggcgacagagcgagactccatctcaaaaaaaagacaaataaataaataaataaaacagtacctactctcaaactgaaaaaaaaaaaaacatgcccggcctcctccttgccttttgaagcatcttttgggcaaacttctttctcaggtgcttgatttccagctcttcgaaattctttttctttttcttttcttttttttttttttgagaaggagtttcgctcttgttgcccaggctggagtgcagtggcacactcttggctcactgcaacctccgcctcccgggttcaagcgattctcctgcctcagcctcccgagtagctgggattacaggcatgtgccaccacgcccagctaattttgtaattttagtagagaagggtttctccatattgatcaggctgctctcaaacttccaacgtcaggtgatccgcccgccttagcctcccaaagtgttgggagtacaggcgtgagccaccacgcccggactccttcgctttttcttaagggtttctggcacagcaggaaccttcttcttctcttctacaccctgcatgttccagccggaaaaagaggatagagggtcttatatatggaatcattccatatgtccttgatttgatctggcttacttcacttagcatcactgttcaggattcactgatgttgctgtgtgtacactgcaaatagttcactccttttcattgccaagtagcattctgctatatggctgtgccccagttgttcatcctttcccctgtggagggacatctgggctggttcctttggcgctattatggataaagctgctgtgattattggagcacaagtccttgtgtggatgtgtccacatttactccaaagtttccccccaactgttctggctccttcttcccaccatatccacattttttcacatccctggtgcttaaaacaacaagcacccatcttctcccacactcacagtcaaagtctcctaaaagatatgcttcctttaatcattgctcaattaaacagagcgagcccctttgtctttttttttttttttttttttttttttttgagacagagtcttgctctgtcaccaggctggagtgcagtggcaggatcttgggtcactgcaacctccgcctcccgggttcaagcgattctcgtgcctcagcctcccgagtagctgggataccaggcatgtgccaccacacccagctaatttttgtatttttagtagagacggggttccccatgttggccaggctgttcttgaactcctgacctcgtgatccacccacctcggcctcccaaagtgctgggattataggcgtgagccaccgccctggcccctttgtcatttttattgctctactccaagctctctcctatttgtttctatcttttttttttgagacagagtctcactctgtcgcccaggctggagtgcaatggcgccatcttggctctctgcaactgccacctcctgggttcaagcagttctcttgcctcagcctcccgagtagctgggactacagccgcgtgccaccacgcccggctaatttttgtacttttagtagaagtctcgaactcctgacctcaagtgatctgcctgccccggcctcccaaagtgctgggattacatgcatgagccaccatgctcggccccgtttgtttctgtcttcctggtaatgaggtgtctgggctaagcaaggtagattgtcattatttagtcagcttggcaaatggacaaaagtccatggtgatagttttctaaagaggagaggtgcctgggagagggtgagcctgggattgatcagatactcctatctcaaaaacaggaagaggctaagggtcaggtgatgtgggacgctgcccttgggggactagtcccgagaggttatctgtacactttgcctttatcaccatctcctgtgggcagttcctgatgggttttctggaacacgggccgcattcacccactggttgtcacagactctaatctaccacattttcacctcttggactggggttagtactgtaactaaaacttctctctttcctctttggacatcaggagtgtggggctatggagccaccagaggagagaaggacagcggaggctggaaggcaggtctgggtctgtgctcgcaactctgataaactgacacttgctgatgacctggcatgtgtggtagctatccttcacagttattctttccagacagacaataacaagtatcagtgaggatgtgaataaaccagaaccctcacatattgctggtggggacgtaaaaagatgcagccactttggaaaatggtttagttacttcttataaagttaaacatacacttaccatatgacccagaaattccactcctgggtatctacctaacagaaataaaaatatgttcatgcaaagacttgcatgcaaatgttcatagcagcattattcataatagccggagtggaaacaatccaaatgtctattcaaccagtgcatagataagcaaaatgtggtgtatccaaacaatgaaataggcctcagcaataaaaaggaacaaaatacagacgcgcgccgcaacatgcataaacttcaaaacattttgataaagaagttaggtgtgtgactgcgtttatatgaagtgtccagaaaaggcaaaagtcttatagagacagagagcagattagtagttgtctggggctgggtataagagagttattgacggccaatgagtttgctattttggggatcatggagatattctaaaactggattgttatgtttgaacaattgtttacattactgaaagttattgaattatatacaaagatgggtgaaatttgtgatatgtaaattataacttaggaagaattttttttttttttttgagacagagttttgctgtgtcacccaggctggagtgcagtggtgcgatcttggcttattgcaacctccaccccccgggttcaagcgattctcctacctcagcctcccaagtagttgggacaattggcatgtgccaccacactgggctaatttttgtatttttagtagagacggggttttgccatgttgcccaggctggtctcaaactcctgacctcaactgatctgcctgccacggcctcccaaagtgctgggattacaggtgtgaaccaccacgcccagctggaatatttaaaacattatccttgcttgctgggcgcagtggctcacgtctgtaatcccagcactttgggaggtggaggtgggcagatcacctgaggtcaagagttcaagaccagcctggccaacatggtgaaaccccgtctctaccagaaatacaaaaattagccaggcatggtgacgggtgcctgtaaccccagctacttggggggctgaggtgggagaatcactcgaacccgggaggtggaggttgcagtgggccgagatcgcgccactgcactccagcttgggagacagagtgagactccctctcaaaaaacaaacgaaacaaaaacaaaagaacaggctgcccacctgggccagagtggctcctcaactgccagataaatctaaaagtcaccatttccacagaaccagcagtgggtgccgtactcagagaaaaccaactcagcctcccaggaagctcatttctcctcagaactaacttcacttcctagaacctcatttgttgaacaaattaacagagcacctacggtgggagagttggttctgaggatttggaggggctctgggagaaggagaaacttaaccaccccagccttgccaaccacctttgaatctcattagaaccaactttgaattccctgaaactggcttctcacaaacagtgcatcccctccagctgccttattagaaccaattttcagtcacctcaacaccaactgtctatctcaaactatcatctcagaaccacccatttaatagtctcagatccacctgactgggtcctttgtaagccttcgctggtcagctatggcagtgttctcaatcctctgttaatgacactaacacaatttctattgccctcaagtccccataaaacagagactctccagtggtgactgcttccagtcccattacagcagcctcagaaccaattttgtcaccagatttgtgatgactcccctgcattgtctcctcagaatcatcgttcattctcttcagagccagatttcatttttggctaatgaaattgtcaaggtccttacaactttctcttcagaagtatcttggttctggccgggtgcagtggctcacacctgtaatcccagcactttgggaggccgaggtgggcggatcacgaggtcaggagatcgagaccatcctggctaacacggtgaaaccccatctctacaaaaatacaaaaaattagctgggcgtggtggcgggcgcctgtagtcccagctactcaggaggctgaggcaggataatggcatgaacctgggaggcggagcttgcagtgagccgagatcgcgccactgcactccagcctgggtgacagagcgagactctgtctcaaaaaaaacaaaaaaacaaaaaaacaagaagtatcttgtttctactcggaaacatttttttccatctcctcaggtccagctgtcagccttcgtaaggcaagtctttaggttattcatccctgggcttcagtttccccatctacttcatgggggaaataatgtttattttttttcttctttgaaaaggtaatgttggccaggcgcagtggctcatgcttgtaatcccagcactttgggaggccgaggcaggtgcactgcttgagcccaggagttcgagaccagcctgggcaacatggtgaaaccccatctctacaaaaaataaaaaaattagaggagtatgatggcgcacttgttgtcccagctacttgggaggctgaggtgggagaaatgcttgatcctgggatgtggaggttgcagtgagccgagatctcatcactgtactccagcctggctgaaagagcaataccctgtctcaaaaaaaaaaaaaagataaaaaacaagacaaaacaaaacaacaaagagtaatgtgaattt

SEQ ID NO: 46 - DNA, 43136 bp, Homo sapiens
cgtgtcagttcatctttctacatttaacatttactgaaggtagcagaagtaacgttttggaagaaaaggatgtttggtaaatcagaacactatttcttgcaataactaaagatcattaataacatttcttccaaacttccccctccccaactccaactccagaaataaccaactagtttgataattactagaagaaaaaaagagaaacaattgtaatatttatacagacataaaggaatggtctggtaaatatggtacaaacaatgaaataaaacacggcaactgagcactatctattatattggtagttaacaaaaagcaaaatacaaaattgcaccttctcaacaccaaaaaaattgcagattttgccattacttttagaatggtaaaaactgcattacttttgcaccaacccaaaacaattatctataataaagtcatgaatatatatattgtcaatttgtcactaataaaattattttggtggtattttgttccatttcttcttacaggggtaattttttctgttatacctcaaatgtaactggcttaaactgatttcttttttcaaccaaatatgtgtctttggaaacaaacattctaatggcatgcctctatacatatctacctagttcaagggaatgcagtttgggagactgtgtgtacatgtgtgcacactcctgtgcgtacatgttaaagtgtaacgtgatccacctgaaatgtacatgcagctgtttatatcatgtagccatccatttcatgataaatatgtttggaaataaatttgtagtactacctcccaacagcaaatcttatttccttttagtttcagtaatagtatttagtattagttgtcactaataaggattatttttaatttgcagatggaaagcttcttcctttccatccataaatcgagtgtttcttctcaaaggcaatggttctcaaactttagtatgcaacagaatcacctgaggagcttttctttttttgagatggagtctcgctctgtcgcccaggctggagggcagtggcgcgatctctgctcactgcaagctccgcctcccgggttcaggccattctcctgcctcaccctcccgagtagctgggactacaggcacccgccaccactcaaaatcctggtccttatctgcaaagattctatttcagtgggcctatgacggagccaagaattctgcatttttaaggcaacttgctgtcctttgagaaacattgcactgaagtatttgggaactttgtttcactgtgatagctgtctgggacttaaatcttccgccaaaggaaaacctggaaaattttgtgattgagcaagcaaatcaagcccatgcgtagtagtagactgggaaccggtgggtgtgagacccaggctctatgtggcctacactcttctgaactcttctgagtcttgattcctggtctgtgaagtgtgcagtgtatccgaattaaatgagaaaatcattccgtgcttttagggtgagtttgaataacttttaggcagtccaccagatggcgatataacttttttttcaaatggagtggttagcctgccgaagttgtgagagtcagtcctacaacattcctagcagatcaagattttatgttcccagttctggcttcagagactgtagcgataacacagggctcatgcagtccaacatcccgtataatacaggttgccagttgttgccttttcagtatttctcctgtgtgatcctggactgcttgtgtcagattcacacaggagcatttgcttacaaatgcagcttccagggccctgcttcagacgtactgaccgagaatctctggaactggttcttcagtatctgctttgcaaaaacaatccgtaagtgctcaacaaacaggttaaagtctgagagccacgtgccagtgaaaaggaggttcacgtcttgctgaagccaccccttattagctgttttgttagaattcctccctcggtgagagtgggattaaggattcagggatgctagttctgccctcttgaggccacactgaagagatcaacttcctttttcttgggaaatgtctgaacattttgaaggtcgctaatcatgacttacctcacctccgcccctatcttctctgggggtggggaagaagtcatactttgcattacaggttggctgtcatcctccttccctttccaggaacactataaccagagactaagagcgaggaccttcactatttcttagctttgtgatcgtgagcaaataacataaactctttgagcctcaatttcctcttctgtaaaatacgagtgaaaataattatacctacttcaaaggattgttatgattattacatggggtgatgaatgcaaagtgaaaaggtaaaatatagcaaaatgtgatctattattaacaataatgagcttcagtttctacatctgtaaaatggtgatgataactactagagcatggggagaattaaatgaggtaatataagtaaggtagttggttaatgtctgacttagaagaggctctcaatagtagtaattataagatggccaataatgtaaaaacaccaatggtctatgcccctaatgatgtgggattttaaaaatcactgaagtaatgagattagcaatttccttactgttatcctgtaggatcagccttagaacaagtataaaacttgtatctcttctatactaagttccttttagaaaatgtttcttaatgaatccacaattatttaataaaacacaaagtattcaatttttaagtattaattcctcacagaaattgctttctaaagttttaagggtgcaaaaaacattaaaaatctttcagtaagctaaaactttaattaggcccttatataattcttgctaaagagagagaatggaactgagactgtgaaatgaaatgacaatgataatatttcctttgaaatttttaaggccaagttgcattaatgcaactttgaaattgttccaatcacacaaggtatttaattaaagcaaatgaaaggctcttcaattcccataaagatttacatggtaggaaaaatgtttctgttttagcaggtctataacatcatttttaaaaattacaaaaattattgtatctacttttaaagctggacagcaatagttatagagagaatcatttaattttagagtcaagcagaccaaattcccatctggctccaccagcgtgttccctttagaaagtaacatttaagagtttcattgcccttgtttgtaaaaaaggggatcatatttgcctccacagtgccgctgaggggtttaaacaaggtgctgaatctagaacacttacagagagcctgtaataagtactcagtgcttaaatgttacctaaaaacaaaggaagatcattagcactaccgtaaaaaattatatatgggtggggcacattggcttgattggtttcgctatatgggtttcaaccaaacgtcttggggaaaaattcggaaggcaataaaaggaaagtggaaaggacaaagaggattggagttggggagggtaagagacagttataagtctgaggaaaaattaggaaatagcatagaattctaattcaaataacttaattacccttgtatttatattttttcttaaagttgttttactttagtgagcagtctttcttctcagattgtgtcttagcatattaatgaaaaaaacagatgataatattactgtacaataagagtttagcagtgattgaaattcagtgtcaatgaagacacagggcaatggagagaaaaatcatagatatgtcatgaaaacagttttagtaatttttcatttcaacaacaaatttcataataatgatataagtacattctttattttatatatatatatgttctttttatagagatggggtctcactgtgttgaccaggctggtcttgaactcctggtctcaagcaatcctcccatcttggcctcccaaagtgctgggattacagatgcgaaccaccatgcctggcctctgaattttaaaatagttatgagtgcctttagaatttctactattggagccctttatgcttctatttaccttcaatcaagatttgcacctcagaaaacatagttacttgttgttgttgttgttgttgttaggaaaagttcagtatgaatgctgttgtctcattctacatagcaattgtttgggtcatgtataataaagaattgatacctactctaaaaatgaagatattttgtgttctaggaattgagtggcacttggtcaaagaatgatttatggaatctctgggcataaggggaattgattgctctttagtttttcttttccacacttagtactaaattattttgaatttatgggaagttaagctaagtgaaccacatctttccattttgttgcaaggagcttatcactttctaaacggagaactatactgtctcggagtaatggattgaatagtggcccccccaaaattatgtccacttcctaaatcgcagaacctgtgaatgttactttgaaaaaaaaagggggtctttgtagatgtcattaagttaaggatctccagatggggaggtgatcctggattatctgagtgggttctaacccagtgacaagagtccttataaaagacacacgaaggactgacacacagagatgagaaagaggcaatgtaaccatggagacagagactggagtgatgtgccacaaatcaaggcaagtttgtagccaccagaagacggaagaggtaagaagtacatcatcccctggcctccagaggagtgtggccctgctaacactctgattttggactcctggcatccaactgcgtgagtataaatttctgttgttttaagccaccaagtttgtggtcatttgttacagcggccacaggaagctaatacacagggtaagctgataggggaatgagagagttttttcacagttgcatgaatgggttaagaattctaaagaataattagccaggtgtggtggtggatgcctgtaatcccagctactcgagaggctgggaggcaggagaatcactggaacccgagaggcggaggttgcagtgagccaagatggcgccactacactctagcctgggcgacagagggcgactctgtctcaaaaaaaaaaaaaaaaagttatttgaaagaataaacattattgggtaaggggagatgacatggtagccattagaaagaggggtggggggagtgaggaaaaaaggcaaaaaacagagaccaggaaggtgaataaccagaatgtgagctaaggagatggaataggaaggacactgtacccaggcagagtatggactgaggagaaaaataaatgatatccctaaatatgttttaatttcagggagttactttgtcttctcatattttactcagatcgctttgtgtgtgtgtgcgtgcgtgtgtgtgtgtgtgtgtgtgtgatgaaatacatattttaattaaatattttacctcagaaacagcctctcagagaatgtttttggataaaatgcaatgttttggtaatattctcttcagaaacattaagttaggatgttagggtgatggaaaaacctcaataaaaaccagtagcttaagtatggagacactcagaactcagtcatcacattgggaagaaaatgagatagtggaaaagaagaaaaagtcacccaggaaagagcccgagaaaacttctaagagtcggagtttttcactgatgcttaccaaagcttagctgtatggaataatggaggaatacatccttttaactttagtcaagctttttaaattctgaaaaggggactctttcacttagagtgctgcagtacaaggaaagcaattgtttggagaaaataggctatgcattctgaaaaaaaatatttctttttggcaagggctatggattcctgtcaatctaaagggatctctaaacttagggagagggtaggaagtagctctgccctctgagaggctctattttattctgaaaggccgaatgtgacaaaagcagctttaatgatcagacagagctgaggtatccaaagctacatataaaatagaagcttaggacacctgaaaaaacagacaagaattaacacaatagcaaacaaaatggcagactcaatcactgcacctggccgaaatatttctatgaagtcagagtttagctgggtaccagagcaattttctccctaaaattgggtaatgaaaatttgaacagaagaggtggtatgtgctgattaattttatgtgttaacttgactgggctgaaggatgcccagatagctggtaaaacattatttctggatgtatctgtgaagatgtttccagaagaggttagtatttgaattggtaggctgagtaaagtagattactctcaccaatgtggtggttagagagtccatcaaccaacccagtgaggactcgaatagaagaaaaaggtggaggaaaggcaaatttgttctcttttcttgagctggcacatccatcttctcccatccttggatgacagaatttctggttctctgatcttcacacttgggctaaattacccactggctttccaaattctccaacttgcagatagcaggttgcagagcttctcagcctctgtaatcacatgagctaattcccataattaatctctgtctctgtctctctctttttctttcacttaataaatatggagatttattgaagaaccaagaggatataccactggttctgtttctctggtgaatcttaatacataaggttaaaatagattaacattagaagcgaaaagtgaaaatgcctcaaaatatattttaaaacttctacttcaaactatagaaaacacgatttcttggtcatcaaatcatggaagaacatctcattcttggaatatgttgaggtatatgagaaatcttctcattgcttctcagaattcttagcacctgcaaaaccattattttgtttatataatcttacagaaatgttacccaactactagattcacgtgaaataattttttcttttgatagaaaaccagcgaggtcagtaatttctgtcgggagaaagagcaggagaaacaattctccttacatgaattcttaggtgtccagttgaaaacattccagaagagggggtggaccatggatggtgggaagcacaaacttcagagccagatccccaaagtttggtgaaaaggccaggaaaagcaccaaataaacacacagccatgcagcccttaacaagtctactttgtaaaagcaattttgttaatctctttcttcaggaaacactttttcttgtggcggtatttactttgttaaacgaagaaagttccctgccttctctctctccagttagggctaaaacctggacactgacagagctaatgtatgtttgatctaatcagtcaagatcaagtgggggaaagcaataaaaataaatttcaaaatgttctctatcaaaaatttttcaagaaaaatgttctaattaagaatctccctcaagtatgtttctgtacaattggaccagtgaactgggactggaagtgtcaagagggttgtagaaatgaaagtattgcctcattttctgatttttgttcccacctacaggagctcccacagtgttctactctttccattttagggagaagatgtagagcagtacaacttttttccctctatgacatgtcccagacctttccgaactctttagtgcctctgattattagtaaacaattcaagcttactgatggagactgtaactttgatgtcatttttcttctccttggtttacagccaggaatcattgcatgtcttccaggtattggcaggaacacatacatttcccaagcatataggtgggattagtataaaataaacttatgaggcctttcatattttatgttgcctcagaccaggtaagttttgtcttaattttctgattatcctgagatgtttctccatttactccattgaatctacttgactctgagttctttttttctttattcttctctattcttattctttttttttaaattcttgatggtgataatatctcttcgcttcaagtgataatgttcattccttaccctgttagatatttttaatataattcttataaacttcttaattttctcaaaggcccatgcctctatgataatgatcagcacttgtttaatttgaaaatgtcaggcatatgtaagaggttcaattgcccaggagctcataactccttactcattcattaaaaacaaatcatcgggatgctcctgctctaatgtttagagcctttcttttaacaaatggcctcttaattttcatggtagaaaagacttttttttccttctgtgatacagaacagttttcaattatttagtcgtcatgagctgaagcagggtagccgtagatatgctagactatttttctacaataaccccagcatgtcctttatttaggagaaattttgactgatggtggaaagaaatttaaagtactcctgcattaaatgaagttatgattcatactaacagtgaaaatgattatttgaatctcagaaggcatacatttctaaaacaatgtttgttttgattatcttctaagagaatatcgagatttacaaaatttattctttctttcatttcattgtatcatccttttcctatgtgaacaatctcacatggcttttccttctttcagagtggatttggtattttttctctttcatttgtatgctttccatttactttgtatttaaagacaatctcaaacttgtaaaaagttacaagtacagtaaaagaactttcttttgaaattttttgagtgtagttgctaacatgctcattcaacttacctgactacttctatgtattccactacaaacaagaatgtttcctacaaacattcttctacataaccatattaccatcaaagtcagcaaattaacagtgataggttactaccatataatcctcaaattctttcaagtttcctcaattttctcaatgatgtccttcatagcaaagggatccagttcagcgtcatgtgtttcattttgttgtcatatctgtttggttttcttcaatgtggaacagttccctagtctttcttggcctttatgaccttaacacttttgaagattacaggccaattattttgtagaatagctctcaatttgagttcacctaatgttttcttatgaatagatttaggtttgcatctttgataggaatatcatagcaatggtgacaattttgattcacctcattactggtgatgttaactttggtcactgattggtgtctgctagacttctccactgtaaagttactctttcttccctttgtaattaataaatattttgtaaggtggtactttgagactatgcaaatatcctgttcctcatcagactttcaatttgtccattcatttatttatttcagtgtggactcatgggttcctattttattcagtaggttaaaaccagttgctttcattatttagtttgatgctcagtgtgggggttcaataaggctggtgggaaaaatattaaagatagttatagtaatagccacaaactctcttggaaggcctgagagtttgtataacatcagtaatagatctggctgaaggcggcctggtccctttacctttagttaaataagttaaagtagtaactaaggaatgtggggaagttatctagctagcttgtttactcatgtggtcttaagactaacctttgatgtacggcaggtgcttaattgctttctacttgggaattccacagtgtcaattaccctctagtggtgttgactcaagcctttgtcaattaatcttccccaaataaatgtgagtctcactagctggtcagggccacagtcacaactgtttacagtactctccagggagtctgtaagtggcttggacactcagctggactggcaaagcagaatatctgtgtgtcagtgtacttcattcatccatggctggctcagggtctgcgggtcagaccgccccaagtgagaactctttcaagagtctttttgatatgttctcataagtctttcagtgcttctttacttcctggcaaagatgtcccaggctcatcttatagtttccctgccctagacttgggatcagccatttctccaaggagacttggatcctgttttggagtatggtcttcagaaaagatgtcagaaccaggtgtgctcattgttactgagggcttgttacttcctgttttcaatggacagagctagttaatatatatatatacttatatacatacataagcacatttttacacctatacttctatatccctattgaaaaccatgggttcactttgatatctccaattccaatctaacagcacagggctcattcatgttttctctccttctatatttgaaacttccttctccaatagtgagaagtcttgatatatttttgatcaagccttctgtatgtcaccagtctgtcattgctgctgcatcccacactccctgtgcaatgctttccctacctgcttgggcttcaatatcccacaccaggcttctcctctcgttgatgttcttcttgctctacttgagctccattacccctaactagtccagcatcctcaccttgcctgggctttagcactctgatttgggtaaccacaggattccccctatccttgccatattcatttctcttgccacttagtggcctttggattgatctgaacaaggaaaggataaaagagaagttatcattttattttcaagttagtatttgctgagtactatttatcaagctctgtattatctcattttagtgacataatgaacttgattacattttactaattgaagcagtcaagatgaaagaagttgtcacttgccagactccacagccagtaagtggcagatccaggactggatgttgtcttgctgactataaaccaatgttccacttggaagctgtgtatgtgtgattcatagaaaaagtggttaattttcaaaggcaataatcatagaattggtagtgtataaattttttggggatataattgtcagatgtctcaattacaagcccaagatagatgaggcagtattaatttgctaattacatattttgaaaagattgtacataaagaaaatgttttctctttaattacggcattaaggatttcaaaaggtactttataatttataccatttcatttcataattttatttcttttctctgtgttttaaagcatgttctaagggttaaacttttaaactttaaactacacagtgaatcactttcttttcttttctttttttttatttttttgagatggagactcagtctgtctcccaggctggagtgcaatggtgcaatctcagctcactgtgacctttgcctcccaggttcaagcgattctcctgtctcagcctcctgagtagctgggattacaaacatgctccactacacctggctaatttttgtatttttagtagagacagcgtttcacagtcttggtcaggctggtctcgaactcctgacctcaggtgatccacccgccttggccttccaaaatgctgggattacaggcatgagccaccgcgcctggcctgtgaatcactttcaataagcctttccataatttagaaaaagacatataagaaggaagatttcttacgctgtttgccttttgttaaataatggtgacccagtttctaaaaggaaccagtttctaaaaggaaaacctgagtaattacttagaagaggctggctttctaaacttagttaacagctattattatttaattgtcagttttacagtaacttggtaagtttcctgcttaatctaactactctaaattgtactaaaaaacctaccctgttccctgcattgtatttttcatgtctttacaagcttgcactgaggccttaccttcctacattattggccagcttatgtaatgcccatgccaggcaaccaccatttgctttctacaaggtgtctcatttaaatttcagaactacattcttattctgtagttccattgttactccaattttataggtgaaaaaactgaaactcagtggggtaaagtaacttgaccaaaatcacatttctaggataacaatggcttcttctgcaataccttctgaaggacctacctgaggctgttttacagttaacttttttaaataagataaatagttgggacttaattaaactaaagggcttttgcatggcaaaaggaacagtcagcagggtaaacagacaacccacagagtgggagaaaatcttcacaatctatacatctgacaaaggactaatatccggaatctacaacaaactcaaacaaaccagtaagaaaaaaaaatcccatcaaaaagtgggcaaaggacatgaatagacaattctcaaaagaagatatacaaatggtcaatgaacatacatgaaaaaatgctcagcatcactaatgatcagggaaatgcaaatcaaaaccacaatgtgataccaccttactcctgcaagaatggccataatcaaaatattaaaaaatggccaggcatggtggcttatgcctgtaatcccagcactttgggaggccgaggcagatcacctgaggtcgggagtttgagaccagcctggccaacatggtgaaaccctgtctctactgcaaatacaaaaattagcctggcgtggtggcaggtgcctgtaatcccagctactcgggaggctgagggaggagaatcatatgaacctgggaggccaaggttgcggtgagccgagatcgtgctattgcactacagcctgggggacaagagcgagacttcgtctcaaaaaaaaaaaaaattaaaaaacagtagatgttggcatggatgtggtgatcagggaacacttccacactgctggtgggaatgtaaactagcacagccactatggaaaacaccgtggagattccttaaagaactaaaagtagaactaccatttaatccagcaatcacactactgggtatctatccagaggaattgaagtcattatatgaaaaagatacttgcacatgcatgtttgtaacagtacaatttgcaattgtgaaatcatggaactaacccaaatgcccgtcaatgagtggaaaaagaaactgtgtgtgtgtgtgtgtgtgtgtgtgtgtgtgtgtatatatatatatatatatatatatatatatatatatatatatatatgatggaatactactcagccataaaaaggaatgaattaatggcatttgcagtgacctggatgtgattggagactattattctaagtgatgtaactcaggaatggaaaaccaaacatcatatgttctcactgatatgtgagagctaagctatgaagacgcaaaggcataagaatgatacaatggactttggggacttggggggaagggtgtgaggggagtgagggataaaagactacaaatagggtacagcatatactgcttgggttatgagtgctccaaaatctcacaaatcaccactaaagaacttactgatataactaaataccacctgtactccaataacttatggaaaaacaaaatatttttttttttgagatgcagtctcactctgtcgcccaggctggagtgcagtggtgtgatattggctcactgcaagctctgcctcccaggttcacaccattctcctgcctcagcctcccaagtagctgggactacaggcgcccaccaccatgcctggctaattttttgcatttttagtagagatggggtttcactgtgttagtcaggatggtcttgatctcccggcctcatgattcacatgccttggcctcccaaagtgctgacattacaggcgtgagccaccgtgcccggcccaaaaaaattttttaaaaaaagatcagtaagatcttatacaaaaatagtggacatgaaaacactataaatcaattgaacataaaagatgtatacagaacgctctaccccaaaacaacataatatacatttttatcaaagcacatagaacattccccaggacagaccatatgttaagtcacaaaataattttaataaatttttaaaggattaaaatcatacaaagtattttatctgaccacaaggaatgaaattagaagtaaaaaatagaaagaaattggaaaatttgcaaatacataaaaattaaacagcacattttacaacaaccaatatgttaaacaagaaatcgcaagataaattagaaaatacttagagatgaatgaaaataaaaatacaaactaataaaacttatagggtgcagttaatgcagtactcagagggaaattatagctgtaaacccatacattaaaaaatgaagatggatctcaagttaataatataacttataatgtaacttaaagaactaaaaaaagaacaaactaaagcaaacctaacagaaggaaggaaataattaagattagattagtgataaataaaatagagaatagaaaagcaattgagggagttaatggaaacaaaagttggctctttgaaaagatcaacaaaattgacaaacttttaaagctggaccaattttaaaaagagagaagactcaagttactaaaataagaagttaaatgaaggcattttcctggacacacaaaaagaaaatggattaaaagagaatactatggacaattgtataccaacacattagaaaacctggatgaaatgggcaagaaacacacaaaccctgaaatctgactcaagaagaaatggaaaatctgaacatatctgtaaaagtggatatgtttacaccttctaaacactttacttcttctaaaaagacagaatcagtaatcagaagcctcccgacaaagaaaagcccaagaccagatggtctcattggtgatttctgcctaacatttgcagaagaatgaacaccaatccctttcaaactcttcaagagatagaaggggagaaaacactttctaaccgattttttgaggccaacattaccctgatatgaaagccagacaaagacacctcaagacaagaaaaccacaaaccaacattccctatgaaaacatatgcaaaaatagtcaatgtatactagtaaaccaaatcaagtaacataccaaaaaggctatacactatgattaagttgaatatatcacaggaatacaagggtggctcaccttatggacattattcaatgtaatacaccaccgtaacaagatgaaggtgaaaatgaatgaccatcttgatttatgcaaagtatttgacaatcacaagaatgacaagaatactcaacaaattagaaatagaatggaacttacttaacatgatgtagagacctaattagagaaaaggagtcaggctggcaggaccaagggaaagcaaaaagatagaacaaataaactataaatatggctttcttcatagttatataaacaaaagaggaattaaatgaattataggtctgtttttctttatggcccaagacatatagccctcctgaacaaataaaatacataacttacaaacttcctgcttgccataaaatgcctcaatttatcaaacatcctggctgacagaagaatgcaagtttccaagttccatcctataaaatctccagcaagcctttgtttctttgcagtcagctcctcttctgctggcttgcacattgcctcctcacaacatgttttcatactttctttaataaatctgcctttctttacctacaattgtcttggtaaattcttttatctctacaccaccaacccagatagtcatcactcacctacaacacatgataaacggcatttagggaaaacacatagctacatcatactccatgaagaatgaataaaagctttcccctaagtataggaaaaatacacgatgcctgcttttgtcccttctattcagtactgaaagttctggctagaacaattatgcaagaaaaaaacaaacgaataaaacagatccaaattataaaggaaggagtaaaactatttgcagatcatatgatcctatagataggaaatcttaaaagatatacacacacaaactattagagctaataaattcaggaaagtattgagtatataactagcacttaaaacttagttttgtcaacatgctgttcgctatgttaaaaaaaaagattagttttgtttctactcatagcaatgaataatccaaaactaaattaagaaaataatttcagaagggtggagcaagatggcacaatagaaaactccactgattgtccctcaatgctagcacaccaagctgtctacacagacaaaacaccttcataagaatgaaaaatcaagtgaccactcatagtacctggttttaaattcatattgctgaaagaagcactgaagaggttaaaaaaaaaaaaaagccctgaatcgcagacaccacccctcccttacccctggcagcagcagtgggcatctctgggtactgggggagggagaacacaccaactgtgaagcattgaaagtgctgttctattagagcagaaaggaaacccagaccaaactcaactgacctgcctgcaaagggagggacccagtgatctaaacttgagttcctgcaaacctcaccaccacgggctacagcaccgtgtgtctccaagtaaacttgaaaggcagtctaggcgataaggattgcaacttgtaggtgagtcctggggctgaattaggcccagagacagtggactagggggacacgtgacatactgagacaccggccgggtcagctaaggaagtactggcatcacccttcccctaaccccaggctgcacagcttgtggcttcaaagagaacccctgtcttctgtttgaggagaacagagggaagagtagggagaactttgtcttgcatctaggatcccagcccagccacagcaggatagggcactggtcagaattgtgaggcccctattccaggccctggttcccagacaacttttctagatatgctctgggccagaagataactggcagccttgaaggaaaggacccagtactgctaccattaatcacttgctaatcaaagagcccttgtgccctaaaaaaccagcagcaatatctaggtactacatccagggccttgggtgaacttctgagatttgatgacttcaggtgagactcaggacataaccagctatggtggctatgtgaccaaactccttccacttgagaaaagcagagggaaaagtaaagaagactttgtcttacatcttagatactagtatggtcacagttgtgtagagcaccaagcaggctcttggggtcctcaatcccaggacttgactcttggatgacatttctggacctgccctgggccagagcggtacccactgccctgaaagatgagtccctggccaggcagcattcaccacaagcttgcttaaaataccttgggccttaacagaacaccgtggtagtctggcagtattcttcatggcctggggtggcagtagctatggtgaggctcctcttcctttggaaaggggagggaagagtgggaagaaatgcattgtgtggtttgagtgccagctcagctgaatgcaacagaacaccatgtagacttctaaggtttttgactctagtccctgactcccaggtggcacttctgaacccacctggggcttgggggaccttgctgctctgaagagaaggacacaggcctgactggctttaccacctgctgattgtagagccccagggccttgagtaaacataagaagtagccagggaaaagttacagtgggccttgggcaagaaccagctctgttctggcttcaggtttgacccggtgcagtcatagtggtggtggccacaggggtgcttgtgtcactccgtccaaatctttaggtggctcagaacagagagagagactctgtatgtttgagataaagtaagggaagggaacaagggtctctgccttgttcccttttctagaattttctctagccagaaaattctcctagatcttgttcaagattagcaagatggtacctctgcaatactgcaagaaccacagcattactgggcttgggttgcccactaaagcagatacagcttagatcacaaaacccaagtcctttcaaatatctgaaaagccttcgcaagaaggatggctacaaataagcttagacagtgaagactacaataaatacctaatcattcaatgcaagactttgaagaacatctactagcatcgatgccatccaggaaaatgtgacctaaccaaataaggcactaggaccaatcctggagaaacatatatgtgacctttcagacagagaattcaaaatagctatgttgaagaaactcaaagaaattcaagataacaccaagaaggaattcagaattctatcagataaatttaacaaagagattgaaataattaaaaagaaccaagcagaaattctggagttgaaaaatgcaaactactaaagaatacattaaagtcctttaatggcagaattgaacaagcagaagaaagaattagtgagcttgaagacaggctaattgaaaacacatagaggagacaaaacaagattctaaaagcagcaggataaaagaaagaaataacatacaatggagctccaatacatatggcagcaggcttttaagtggaaaccttagaggccaggagaaagaggcatgacatatttaacgtgatgaaggaagaaaactttcagcctagaatagtattatccagtgaaaatgtccttcaaacatgaagaataaagactttcccagacaaacaaaagctgaggaatttcatcaataccagacttctcctacaagaaatgctaaagggagtacttcaatccaaaagaaaaggaagttaaaaagcaataagtaatcacctgaaggtaccaaacccatggataatagtaagtacacagaaacacagaatattataacactgtaactgtggtgtgtaaactacccttatcctaagtagaaagactaaatgatgaactaaagactaaagaaatcaataaaaaataacaactacaataactcttcaagacatagtcaatacaaggtataaatagagacaaaaaaactgttaaaaagcaggtggatgaagttaaggcatagagttcgtattagttttctttttgcttatttgtgtatacaaatagtgttaagttgttatcacattaaaataatgggttataagatagtatttgttggccgggcacagtggctcatgcctgtaatcccagcactttgggaggccaaggcaggcagatcacaaggtcaggagattaagaccatcccggctaacacggtgaaacctcgtctctgctaaaaatacaaaaaattagccaggtgtggtggcatatgcctgtagttccagctactcgggaggctgaggcaggagaatcgcttgaacccaggaggcagaggttgcagtgagccaagattgagccactgcactccagcctgggtgacagagtgagactccacctcaaaaaaaaaaaaaaaaatagtatttgtgaccttcatggtaatctcaaaccaaaaaaacatgcaatggatgcacaaaaaataaaaagcaagaaactaagtcttatcaccagagaaaatcaccttcactagaggaagacaggaaggaaagaaagaaggaagaaatgaccacaaaacaactaggaaacaaataacaaaatagcaggagtaagtattcacttcttaatgacaacattgaatgtaaatggactaaactctccaatcgaaagacatagactggctgaatgaataaaaaaaaagatctattgatctgctgcctataagaaacacacttcacctataaagacacacataggctgaaaataaagggacagaaaaagatatttcatgccaatggaaaccaaaaaagagcaggagtcactatatttgtatcagatgaaatagattttaatcaaaaactataagaagagacaaagaggttactatgtaacaataaagtggtgtattagtccgttttcatgttgctgataaggacatacctgagactgggaagaaaaagaggtttaattggatttacagttccacatggctaaggagccctcagaatcatggtgggaggtgaaagacacttcttacatggtggcagcaagagaaaaatgaggaagaaacaaaagcagaaacccctgataaacccatcagatctcatgagacttatccattatcatgagaatagcatgggaaagactggcccccatgattcaattacctcccccgggtctctcccacaacatgtgggaattctgggagatacaattcaaattgagatttgggtggggacacagccaaaccatataattccacccctggcccctccaaatctcacatcctaacatttcaaaaccaatcataccttcccaacagtcccctaaagtcttaactcatttcagcattaacccaaaagtccacagtcggaagactcatctgagacatggcaagtcccttccaccaatgagcctgtaaaatcacaagcaagctttacttcctggatacaatgggggtattgggtaaatacagccattccaaatgggagaagttggccaaaacaaaggggttacggggcccatgaagtctgaaatccagagaggcagtcaaattgtaaagctccaaaatgatctcctttgactccaggtctcacatccaggttacgctgatgcaagagatgggttcccatggtcttggacagctctgcccctgtggctttgcagggtagagccttccttcaggctgctttcatgggctggcattgagtgtctgaggcttttccaggtgcacggtgcaagctgtcggttgatctaccattctgggttctggagaacagtggccctcttcttacacctccactaggcagtgccccagtagagactgtgtgtgggggctccaaccccacatttcccttctgcactgccctagcagaggttctccatgagggccctacccctgtagcacacttttgcctgtgcatccaggtgtttccattcatcttctgaaatctaggtggaggttcccaaacctcaattcttgacttctgtgcacccacatgctcaacaccatgtggaagctgcctaggcttggggcttccaccctctgaagccacagcccgagctgtatattggcccctttaagccacagctagagcagctgggacaagtggaccaagtccctaggctgcacacaacctggagaccctgggcctggcccatgaaaccattatttcttcctgggcctctgggcctgtgatgggaggggcgccatgaaggtctctgacatggcctggagacattttccccatggtcttggggattaacattagactccctgatacttatgcaaatttctgcagccagcttgaatttctccccagaaaaatgggtttttcttttctatcacttagtcaggctgcaaattttccaaacattaatgctcttctttctttataaatctgaatgtctttaacggtacccaagttaccgcttgaaggctttgctgcttagaaatttcttctaccagttaccctaaatcatccttctcaagttaaagttccacaaatctctagggcagaggcaaaatgctgccagtctctttgctaaaacataacaagagtcacctttgctccagttctcaaaaagttcctcagctccatatgagaccacctcagcctggacctcatagtccatatcattatcagcattttaggcaaagccattcaacaagtctctaggaagtttcaaactttcccacattctcctatcttcttttgagccctccaaactgttccaacctctgtctgtaatcccagcacgggcaaatttcttactgtctgtgagactcacttaaaattataataggtgtacccaactaataaacgaagtcatttgatcttatgagtaagcaatgatatggggagagctcaacttctcttttgcttctttttcataaccactctttgttgtctatgctggacatatatttagcatgaagaaggatatccagtagtcctttcttatccacagggaatatgttgcaaaacctccagtggatgcttcaaactttggatagtactgaactcaatcgttgtcaattggaacattttctgtcgatgtcttccacccgcaaatttaatgccttttccatcttaactaagcacttatcacacactgtggatgtaacttttacagtttgagatgtgagcaaaactagcaaaattttttttccttcagcgtttaatggatagaagattcattcttactgtagatattagcaacctagtatatgacttttccccttattaagtcaagaattttcaccttttcacttaaaggaagcactttacaacttctctttggtgtatctgaattgccagcatcactcttcttgaactttggggccattattaagtaaagtaagagttacttgaatataagcgtgtggtattatgatacatctgataatgaaggcagctactaagtgactaacaggcaggtactgtctatagtgtggatatcctgaacaaaggaataatttacgtcctgagtgggatgaagtggtgcaagatttaatcacccaattcagaatgatgtgcaattcaaaatttatgaattgtttatttctggaattttccatttattattttcagattgcagttggctgtggataaccgaaactgcagaaagtgaagctgtggataagggacggacaacagtgcatcacattaacagaatgaaaaacaaaaaccatataatcatcttggtacatgcagaaaaaacatttgataaaattcaacctccctttatgatttaaaaaaccaacaaattaagtatacaaagaatataactcaaggaaataaagtccatatatgaaaaacctacagctaacatcatattcaatgttgaaaagctgaaagttttttctcagtatcagaaacaagacaaagatgcccactcttaactcttctattcaacatattcctgcaagttcctagccagaccaattaggaaaaaaaaagtcatgtaaataacatttgacccagccatccccttattgggtatatacccaaaggaatataaatcatgctgctgtaaagacacctgcacacatatgtttattgcggcactactcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacactgcatgttctcactcataggtgggaactgaacaatgagaacacttggacacaggaaggggaacatcacacactggggcctgttgtggggtggggggaggggggagggatagcattaggagatatacccaatgtaaatgacaagttaatgggtgcagcacaccaacatggcacatatgtacacatgtaacaaacctgcatgttgtgtacatgtaccctagaacttagagtataattatatatatatatatatatataaagaaaagtaagaagtgaaattgtctctctttgctgatggcatgatcttctatatacaaaaccctaaagactccaccaaaaaactggtagaattagtaaacaaattcagtaaagttgtaggatacaaaatcaacacagaaaaattaggagcatttctatatactaacagtgacctatctgaaaaggaaatttaaaaaaattccatttacagtagtatcaaaagaataaaaacaattttatttaaaatttagaagtaaattttttaaaatttaggaataaatttaataatttaataatagaagataaaacttagaaataaatctaactaagagggtgaaatatctgtacactggaaattatgaaacattgatgaaagaaattgaaaagacacaaataaatggaaacatataccagttcacgggttggaagaattaatattgttaaaatgtccatactacccaaagtgatctacagattcaatgcaatctctacaaaatttcaatgttatttttcacattagaggtagaaacaatccaaaaatttatatgaaactaccaaagacactgcctgaatagccaaagcaatcttgaacagaaagaacaacatttgaggcattatgctacctgacttcaaaatatattacaaagctatagtaattaaaacagcatagtattgtcacacagacagacacacaaaccaatgagacagaataaataatagaattaaacccatgcatttatggtcacttgatttttgacaaaggtatcaagaaaatacaatggggataagacactcttcaataaatggtgttggaaaaactggatatccacatgcagaataatgaaattggacatttatctcacaccctgtatgcaaatcaactgaaattagattaaatacttaaatgtaagacccgaaactgtaatagtcccagaagaaaacataggggaaacgctccatgactttgttctgggcaatgattttttagatataacccctaaagcacaggcaacagaaacaaaaatacacaaatgggactgtatcaaactaaaaagcttctgcacagcataggaagcaagtaatagagtaaagagataacctacagaatggaagaaaatatttgcaacatacatctgaaaaggggttaatatccaaaatatataaagtactcaaagttcaataataagaaaataagtaatccaattttaaaagggcccaaatagatgtttctcaaaagaagacatataattgggcaacaggtatatgaaaaaatgttcaacatcaataattatcagcaaaatgcaaaataaaaccaaaatgagacaccatctcaaatctgttaggatggttattataaaaaagacaagaggtaacaagttttggtgaggatgtgaacaaaaaaccccttgtatgctgctggtgggaatgtaaattagtacagccattatggaagacaccatggaggttcctcagaaaactatatgatccagcaatcccacttctgggcatatccaaaggaactgaaatcaggatcaaagaaacatctgcactcccatgttcatttcagcattattcacaatagccaagctatggaagcaacccaagtgtccatcagtagatgaatgtataaagaaaccatggtatgcatacccaatggaatactatttggccagaagaaagaatgaaatcaagtcatctgcagcaacatggatggaactgaaggttatcatgttaagtgaaataagccagactcagaaagacaactattgcatgacctcacctatatatggaatataaaaaaataaaactcatgaaagtaaagagtagaatagaagtcaccagaggatgaggggaaatacggagtcgttcatcaaaaggtacaaaatttctgttagacaggaagaacaagttttgaagatctattgcacagcacaatgaccatagttaataatgtaatgtatatttcaaaattgctaagagagattttatgagctcataccacaaatgttaaatatgtgatgaatatgttaattttagcttgatttaattattccataatgtatacacatatcaaaacatcactttgtatgtcataaatatataccattgttttttgtcaagtatttataaaaaaacttgtcatgttaaaaaaggcacatgcataccttcaaactagaaaaattctacttattgtttctggcttagaaaaataatcatagatgtatgtaaagattcatatgtaataatgttcatcttaatatttttatacacaatgaaaagttgaatataagctaaatgtttaattgtagctactaaaaattaggttttagaagaatattcaatgatatacaaaataaacattacattaaaaagaaaaaagaattgaaagtaaagtgatggaaacattaacaattaaaaattaatcaagtgaaaacttttatagctataataatactaaattggtctttgaggaagcactactagtaatgaataaattactttaataaaattatcaattaaaagtaatggccagaaattctaattttatgtaaaattaatttcatggcttcaaatgtatatataatgggataagatgacagaagtataattaaaaaacaaaagaaatccaggtacatagttggaaatcttaacacaattctctcaacaataaatagaagatagaagagttaaaaacatttatatatttattcatgaacaacatgaataatggacttaagaaactcatatgtaatgataattgaatttaagtaacatatataacactacactctcagcctaaaaaacacatatttctttcaagtttacatgcaacagatatctgaaaagaccataaactgggccattataatgatattgggaaaaaagcttctaagtttggaaattatgcaatatactgcaaaataatgccaaagaaaattacgatgaatatttaaaaatagttcatatttaatgatgattaaaatataatatgttaaatttgtggaatgcagctaaaggtgtgctcagtagaaatgtgaagctctaaatacatttgaaaggaaaaaaaattacataaaaagtcagaaccaaatttatcagaactctggaaaatggtcaaagttgagtaacagccaagcaaatgctgaatggagcaaaagacagcataaaaggtagaaattagtaagcattcctcaaaaacattgtaatacaaccaaacaatccacattcacttggtgcaaaatatcagaactgaataaagtaataaatactcaaaagcataaaaggaaaagcagggaacagagtttctttagaaaattggggcactcaaaagcacctatgtgtactaggaatttagaaagtcaagtgcatgcccagggcaggacatacatttagaaaaacactgaggaaaaacagtacagaagtttcccaaaaaattaaaaaataaaacgattatgtaatccagcaatcccactacttggtatacatccaaaggaaatgaaatcagtatgtcaaagaaatacatgtactctcatgtttactgcagcattatttacaataattaagacatggaagcaacctaagtgtccataaaggggtgaatggatatttttaaaaatgcgtcctgtatatacaatgaaatactatccagccttaataaagaaggaaatcctgtcatttgtgacaccatggataagcctggagggcattatgttaagtgaaataagccaggcacaaaaagacacataccgcatgatcttatttatatgtagaatctaaaaaagttgatctcgtggaagaagagagcagaatggtggtttcctgggactcagtagtggggtgagagttggggagatgttggtcaaaggctataaaatttcagctgggtaagaagaataagttcaagatatctgttgtacaacatcatgactatagttaataccaatgcatttttttccttgaaaattcctaacggtagattttgtggtcttaccacatacaaaaatgataaatatgtgaggtaatatgtatgttgattacattaccattccacagtgtatacatatctaaaaacatgttgtacaaaataaatatatacaattttacttgtctatgtaaataaattaaataaagaaagaaaataaaatgtatataataaaagaaaataagaagaaagaacaaacctgagaagaccctcaactttcacctctggctaacagctgggtcagtgcaagctctaagagaaggctaaggcagaattataaacagcctgttaagcattgaaggagtgttccagaactatgctaatctgcaatgattgagagagttttgttttgttttgttttgttttgtttttttgtggtcttttatttcttcatttatttttgggaagggacttgaaatggtacactaaaaaaataaactaaagtcgtttatcagttctaggagcatttgggcagagtcttcagggttttctagtataggatcatattgtcagagaagagagataatttgatttctcccttttctatgccgtttattttgttttctcttgcctgatcgctgtgattagacttccagtactatgctgaataggaatggcgagaatgagcatctttgtcttgttccagctctcaatgggaatgctttcagttgctgctcattcagtatgacattggctgtggattcgtcataggtggccttattattttgaggtatgttccttcaatgaagtttgttgtgggtttttaatcataaaggaatgttggattttatcaaaagctttttccttatagactttagtaaaatttcaagatacaaaatcgatgtacaaaaattagtagcaatttgatacactagtaatattcaagctgagagccaaatcaagaatgcaatcctatttacaatagccacaaaaattaaaatgcctaggaatacatctaaccaagaggtgaaagatctttacaaggagaactacaaaacactgctagaagaaataatagattacacaaacaaatggagaaatattccatgctcacagattagcagaatcagtattgttataattgccagactccccaaggcaatctacagattcagtgctattcttatcaaactaccaatgtcacttttcacacaattagaaaaaactcttctaaaattcatgtggaaccaaaaaggagcccagtcagccaaagccatccctagcaaaaagaacacagtcagaggcatcacattacctgtcttcaaaccacactataagggtatagtaacaaaaacagcatagtactgatacaaaaacagacacatagaccaatgcaacagaatagaggacccagaaataaagccttatacctactgctatctgatcttcgacaaagttgacaaaaacaagcaatgagaaaaggactccctgttcaataaatggtgttgggatagctggctagccacacacaaaggaatgaaactagacccctagccaggcacggtggctcacgcctgtaatcccagcactttggaaggctgaggcgggcagatcacgaggtcaggagattgagaccatcctggctaacatggtgaaatcccgtctctactaaaaatacaaaaattagctgggtgtggtggcaggcacctgtagtcccagctactcgggaggctgaggcaggagaatggcgtgaacccaggaggtggagcttgcagtgagctgagatcacgccactgcactccagcctgggcgacaaggcaagactctgtctcaaaacaaaacaaaacaaaaaaaaactagatccctacatttcaccatatacaaaaattagctcaagaaggattaaagatataaatacaagacttcaaactataagaatcctaaaagaaaacctaggaaacaccattctggacaattggctttgggaaagaatttatgactaagtcctcaaaaacaattgcagcaaaaacaaaaattgacaagtgagacctatttaaactaaagagtttctgcacagcaaaggaaactatcaatagtgtaatgagaaaacatacagagtgggagaaaatgttcacaaacaatccatctgacaaaggtctaatattcagaacctgtaggaaacataaacaaaccaacaagcaaaaaccaaacaaccctattaaaaagtgggcaaagtcatgaacagacacttctcaaaagaagacctctaagtggccaacaagcatatggaaaaatgctcaacattactaagcattagagaaatgcacatcaaaaccacaatgagataccatctcacatcagtcagaatggctattattaaaaagtcaaaaaataacagatgctggtgaggctgcagagaaaagagaatgtttacacactgttggtgggaatgtaaattatcccagccactgtggaaagcaggttggagacttctcaaagaacttaaaatagaattacctttcgatccagtaatcccattactgggtatatagctaaaagaaaataaattattctattgaaaagacatatgcactcatatgttcatcccagtactattcacaatagcaaagacacggaatcaacctagatgtccatcaacaatggacgggataaagaaaatgtggtacatatatatcatggaatactatgcagccataaaaaatgaatcacatcctttgcagccacgtggatgttactggaggccattatcctatgcaaattaatgcaggaacaggaaaccaaatactgcatgttctcacttataagtgggagttaaaaaaatgagtatttgtgaacataaagatggcaaaagtagacactgaagaaagggcggaggaagggaggggtccaagtataacaaatgattgggtactatgctcacaacctgggtgatgggatcaattgtaccccaaacttcagcatcacacaatatacccaggtaagaaaccgcacatgtaccccctgaatctaaaataaaagatgaaataatttaaaaaattaaaaatggactaaacataaaaagaaggtagtaatggaggaaatgagaggggtaaagtataatatagaaagaaaaagtaaaatggcaaaaataagttcttccttaccaatgattactaaatgtaagtgaatttaactccccagtcaaaaagcagagactcctatagagtcatttcagatctaaagatacacataggctgagagtgaaagaatggaaaaacatatttcatacaaataataatgaaaagagatcaaggcagaaatttccccaataatagttggataattcaatattccactttcaataatggataaagcattcatacaggagatcagtaaggacccagagacattgagcaacactaaaaactaaatagacctaacaatatagaacaatacactcaaccagagcagattatatatatattttctcaagagcacacggcatattctccaggatgttaggccacaaaataggtctcagtgaatttaaaaatgttgaaatcacgcaaagcatcttttctgactacaaaaaaaaaaaccaaactaaacaaaactacaaatcaataagagacgaggaactggaagatttacaaatctgtggaattcaacagcacactgttacacatccagcaggtcaaaggagaaatcacaatggaaattataaaatacttagagaggagtgagaataaaagtacaacataccaaaactaatgtgatgtagggaaaggagtgctcaaagggaagtttacaggtgtggacacctacattaaaaagaggaaaaatctcaaattaacataactttacaccttgaagaactaggggaaaagggcaaatgaaactcaaagctagtggaaggaaacaataaagatgagagtagagttcaatgaaattgagatagataaacaatagagagaatcaataaaaacatcagttgattctttgaaaagattaacaaaattgacaaacctttagttagaccagcaaagaaaaccagagaaaacacaaataactaaatccagaaatgaaagtgaggacattacttaccaaccttacagaaataaaaaagattatcagagagaataatgaaaaattattcaccagaaaattaaataaccaaaggcaatggacaaattactacatacgcaaatgaccaaaactgacttaagcagaaaaattgaacaaacctataaatgctaaatgaattgaataaataatcatgaaactctctgtacagggtgacatcagcaagacttttccagctgctgcttgagggtctgacaccagggagttctaatttctggagggatccaaaaaacaggagtaggaatttgcattttttattctctatgcccttttggggcacctccctttatctgcttggctgggaaaccatggtttttcccttgctgaggagacccactcataaggcaaagggctgtatgggcctcttatcatgaacatataaatgaacaaattgtgtgtgtatgtgtgtatgttgtgcatgtgtttgaacaattattaaattcagcacacagtgtctgccctgaaccagcacattacaccagggagtagatactccagggactcccaaaacacccacactttggaagcagaatggtccaaagttgtaaccaaagttgatcatcccgtgtgggatgatcaacactatgtttgaaatgcttgttttttggtgctgtaaagaaatagcacttgaacataaatttaattttctcagcaaggccatttttatactttctgcagaaagggtacactcgccagcagttttgccacaagagtacactgaacaaaggagacagggtcatttataacttgatgcgtccaccttactgctgtgtctggtttctattggctggaacaggacttcacattctgtatttgtcttgattggctaggaacttagaactttttaaaaggggcaaaggcagaggagaacaaaggaaggaggtagtaacttgtggaatgctgagaaaggtaaaaacaccttcaaataaggaagaggaacaggcaatgacctaatgcttgcttggaccagtataagcatgccagggcaaatatttaggctaaattgtgggagctaagaacataaagtacattgatttctttattacggctaacagatatttaaggatgttagcacaggtctttgaataaattttccttctaagagaagttactatttattcctaattagatgaggaggaaagtctttgaagaggaacctctactttacttttcacaattccttctctttttatttcataattcctcttcaaacttgtttaatatgttttgacttaattgctttatttgtctttctaagagaagtaatttttctgaatagggtggaggagagttaggagttaactctgtaagagtggcagagacaaatttttgtataaaactttgaaagcagggaataatagcctacaagaataagcacactaataacaaaagctaacaaggtgagaattgaagttaaaatttatttttatccacttaactaatactttattattttattattattattattatttttattttgttctttatttatttatttttttgagacggggtcttgctctgtcacccaggctggagtgcagtggcacaatcttggctcactgcaagctccgcctcccaggttcacgccattctcctgcctcagcctcccgagtagctgggactacaggtgcccactaccacgccagctaatttttttgcatttttagtggaggcggggtttcaccgtgttagccaggatggtctcgatctcctgacctcgtgatccacccacctcagcctcccaaagtgctgggattacaggcgtaagccaccgctcttggctgttttaatattttagaaaaaggattatttatttttgaatttttggcaagtttattggatagggctgttaatccttgtagcgcttttgttatagttccatcagggcagtattattaggaacaaaggtacaatattgagttttaattatgacacaaacatctcctttttctgctaatattatatttaaagctattttatttttctaggccatctggcttagcttagatatctctttgatgtttagcaatctctttgatgacgtcctcagtgtaatgtatgaattgttgctgattgtagtagatatagtttatttagtctacatttttttttatttaaagttacttaccagaaatacgtggattcaaattgtgcagctgtttgattttgtgctttaaacttatttggcacttctcaaaggaccttaatagcatttatgtaaaactgaggattaaaggattcataaggagtttctcttggcctgtggtgctttgtttttacttttttagattgatgaaatgccagggtgaaggggatagccaattggattagagcacaagtactgctccaattatttggcagagtgtccagtaaaggtgcttcacagtaccaccatacatttgcttggggatggctaagcatggactgatgggcaagctcttggaaaggctcgagctcctcgcatctttgtgtgcttccaaagaacaccaaattttcctcttgccatgagatgcataaagtaaacttggcatttagaggtggaagctggattgccttcaggggcttaccagcagagtgttgaatttcaggaaatagcagagagagcttggcatgatggattatcctaagtaattggattctgaaaaagagccaccatacagtccgtatctggtcgatgaggagaccatctgagtggaaagaggataatctgggcctctggcctaccgtgcatacaagtttaataatcgcttttatttaaagtgtgaacggaatatttaatccactccagctacgcatttgcatcttgatattttgtcttgatggctaagttctgtctgtcttagatctcttatttttacaatagacactctagttttattagatgtaggagcgaccagtgtgggatctagaactgaggctactgaagaaggggaagatgggggtaataatgcccgttttgtagagttagttaaggtggaggtagtgacagagagaaggacagggttacattgataaggctagcagttagaaggggtagtctttttagtgaaatagatgaagggttttagatctgcacaaacctttttcgtggaagtctaactttgctcctgagtagtttaaaggacgtagtcctatttactacaaggttaccaggctgtaggagcagaaaatcagtgtcttggctgcaggtgatcacaacgatgagtgctaggggtaactgtgtcaattagagggccaggatataaatatttgtgtgaaaaggctaactgtcgttgatcttttacatttccacaaggtatgatagagcaagcattaaaggcaatggtctgaggcagacttagttacattaataacaaaggagctagtaacagaataaggaaagaaaaggaagcaatatagaatgtatatgaaaattaagctttctttaacttagtagggcttgatcttagtacagtaacctaagatgttttcttgactcgagtatggtgggtccattctttcttggctgtgcggatggcagtctcagtggttaacagcataaaatagggtccttcctaggctggcgtgaattttttttctatcttttgatgaggatgtgatttttaggctggtgctggtgcactggaaattctaggggtggcacctgtgctaaaagacttttagttctgagggaagggaaagtggaagataaattaagcatatcatttctattgcatatcttggggcttgaggcctcatggtgatgcctcccactccattccttctcagcgccgcccagggtacgtggcggccttgatccctcttaaggtcttggccatcttgtggccttcaccgcccctgcgcgttgtggccttggggatgaggggccttgtgacttacctggccaccttcaggccttaagaaagctaaacaccattttatatttgacaatgctttttgtatgattttatacgagataagttaaattttaccttcatattaatgtgctattaatgttaaacttaattttaataaaatcttgtagacattatttatccaattttaatgtctgactataaggtaagatttttatagactctttttaaccttttataatttttgttaaagagcaggttagtgctttaagaaaaatctattgtgcttttattttaacgttcagttcacagaaaaactggatgatacctctttaactttagccaatatgtttacacacagaatttcctttacaattaacattttaaaacttgcttaaacctttaaaacaagttttttaaccttttaatataggtaaaaatccatattcttatgcctccttataatcctgttattaaaagtatattttatttttcttacatactttgtacataaactgtttttaaaatagttttacattcagaaggcctaattacttttaaattatacaatatttcttgcataaattcctttttataactttccttatgactttcacagacaatcttcaacatgtcttaactttctgccttccttttacactatttcttttcttagtttcaccttctgggtctttctttgatttctgtctcttccagtttctctcttactcttttattctatttctctctctctcatttgcactcttattttcctctctctcatttgcattctatttttctttctctgtctgtcatcctctgtttcttttttcctttctgagttttcctggtcttgcagctggtggggctgggcaaaggcatgggcctcgcccccaagtatgcgctgccatctatttctcctgtttttatttttttctgatttcattttttactttttttttccctttcttcctacacttagtttctcaggctgggtgggatttgcacggctgcagtcctggccctgggccttcaccggccttgaggcttggcagatgcctgccgcaacttgcaagaattgtaccttttcacctcttctgctgtcctcctggcactggtcctcaccctctttttcacacagagctgggctggggagagggacttaactttaggttagttaagttaaggtgcctggctgtctggcaccatgcttgctgtttttgctctctttctctctgaatttcctctcctaatttctttttcctctctgctggtctttcctttgcctctgccagccacctatgctgctgttttcctccctctccttcctcttcctctaggggagccaccggggagaggagcttagcctttttctttcctcgggaagagggggaaggggagttttgaaaaaaaaaaaaaatatatatatatatatatatatatatatatttttttttttttactaccagaggtttgtgtgaggttcaaccccctctcaatggggatttctcacctctttttgaggttcaagcccccctcaatggggatttctcacctctttttgaggttcaacttctacagtggggatttctcacctcttttttgacctccaagacatcctgactaaggaatacttcactgccccctgtcgctttctttccttagtcctgcccaaggaatgctttatcgcccctgcagtttctccctccttggtatgtcctaaccaaggaatgctttaccaccctgcagctttttttttagtcttgactaccaaggaaatagtttactggctctcctggtgtttctttccttggtctgtgcacacagtttcctggtttaggtgatatatgaggatcttttactccaggtcaccggccagtgttttttctttttttgcattgctgagagtccgggtttatttgtcacagtgggtgggtctcgagtccttatccctgaggccactgcaatgaggcagaggagcatgctccttcatgagagaggactggagaccatccccagaggagaatgtatccctgtaccagccaccaaattgtttgaaatgcttgttcttcggtgccataaagaaatagcacctgaacataaatttaattttctcggcaaggccatttttatactttctgcagaaatgttacactcgccagcagttttgccacaggagtacaccgaacaaagaagacaaggtcatttataacttgatgtgtccaccttactactgtgtctagtttctattggttggaacagggcttcacattctgtatttgtcttgattggctagcaatctagaacatttttaaaagaggaaaaggcagaggagaacaaaagaaggagaaagtaacttgtggaatgctgataaaggtaaaaacaccttcaaataacgaagaacaggctgtgacctaatgcttgcttggaccagtataaacatgccagggcaaatatttaggctaaattgtaggagctaagaacataaagtacattgatttctttattatgtctagcagatatttaagaacgttagcacaggtctttgaataaattttgcttctaagagaagttactatttattcctaattagatggggtggaaagtcttcgaagaggaacttctactttacttttcacaactgtatgaaccggttacagaaaagagaaatgttctttagaaagtgacaatccttatggagaaagtggaaaaatcctgaaatttactgccacacatgcatactttcagaaatttgcataattgtagaactcttcttcccatttgatcaccccaccccatctttttgttctttatttactattatttcagagggattcaggaaaacaagagagataaatgcatgaattccactctacactgtgctatggtgccaaattaagtccacttagttggtgaatttaaatggtttaaaacaacagtaaaggggaggagatgtgctgtagaagaaactgcttcagtatcatgaagtgattgatagaaatagtagattaccattccagagactgaagataaatttcatgaacacttctaatggatgacttgggtctggacctaacagaatcattggagtccttcctagagatgacagcaatctttgtttcctacaattcttggttcttccaagatccagcaatagggtgttgatggtttaagacataaagacaatataattcttactttcatctcatttaatcttagaggcatttggccaagctattttagtttaggttctacaaaagcaatgcccccaaaacaaggacttggctacagatagattatcctgtgggtgatcctgccttatttaactggggctcaatccaacacgcatatgcccccaaattgtccaactgggacaatgtgggcagcttggacctggctcccaacccacattggtaaaggtaccccccaaatatttcctcctctctacttctaggctgaacatgcacactgggcaaatgggctctcttggatctgaagactgctctacagcagaaaagcagagagacatgttgggaggacacctaattcaagttaatagagttggctggccagtttacagactctctctctttccctcccttgtcaacttaagaatttgggcaattgattcaaaattcttgcaaaggcagatttgggtaactagggtctattgccaggctctattgataacagagtacatcctcactgagcttcctcctctgggtaccagcaagcttctggtgtcaatggtggggaggtcattatgtgctcaggtccacatctctgatggataaatatattgaatattacccatggatacccagctaaagtcagcagcatgaagagatgaagagttcaaaagaggcaacgactgagaagagctaggatgaaagagaaccagcctacaacagatgggaagtaacccttgttcctggtcattccgtcctctgtgtcccttctgtcagggacctagatacacagcaggcatgcccctgtacccctgcccactacccagtctctacgtgagttggataaggagtactttattctatagtcttggatgaacatcagctagaacaatggaataataatgagaatttaaataactaaattcttcaggatttcttgaatgcctacacatacattatctacttcaacttcataaagcctgaatgaaatgaaaataactttaagataatgaatctcagacacaatggaggaaaagctccagacactggctgaggaggacctaggacctcagcccatttgcaggacactttcctcttctatcagacacccatgctcccctccatctgcagcctcccacacccagggactaaccatcagaaaaacgcctagtatctcttccctcacttgcgaattccgcactaaatgcatctcttcttgccaccttttacttaactggctgcacttgactcagccccctctgctcctactgtctttccaagaaagtcacatctgatggatgtacatttttggggttttggaaaccgttgactgttgccacaacaaggaggtaagatgcgctggcaaaatcctttggcacctgccttgctgtggctgagtggggctgggctgtaatggcaagagatagaggggctctcgttatgggtgaaatctgcatggggctctttgcatactagggcaccagaagttttcttagtgtggcacccaccgccctgaggggtatcactgatgatcaacatccaaagaacctgaggcccaaagcagagatagtagctccaaatctctcattagatggaagactgagattcccatctgattttttttcaaaccagccagagtatttggaacagaaatgcctaacttgcctgttaaaaagtaagagagtgttgatatttaagctctggctggaatttaagactctggctttttcttgaaggctccatatatgaaaaagaaaagtgaaatcagattatgctttttcctcttcccaacaaagccagtatttccaagagtgaaaggctgtctgtccagtactcaggctgcccggtgtggatggctcagtgagagaggggagggtgagaagccattggggccaaaactagggatctcagtgactgagaggagtggacaagtcttcagtcagcagagttggatttgggatgacagaccaggatttctggggtcagtgcaaaggccggtgagagcctcctccttcccttctctgctcagcccctggggtcttcttcctccacaatgagtactggtgaatctgaactcttttctctgcctatgctccactgagggagaccaggcctttgggtcctggggacagagtgagatagaattaaggaatctgctctggaatcactgaaagcgacttgatgtcttcacatcactgccccctgcatcacagctccaaaagggacacattatagtccccaagaattggctggaatactacacaggtttgttaattctctggccatgctcagggaatatactgtctcccggtcacgctcaggtaatcagaagtccagacattctaataaacaagccctagacccttgttgaacttaaatctccctcgccccagctcagtcctaccttggagtgagaaatcagcaggagggacaagaaaagagtcagcttctggtcttttctttcccctacctcctctgctatgagcatctgatgtttgggacccttacaaggtgtctgtgtgggagtggggagggtggtaaagggtagagaagtggggagaggagaggcagtggtgaaaatcaggacaagtctcgcttgtgatatggttgcaatctggctgtaatggcctctggggggtggtgaatgttactgactatcctctagtatgagggaccatgagggaccctctctaatattccttttgggatctttgagataggcaaagccctaatccgcagatttcctctcacctcctcggtctctgcaacaggtgagcccagtatctttcaactgaggtcctgttgactgtgttctgcacactgggctcttccctctagcccttactgttggcctttggtgaaggcacatccacgtgccctttctgcctcctcaatctgacagttgtcctgttctgacctgggcaaggagttgagggggcaaagccaatctcatagctgcataagtggttttgcaacttcttagttctgtaaatctccagaaagcagacatactatcatcttactagcctcatagccaccttgtgctggggcatctcttctcttactttaaacaccctgggggcttatggtccccatttaaaacaaggaaatgagattctctgagaggtgaagcagataaccaaggtcactgctagtataaacatgcatgtgcaagtgtctttttcatataatcacttcttttcctctgggtagacacccagtagtgggattgctgggtcaaatggcagatctacttttagttctttgaggaatctccatactgttttgcataatggttgtactagtttacattcccaccagcagtataaaagtgttccttttcaccacctgcatgccaacatctgtcattttttaatttttaaattatggccattcttaacaggagtaaggtggtatctcattgtgtttttaatttgcatttccctgattactagggatgttgagcatgttttttcatatgtttgttgaccatttgtctatcttcttttgagaactgtctattcatgtcctctgccccactttttgatgggattatttgttttttttcttgctgatttgtatgagttccttgtcgattctggatattggtcctttgtcagatgcatagtttgcaaagattttcccccactctgtggattgtctgtttactctgctgattatttcttttgctgtgcagaagctttttagtttaattaggtcccatttatttatttttgtttttgttgcatttgctttgggatcttagtcatgaattctttgcctatgtcaatgtctagaagaatttttcgaatgttatcttctagaatttttatggtttcaagttagatttcagtctttgatctatcttgagtttattttattattattattctttttgagacggagtctcgctctgtcaccaggcgggagtgcagtggcgcgatctcggctcactgcaacctttgcctcccagattcaagcaattctcctgcctcggcctcctgagtagctaggactacaggcacgcaccaccatgcccagctaattttttgtatttttagtagagacagggtttcaccatgttggccaggatggtctcaatctcttgggctcatgacccgcccgcctcagcctcccaaagtgctgcgattacaggcatgagccaccgcacctggccgagtttatttttgtgtaagatgagagctgaggatccagtttcattattctacatgaattatcacattgatttttcccgcagccttttctgataatgatcaaacagaggaaaagcctgggatttgatccacattgttttccgggcacatggagttctctgatgcaccagcctccacatctgtgctaaggccaggtcttactttgctataagtacctttgtttggggatcaagataattggcatggaattaactatatata

SEQ ID NO: 47 - DNA, 44669 bp, Homo sapiens
cgtgtcagttcatctttctacatttaacatttactgaaggtagcagaagtaacgttttggaagaaaaggatgtttggtaaatcagaacactatttcttgcaataactaaagatcattaataacatttcttccaaacttccccctccccaactccaactccagaaataaccaactagtttgataattactagaagaaaaaaagagaaacaattgtaatatttatacagacataaaggaatggtctggtaaatatggtacaaacaatgaaataaaacacggcaactgagcactatctattatattggtagttaacaaaaagcaaaatacaaaattgcaccttctcaacaccaaaaaaattgcagattttgccattacttttagaatggtaaaaactgcattacttttgcaccaacccaaaacaattatctataataaagtcatgaatatatatattgtcaatttgtcactaataaaattattttggtggtattttgttccatttcttcttacaggggtaattttttctgttatacctcaaatgtaactggcttaaactgatttcttttttcaaccaaatatgtgtctttggaaacaaacattctaatggcatgcctctatacatatctacctagttcaagggaatgcagtttgggagactgtgtgtacatgtgtgcacactcctgtgcgtacatgttaaagtgtaacgtgatccacctgaaatgtacatgcagctgtttatatcatgtagccatccatttcatgataaatatgtttggaaataaatttgtagtactacctcccaacagcaaatcttatttccttttagtttcagtaatagtatttagtattagttgtcactaataaggattatttttaatttgcagatggaaagcttcttcctttccatccataaatcgagtgtttcttctcaaaggcaatggttctcaaactttagtatgcaacagaatcacctgaggagcttttctttttttgagatggagtctcgctctgtcgcccaggctggagggcagtggcgcgatctctgctcactgcaagctccgcctcccgggttcaggccattctcctgcctcaccctcccgagtagctgggactacaggcacccgccaccactcaaaatcctggtccttatctgcaaagattctatttcagtgggcctatgacggagccaagaattctgcatttttaaggcaacttgctgtcctttgagaaacattgcactgaagtatttgggaactttgtttcactgtgatagctgtctgggacttaaatcttccgccaaaggaaaacctggaaaattttgtgattgagcaagcaaatcaagcccatgcgtagtagtagactgggaaccggtgggtgtgagacccaggctctatgtggcctacactcttctgaactcttctgagtcttgattcctggtctgtgaagtgtgcagtgtatccgaattaaatgagaaaatcattccgtgcttttagggtgagtttgaataacttttaggcagtccaccagatggcgatataacttttttttcaaatggagtggttagcctgccgaagttgtgagagtcagtcctacaacattcctagcagatcaagattttatgttcccagttctggcttcagagactgtagcgataacacagggctcatgcagtccaacatcccgtataatacaggttgccagttgttgccttttcagtatttctcctgtgtgatcctggactgcttgtgtcagattcacacaggagcatttgcttacaaatgcagcttccagggccctgcttcagacgtactgaccgagaatctctggaactggttcttcagtatctgctttgcaaaaacaatccgtaagtgctcaacaaacaggttaaagtctgagagccacgtgccagtgaaaaggaggttcacgtcttgctgaagccaccccttattagctgttttgttagaattcctccctcggtgagagtgggattaaggattcagggatgctagttctgccctcttgaggccacactgaagagatcaacttcctttttcttgggaaatgtctgaacattttgaaggtcgctaatcatgacttacctcacctccgcccctatcttctctgggggtggggaagaagtcatactttgcattacaggttggctgtcatcctccttccctttccaggaacactataaccagagactaagagcgaggaccttcactatttcttagctttgtgatcgtgagcaaataacataaactctttgagcctcaatttcctcttctgtaaaatacgagtgaaaataattatacctacttcaaaggattgttatgattattacatggggtgatgaatgcaaagtgaaaaggtaaaatatagcaaaatgtgatctattattaacaataatgagcttcagtttctacatctgtaaaatggtgatgataactactagagcatggggagaattaaatgaggtaatataagtaaggtagttggttaatgtctgacttagaagaggctctcaatagtagtaattataagatggccaataatgtaaaaacaccaatggtctatgcccctaatgatgtgggattttaaaaatcactgaagtaatgagattagcaatttccttactgttatcctgtaggatcagccttagaacaagtataaaacttgtatctcttctatactaagttccttttagaaaatgtttcttaatgaatccacaattatttaataaaacacaaagtattcaatttttaagtattaattcctcacagaaattgctttctaaagttttaagggtgcaaaaaacattaaaaatctttcagtaagctaaaactttaattaggcccttatataattcttgctaaagagagagaatggaactgagactgtgaaatgaaatgacaatgataatatttcctttgaaatttttaaggccaagttgcattaatgcaactttgaaattgttccaatcacacaaggtatttaattaaagcaaatgaaaggctcttcaattcccataaagatttacatggtaggaaaaatgtttctgttttagcaggtctataacatcatttttaaaaattacaaaaattattgtatctacttttaaagctggacagcaatagttatagagagaatcatttaattttagagtcaagcagaccaaattcccatctggctccaccagcgtgttccctttagaaagtaacatttaagagtttcattgcccttgtttgtaaaaaaggggatcatatttgcctccacagtgccgctgaggggtttaaacaaggtgctgaatctagaacacttacagagagcctgtaataagtactcagtgcttaaatgttacctaaaaacaaaggaagatcattagcactaccgtaaaaaattatatatgggtggggcacattggcttgattggtttcgctatatgggtttcaaccaaacgtcttggggaaaaattcggaaggcaataaaaggaaagtggaaaggacaaagaggattggagttggggagggtaagagacagttataagtctgaggaaaaattaggaaatagcatagaattctaattcaaataacttaattacccttgtatttatattttttcttaaagttgttttactttagtgagcagtctttcttctcagattgtgtcttagcatattaatgaaaaaaacagatgataatattactgtacaataagagtttagcagtgattgaaattcagtgtcaatgaagacacagggcaatggagagaaaaatcatagatatgtcatgaaaacagttttagtaatttttcatttcaacaacaaatttcataataatgatataagtacattctttattttatatatatatatgttctttttatagagatggggtctcactgtgttgaccaggctggtcttgaactcctggtctcaagcaatcctcccatcttggcctcccaaagtgctgggattacagatgcgaaccaccatgcctggcctctgaattttaaaatagttatgagtgcctttagaatttctactattggagccctttatgcttctatttaccttcaatcaagatttgcacctcagaaaacatagttacttgttgttgttgttgttgttgttaggaaaagttcagtatgaatgctgttgtctcattctacatagcaattgtttgggtcatgtataataaagaattgatacctactctaaaaatgaagatattttgtgttctaggaattgagtggcacttggtcaaagaatgatttatggaatctctgggcataaggggaattgattgctctttagtttttcttttccacacttagtactaaattattttgaatttatgggaagttaagctaagtgaaccacatctttccattttgttgcaaggagcttatcactttctaaacggagaactatactgtctcggagtaatggattgaatagtggcccccccaaaattatgtccacttcctaaatcgcagaacctgtgaatgttactttgaaaaaaaaagggggtctttgtagatgtcattaagttaaggatctccagatggggaggtgatcctggattatctgagtgggttctaacccagtgacaagagtccttataaaagacacacgaaggactgacacacagagatgagaaagaggcaatgtaaccatggagacagagactggagtgatgtgccacaaatcaaggcaagtttgtagccaccagaagacggaagaggtaagaagtacatcatcccctggcctccagaggagtgtggccctgctaacactctgattttggactcctggcatccaactgcgtgagtataaatttctgttgttttaagccaccaagtttgtggtcatttgttacagcggccacaggaagctaatacacagggtaagctgataggggaatgagagagttttttcacagttgcatgaatgggttaagaattctaaagaataattagccaggtgtggtggtggatgcctgtaatcccagctactcgagaggctgggaggcaggagaatcactggaacccgagaggcggaggttgcagtgagccaagatggcgccactacactctagcctgggcgacagagggcgactctgtctcaaaaaaaaaaaaaaaaagttatttgaaagaataaacattattgggtaaggggagatgacatggtagccattagaaagaggggtggggggagtgaggaaaaaaggcaaaaaacagagaccaggaaggtgaataaccagaatgtgagctaaggagatggaataggaaggacactgtacccaggcagagtatggactgaggagaaaaataaatgatatccctaaatatgttttaatttcagggagttactttgtcttctcatattttactcagatcgctttgtgtgtgtgtgcgtgcgtgtgtgtgtgtgtgtgtgtgtgatgaaatacatattttaattaaatattttacctcagaaacagcctctcagagaatgtttttggataaaatgcaatgttttggtaatattctcttcagaaacattaagttaggatgttagggtgatggaaaaacctcaataaaaaccagtagcttaagtatggagacactcagaactcagtcatcacattgggaagaaaatgagatagtggaaaagaagaaaaagtcacccaggaaagagcccgagaaaacttctaagagtcggagtttttcactgatgcttaccaaagcttagctgtatggaataatggaggaatacatccttttaactttagtcaagctttttaaattctgaaaaggggactctttcacttagagtgctgcagtacaaggaaagcaattgtttggagaaaataggctatgcattctgaaaaaaaatatttctttttggcaagggctatggattcctgtcaatctaaagggatctctaaacttagggagagggtaggaagtagctctgccctctgagaggctctattttattctgaaaggccgaatgtgacaaaagcagctttaatgatcagacagagctgaggtatccaaagctacatataaaatagaagcttaggacacctgaaaaaacagacaagaattaacacaatagcaaacaaaatggcagactcaatcactgcacctggccgaaatatttctatgaagtcagagtttagctgggtaccagagcaattttctccctaaaattgggtaatgaaaatttgaacagaagaggtggtatgtgctgattaattttatgtgttaacttgactgggctgaaggatgcccagatagctggtaaaacattatttctggatgtatctgtgaagatgtttccagaagaggttagtatttgaattggtaggctgagtaaagtagattactctcaccaatgtggtggttagagagtccatcaaccaacccagtgaggactcgaatagaagaaaaaggtggaggaaaggcaaatttgttctcttttcttgagctggcacatccatcttctcccatccttggatgacagaatttctggttctctgatcttcacacttgggctaaattacccactggctttccaaattctccaacttgcagatagcaggttgcagagcttctcagcctctgtaatcacatgagctaattcccataattaatctctgtctctgtctctctctttttctttcacttaataaatatggagatttattgaagaaccaagaggatataccactggttctgtttctctggtgaatcttaatacataaggttaaaatagattaacattagaagcgaaaagtgaaaatgcctcaaaatatattttaaaacttctacttcaaactatagaaaacacgatttcttggtcatcaaatcatggaagaacatctcattcttggaatatgttgaggtatatgagaaatcttctcattgcttctcagaattcttagcacctgcaaaaccattattttgtttatataatcttacagaaatgttacccaactactagattcacgtgaaataattttttcttttgatagaaaaccagcgaggtcagtaatttctgtcgggagaaagagcaggagaaacaattctccttacatgaattcttaggtgtccagttgaaaacattccagaagagggggtggaccatggatggtgggaagcacaaacttcagagccagatccccaaagtttggtgaaaaggccaggaaaagcaccaaataaacacacagccatgcagcccttaacaagtctactttgtaaaagcaattttgttaatctctttcttcaggaaacactttttcttgtggcggtatttactttgttaaacgaagaaagttccctgccttctctctctccagttagggctaaaacctggacactgacagagctaatgtatgtttgatctaatcagtcaagatcaagtgggggaaagcaataaaaataaatttcaaaatgttctctatcaaaaatttttcaagaaaaatgttctaattaagaatctccctcaagtatgtttctgtacaattggaccagtgaactgggactggaagtgtcaagagggttgtagaaatgaaagtattgcctcattttctgatttttgttcccacctacaggagctcccacagtgttctactctttccattttagggagaagatgtagagcagtacaacttttttccctctatgacatgtcccagacctttccgaactctttagtgcctctgattattagtaaacaattcaagcttactgatggagactgtaactttgatgtcatttttcttctccttggtttacagccaggaatcattgcatgtcttccaggtattggcaggaacacatacatttcccaagcatataggtgggattagtataaaataaacttatgaggcctttcatattttatgttgcctcagaccaggtaagttttgtcttaattttctgattatcctgagatgtttctccatttactccattgaatctacttgactctgagttctttttttctttattcttctctattcttattctttttttttaaattcttgatggtgataatatctcttcgcttcaagtgataatgttcattccttaccctgttagatatttttaatataattcttataaacttcttaattttctcaaaggcccatgcctctatgataatgatcagcacttgtttaatttgaaaatgtcaggcatatgtaagaggttcaattgcccaggagctcataactccttactcattcattaaaaacaaatcatcgggatgctcctgctctaatgtttagagcctttcttttaacaaatggcctcttaattttcatggtagaaaagacttttttttccttctgtgatacagaacagttttcaattatttagtcgtcatgagctgaagcagggtagccgtagatatgctagactatttttctacaataaccccagcatgtcctttatttaggagaaattttgactgatggtggaaagaaatttaaagtactcctgcattaaatgaagttatgattcatactaacagtgaaaatgattatttgaatctcagaaggcatacatttctaaaacaatgtttgttttgattatcttctaagagaatatcgagatttacaaaatttattctttctttcatttcattgtatcatccttttcctatgtgaacaatctcacatggcttttccttctttcagagtggatttggtattttttctctttcatttgtatgctttccatttactttgtatttaaagacaatctcaaacttgtaaaaagttacaagtacagtaaaagaactttcttttgaaattttttgagtgtagttgctaacatgctcattcaacttacctgactacttctatgtattccactacaaacaagaatgtttcctacaaacattcttctacataaccatattaccatcaaagtcagcaaattaacagtgataggttactaccatataatcctcaaattctttcaagtttcctcaattttctcaatgatgtccttcatagcaaagggatccagttcagcgtcatgtgtttcattttgttgtcatatctgtttggttttcttcaatgtggaacagttccctagtctttcttggcctttatgaccttaacacttttgaagattacaggccaattattttgtagaatagctctcaatttgagttcacctaatgttttcttatgaatagatttaggtttgcatctttgataggaatatcatagcaatggtgacaattttgattcacctcattactggtgatgttaactttggtcactgattggtgtctgctagacttctccactgtaaagttactctttcttccctttgtaattaataaatattttgtaaggtggtactttgagactatgcaaatatcctgttcctcatcagactttcaatttgtccattcatttatttatttcagtgtggactcatgggttcctattttattcagtaggttaaaaccagttgctttcattatttagtttgatgctcagtgtgggggttcaataaggctggtgggaaaaatattaaagatagttatagtaatagccacaaactctcttggaaggcctgagagtttgtataacatcagtaatagatctggctgaaggcggcctggtccctttacctttagttaaataagttaaagtagtaactaaggaatgtggggaagttatctagctagcttgtttactcatgtggtcttaagactaacctttgatgtacggcaggtgcttaattgctttctacttgggaattccacagtgtcaattaccctctagtggtgttgactcaagcctttgtcaattaatcttccccaaataaatgtgagtctcactagctggtcagggccacagtcacaactgtttacagtactctccagggagtctgtaagtggcttggacactcagctggactggcaaagcagaatatctgtgtgtcagtgtacttcattcatccatggctggctcagggtctgcgggtcagaccgccccaagtgagaactctttcaagagtctttttgatatgttctcataagtctttcagtgcttctttacttcctggcaaagatgtcccaggctcatcttatagtttccctgccctagacttgggatcagccatttctccaaggagacttggatcctgttttggagtatggtcttcagaaaagatgtcagaaccaggtgtgctcattgttactgagggcttgttacttcctgttttcaatggacagagctagttaatatatatatatacttatatacatacataagcacatttttacacctatacttctatatccctattgaaaaccatgggttcactttgatatctccaattccaatctaacagcacagggctcattcatgttttctctccttctatatttgaaacttccttctccaatagtgagaagtcttgatatatttttgatcaagccttctgtatgtcaccagtctgtcattgctgctgcatcccacactccctgtgcaatgctttccctacctgcttgggcttcaatatcccacaccaggcttctcctctcgttgatgttcttcttgctctacttgagctccattacccctaactagtccagcatcctcaccttgcctgggctttagcactctgatttgggtaaccacaggattccccctatccttgccatattcatttctcttgccacttagtggcctttggattgatctgaacaaggaaaggataaaagagaagttatcattttattttcaagttagtatttgctgagtactatttatcaagctctgtattatctcattttagtgacataatgaacttgattacattttactaattgaagcagtcaagatgaaagaagttgtcacttgccagactccacagccagtaagtggcagatccaggactggatgttgtcttgctgactataaaccaatgttccacttggaagctgtgtatgtgtgattcatagaaaaagtggttaattttcaaaggcaataatcatagaattggtagtgtataaattttttggggatataattgtcagatgtctcaattacaagcccaagatagatgaggcagtattaatttgctaattacatattttgaaaagattgtacataaagaaaatgttttctctttaattacggcattaaggatttcaaaaggtactttataatttataccatttcatttcataattttatttcttttctctgtgttttaaagcatgttctaagggttaaacttttaaactttaaactacacagtgaatcactttcttttcttttctttttttttatttttttgagatggagactcagtctgtctcccaggctggagtgcaatggtgcaatctcagctcactgtgacctttgcctcccaggttcaagcgattctcctgtctcagcctcctgagtagctgggattacaaacatgctccactacacctggctaatttttgtatttttagtagagacagcgtttcacagtcttggtcaggctggtctcgaactcctgacctcaggtgatccacccgccttggccttccaaaatgctgggattacaggcatgagccaccgcgcctggcctgtgaatcactttcaataagcctttccataatttagaaaaagacatataagaaggaagatttcttacgctgtttgccttttgttaaataatggtgacccagtttctaaaaggaaccagtttctaaaaggaaaacctgagtaattacttagaagaggctggctttctaaacttagttaacagctattattatttaattgtcagttttacagtaacttggtaagtttcctgcttaatctaactactctaaattgtactaaaaaacctaccctgttccctgcattgtatttttcatgtctttacaagcttgcactgaggccttaccttcctacattattggccagcttatgtaatgcccatgccaggcaaccaccatttgctttctacaaggtgtctcatttaaatttcagaactacattcttattctgtagttccattgttactccaattttataggtgaaaaaactgaaactcagtggggtaaagtaacttgaccaaaatcacatttctaggataacaatggcttcttctgcaataccttctgaaggacctacctgaggctgttttacagttaacttttttaaataagataaatagttgggacttaattaaactaaagggcttttgcatggcaaaaggaacagtcagcagggtaaacagacaacccacagagtgggagaaaatcttcacaatctatacatctgacaaaggactaatatccggaatctacaacaaactcaaacaaaccagtaagaaaaaaaaatcccatcaaaaagtgggcaaaggacatgaatagacaattctcaaaagaagatatacaaatggtcaatgaacatacatgaaaaaatgctcagcatcactaatgatcagggaaatgcaaatcaaaaccacaatgtgataccaccttactcctgcaagaatggccataatcaaaatattaaaaaatggccaggcatggtggcttatgcctgtaatcccagcactttgggaggccgaggcagatcacctgaggtcgggagtttgagaccagcctggccaacatggtgaaaccctgtctctactgcaaatacaaaaattagcctggcgtggtggcaggtgcctgtaatcccagctactcgggaggctgagggaggagaatcatatgaacctgggaggccaaggttgcggtgagccgagatcgtgctattgcactacagcctgggggacaagagcgagacttcgtctcaaaaaaaaaaaaaattaaaaaacagtagatgttggcatggatgtggtgatcagggaacacttccacactgctggtgggaatgtaaactagcacagccactatggaaaacaccgtggagattccttaaagaactaaaagtagaactaccatttaatccagcaatcacactactgggtatctatccagaggaattgaagtcattatatgaaaaagatacttgcacatgcatgtttgtaacagtacaatttgcaattgtgaaatcatggaactaacccaaatgcccgtcaatgagtggaaaaagaaactgtgtgtgtgtgtgtgtgtgtgtgtgtgtgtgtgtatatatatatatatatatatatatatatatatatatatatatatatgatggaatactactcagccataaaaaggaatgaattaatggcatttgcagtgacctggatgtgattggagactattattctaagtgatgtaactcaggaatggaaaaccaaacatcatatgttctcactgatatgtgagagctaagctatgaagacgcaaaggcataagaatgatacaatggactttggggacttggggggaagggtgtgaggggagtgagggataaaagactacaaatagggtacagcatatactgcttgggttatgagtgctccaaaatctcacaaatcaccactaaagaacttactgatataactaaataccacctgtactccaataacttatggaaaaacaaaatatttttttttttgagatgcagtctcactctgtcgcccaggctggagtgcagtggtgtgatattggctcactgcaagctctgcctcccaggttcacaccattctcctgcctcagcctcccaagtagctgggactacaggcgcccaccaccatgcctggctaattttttgcatttttagtagagatggggtttcactgtgttagtcaggatggtcttgatctcccggcctcatgattcacatgccttggcctcccaaagtgctgacattacaggcgtgagccaccgtgcccggcccaaaaaaattttttaaaaaaagatcagtaagatcttatacaaaaatagtggacatgaaaacactataaatcaattgaacataaaagatgtatacagaacgctctaccccaaaacaacataatatacatttttatcaaagcacatagaacattccccaggacagaccatatgttaagtcacaaaataattttaataaatttttaaaggattaaaatcatacaaagtattttatctgaccacaaggaatgaaattagaagtaaaaaatagaaagaaattggaaaatttgcaaatacataaaaattaaacagcacattttacaacaaccaatatgttaaacaagaaatcgcaagataaattagaaaatacttagagatgaatgaaaataaaaatacaaactaataaaacttatagggtgcagttaatgcagtactcagagggaaattatagctgtaaacccatacattaaaaaatgaagatggatctcaagttaataatataacttataatgtaacttaaagaactaaaaaaagaacaaactaaagcaaacctaacagaaggaaggaaataattaagattagattagtgataaataaaatagagaatagaaaagcaattgagggagttaatggaaacaaaagttggctctttgaaaagatcaacaaaattgacaaacttttaaagctggaccaattttaaaaagagagaagactcaagttactaaaataagaagttaaatgaaggcattttcctggacacacaaaaagaaaatggattaaaagagaatactatggacaattgtataccaacacattagaaaacctggatgaaatgggcaagaaacacacaaaccctgaaatctgactcaagaagaaatggaaaatctgaacatatctgtaaaagtggatatgtttacaccttctaaacactttacttcttctaaaaagacagaatcagtaatcagaagcctcccgacaaagaaaagcccaagaccagatggtctcattggtgatttctgcctaacatttgcagaagaatgaacaccaatccctttcaaactcttcaagagatagaaggggagaaaacactttctaaccgattttttgaggccaacattaccctgatatgaaagccagacaaagacacctcaagacaagaaaaccacaaaccaacattccctatgaaaacatatgcaaaaatagtcaatgtatactagtaaaccaaatcaagtaacataccaaaaaggctatacactatgattaagttgaatatatcacaggaatacaagggtggctcaccttatggacattattcaatgtaatacaccaccgtaacaagatgaaggtgaaaatgaatgaccatcttgatttatgcaaagtatttgacaatcacaagaatgacaagaatactcaacaaattagaaatagaatggaacttacttaacatgatgtagagacctaattagagaaaaggagtcaggctggcaggaccaagggaaagcaaaaagatagaacaaataaactataaatatggctttcttcatagttatataaacaaaagaggaattaaatgaattataggtctgtttttctttatggcccaagacatatagccctcctgaacaaataaaatacataacttacaaacttcctgcttgccataaaatgcctcaatttatcaaacatcctggctgacagaagaatgcaagtttccaagttccatcctataaaatctccagcaagcctttgtttctttgcagtcagctcctcttctgctggcttgcacattgcctcctcacaacatgttttcatactttctttaataaatctgcctttctttacctacaattgtcttggtaaattcttttatctctacaccaccaacccagatagtcatcactcacctacaacacatgataaacggcatttagggaaaacacatagctacatcatactccatgaagaatgaataaaagctttcccctaagtataggaaaaatacacgatgcctgcttttgtcccttctattcagtactgaaagttctggctagaacaattatgcaagaaaaaaacaaacgaataaaacagatccaaattataaaggaaggagtaaaactatttgcagatcatatgatcctatagataggaaatcttaaaagatatacacacacaaactattagagctaataaattcaggaaagtattgagtatataactagcacttaaaacttagttttgtcaacatgctgttcgctatgttaaaaaaaaagattagttttgtttctactcatagcaatgaataatccaaaactaaattaagaaaataatttcagaagggtggagcaagatggcacaatagaaaactccactgattgtccctcaatgctagcacaccaagctgtctacacagacaaaacaccttcataagaatgaaaaatcaagtgaccactcatagtacctggttttaaattcatattgctgaaagaagcactgaagaggttaaaaaaaaaaaaaagccctgaatcgcagacaccacccctcccttacccctggcagcagcagtgggcatctctgggtactgggggagggagaacacaccaactgtgaagcattgaaagtgctgttctattagagcagaaaggaaacccagaccaaactcaactgacctgcctgcaaagggagggacccagtgatctaaacttgagttcctgcaaacctcaccaccacgggctacagcaccgtgtgtctccaagtaaacttgaaaggcagtctaggcgataaggattgcaacttgtaggtgagtcctggggctgaattaggcccagagacagtggactagggggacacgtgacatactgagacaccggccgggtcagctaaggaagtactggcatcacccttcccctaaccccaggctgcacagcttgtggcttcaaagagaacccctgtcttctgtttgaggagaacagagggaagagtagggagaactttgtcttgcatctaggatcccagcccagccacagcaggatagggcactggtcagaattgtgaggcccctattccaggccctggttcccagacaacttttctagatatgctctgggccagaagataactggcagccttgaaggaaaggacccagtactgctaccattaatcacttgctaatcaaagagcccttgtgccctaaaaaaccagcagcaatatctaggtactacatccagggccttgggtgaacttctgagatttgatgacttcaggtgagactcaggacataaccagctatggtggctatgtgaccaaactccttccacttgagaaaagcagagggaaaagtaaagaagactttgtcttacatcttagatactagtatggtcacagttgtgtagagcaccaagcaggctcttggggtcctcaatcccaggacttgactcttggatgacatttctggacctgccctgggccagagcggtacccactgccctgaaagatgagtccctggccaggcagcattcaccacaagcttgcttaaaataccttgggccttaacagaacaccgtggtagtctggcagtattcttcatggcctggggtggcagtagctatggtgaggctcctcttcctttggaaaggggagggaagagtgggaagaaatgcattgtgtggtttgagtgccagctcagctgaatgcaacagaacaccatgtagacttctaaggtttttgactctagtccctgactcccaggtggcacttctgaacccacctggggcttgggggaccttgctgctctgaagagaaggacacaggcctgactggctttaccacctgctgattgtagagccccagggccttgagtaaacataagaagtagccagggaaaagttacagtgggccttgggcaagaaccagctctgttctggcttcaggtttgacccggtgcagtcatagtggtggtggccacaggggtgcttgtgtcactccgtccaaatctttaggtggctcagaacagagagagagactctgtatgtttgagataaagtaagggaagggaacaagggtctctgccttgttcccttttctagaattttctctagccagaaaattctcctagatcttgttcaagattagcaagatggtacctctgcaatactgcaagaaccacagcattactgggcttgggttgcccactaaagcagatacagcttagatcacaaaacccaagtcctttcaaatatctgaaaagccttcgcaagaaggatggctacaaataagcttagacagtgaagactacaataaatacctaatcattcaatgcaagactttgaagaacatctactagcatcgatgccatccaggaaaatgtgacctaaccaaataaggcactaggaccaatcctggagaaacatatatgtgacctttcagacagagaattcaaaatagctatgttgaagaaactcaaagaaattcaagataacaccaagaaggaattcagaattctatcagataaatttaacaaagagattgaaataattaaaaagaaccaagcagaaattctggagttgaaaaatgcaaactactaaagaatacattaaagtcctttaatggcagaattgaacaagcagaagaaagaattagtgagcttgaagacaggctaattgaaaacacatagaggagacaaaacaagattctaaaagcagcaggataaaagaaagaaataacatacaatggagctccaatacatatggcagcaggcttttaagtggaaaccttagaggccaggagaaagaggcatgacatatttaacgtgatgaaggaagaaaactttcagcctagaatagtattatccagtgaaaatgtccttcaaacatgaagaataaagactttcccagacaaacaaaagctgaggaatttcatcaataccagacttctcctacaagaaatgctaaagggagtacttcaatccaaaagaaaaggaagttaaaaagcaataagtaatcacctgaaggtaccaaacccatggataatagtaagtacacagaaacacagaatattataacactgtaactgtggtgtgtaaactacccttatcctaagtagaaagactaaatgatgaactaaagactaaagaaatcaataaaaaataacaactacaataactcttcaagacatagtcaatacaaggtataaatagagacaaaaaaactgttaaaaagcaggtggatgaagttaaggcatagagttcgtattagttttctttttgcttatttgtgtatacaaatagtgttaagttgttatcacattaaaataatgggttataagatagtatttgttggccgggcacagtggctcatgcctgtaatcccagcactttgggaggccaaggcaggcagatcacaaggtcaggagattaagaccatcccggctaacacggtgaaacctcgtctctgctaaaaatacaaaaaattagccaggtgtggtggcatatgcctgtagttccagctactcgggaggctgaggcaggagaatcgcttgaacccaggaggcagaggttgcagtgagccaagattgagccactgcactccagcctgggtgacagagtgagactccacctcaaaaaaaaaaaaaaaaatagtatttgtgaccttcatggtaatctcaaaccaaaaaaacatgcaatggatgcacaaaaaataaaaagcaagaaactaagtcttatcaccagagaaaatcaccttcactagaggaagacaggaaggaaagaaagaaggaagaaatgaccacaaaacaactaggaaacaaataacaaaatagcaggagtaagtattcacttcttaatgacaacattgaatgtaaatggactaaactctccaatcgaaagacatagactggctgaatgaataaaaaaaaagatctattgatctgctgcctataagaaacacacttcacctataaagacacacataggctgaaaataaagggacagaaaaagatatttcatgccaatggaaaccaaaaaagagcaggagtcactatatttgtatcagatgaaatagattttaatcaaaaactataagaagagacaaagaggttactatgtaacaataaagtggtgtattagtccgttttcatgttgctgataaggacatacctgagactgggaagaaaaagaggtttaattggatttacagttccacatggctaaggagccctcagaatcatggtgggaggtgaaagacacttcttacatggtggcagcaagagaaaaatgaggaagaaacaaaagcagaaacccctgataaacccatcagatctcatgagacttatccattatcatgagaatagcatgggaaagactggcccccatgattcaattacctcccccgggtctctcccacaacatgtgggaattctgggagatacaattcaaattgagatttgggtggggacacagccaaaccatataattccacccctggcccctccaaatctcacatcctaacatttcaaaaccaatcataccttcccaacagtcccctaaagtcttaactcatttcagcattaacccaaaagtccacagtcggaagactcatctgagacatggcaagtcccttccaccaatgagcctgtaaaatcacaagcaagctttacttcctggatacaatgggggtattgggtaaatacagccattccaaatgggagaagttggccaaaacaaaggggttacggggcccatgaagtctgaaatccagagaggcagtcaaattgtaaagctccaaaatgatctcctttgactccaggtctcacatccaggttacgctgatgcaagagatgggttcccatggtcttggacagctctgcccctgtggctttgcagggtagagccttccttcaggctgctttcatgggctggcattgagtgtctgaggcttttccaggtgcacggtgcaagctgtcggttgatctaccattctgggttctggagaacagtggccctcttcttacacctccactaggcagtgccccagtagagactgtgtgtgggggctccaaccccacatttcccttctgcactgccctagcagaggttctccatgagggccctacccctgtagcacacttttgcctgtgcatccaggtgtttccattcatcttctgaaatctaggtggaggttcccaaacctcaattcttgacttctgtgcacccacatgctcaacaccatgtggaagctgcctaggcttggggcttccaccctctgaagccacagcccgagctgtatattggcccctttaagccacagctagagcagctgggacaagtggaccaagtccctaggctgcacacaacctggagaccctgggcctggcccatgaaaccattatttcttcctgggcctctgggcctgtgatgggaggggcgccatgaaggtctctgacatggcctggagacattttccccatggtcttggggattaacattagactccctgatacttatgcaaatttctgcagccagcttgaatttctccccagaaaaatgggtttttcttttctatcacttagtcaggctgcaaattttccaaacattaatgctcttctttctttataaatctgaatgtctttaacggtacccaagttaccgcttgaaggctttgctgcttagaaatttcttctaccagttaccctaaatcatccttctcaagttaaagttccacaaatctctagggcagaggcaaaatgctgccagtctctttgctaaaacataacaagagtcacctttgctccagttctcaaaaagttcctcagctccatatgagaccacctcagcctggacctcatagtccatatcattatcagcattttaggcaaagccattcaacaagtctctaggaagtttcaaactttcccacattctcctatcttcttttgagccctccaaactgttccaacctctgtctgtaatcccagcacgggcaaatttcttactgtctgtgagactcacttaaaattataataggtgtacccaactaataaacgaagtcatttgatcttatgagtaagcaatgatatggggagagctcaacttctcttttgcttctttttcataaccactctttgttgtctatgctggacatatatttagcatgaagaaggatatccagtagtcctttcttatccacagggaatatgttgcaaaacctccagtggatgcttcaaactttggatagtactgaactcaatcgttgtcaattggaacattttctgtcgatgtcttccacccgcaaatttaatgccttttccatcttaactaagcacttatcacacactgtggatgtaacttttacagtttgagatgtgagcaaaactagcaaaattttttttccttcagcgtttaatggatagaagattcattcttactgtagatattagcaacctagtatatgacttttccccttattaagtcaagaattttcaccttttcacttaaaggaagcactttacaacttctctttggtgtatctgaattgccagcatcactcttcttgaactttggggccattattaagtaaagtaagagttacttgaatataagcgtgtggtattatgatacatctgataatgaaggcagctactaagtgactaacaggcaggtactgtctatagtgtggatatcctgaacaaaggaataatttacgtcctgagtgggatgaagtggtgcaagatttaatcacccaattcagaatgatgtgcaattcaaaatttatgaattgtttatttctggaattttccatttattattttcagattgcagttggctgtggataaccgaaactgcagaaagtgaagctgtggataagggacggacaacagtgcatcacattaacagaatgaaaaacaaaaaccatataatcatcttggtacatgcagaaaaaacatttgataaaattcaacctccctttatgatttaaaaaaccaacaaattaagtatacaaagaatataactcaaggaaataaagtccatatatgaaaaacctacagctaacatcatattcaatgttgaaaagctgaaagttttttctcagtatcagaaacaagacaaagatgcccactcttaactcttctattcaacatattcctgcaagttcctagccagaccaattaggaaaaaaaaagtcatgtaaataacatttgacccagccatccccttattgggtatatacccaaaggaatataaatcatgctgctgtaaagacacctgcacacatatgtttattgcggcactactcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacactgcatgttctcactcataggtgggaactgaacaatgagaacacttggacacaggaaggggaacatcacacactggggcctgttgtggggtggggggaggggggagggatagcattaggagatatacccaatgtaaatgacaagttaatgggtgcagcacaccaacatggcacatatgtacacatgtaacaaacctgcatgttgtgtacatgtaccctagaacttagagtataattatatatatatatatatatataaagaaaagtaagaagtgaaattgtctctctttgctgatggcatgatcttctatatacaaaaccctaaagactccaccaaaaaactggtagaattagtaaacaaattcagtaaagttgtaggatacaaaatcaacacagaaaaattaggagcatttctatatactaacagtgacctatctgaaaaggaaatttaaaaaaattccatttacagtagtatcaaaagaataaaaacaattttatttaaaatttagaagtaaattttttaaaatttaggaataaatttaataatttaataatagaagataaaacttagaaataaatctaactaagagggtgaaatatctgtacactggaaattatgaaacattgatgaaagaaattgaaaagacacaaataaatggaaacatataccagttcacgggttggaagaattaatattgttaaaatgtccatactacccaaagtgatctacagattcaatgcaatctctacaaaatttcaatgttatttttcacattagaggtagaaacaatccaaaaatttatatgaaactaccaaagacactgcctgaatagccaaagcaatcttgaacagaaagaacaacatttgaggcattatgctacctgacttcaaaatatattacaaagctatagtaattaaaacagcatagtattgtcacacagacagacacacaaaccaatgagacagaataaataatagaattaaacccatgcatttatggtcacttgatttttgacaaaggtatcaagaaaatacaatggggataagacactcttcaataaatggtgttggaaaaactggatatccacatgcagaataatgaaattggacatttatctcacaccctgtatgcaaatcaactgaaattagattaaatacttaaatgtaagacccgaaactgtaatagtcccagaagaaaacataggggaaacgctccatgactttgttctgggcaatgattttttagatataacccctaaagcacaggcaacagaaacaaaaatacacaaatgggactgtatcaaactaaaaagcttctgcacagcataggaagcaagtaatagagtaaagagataacctacagaatggaagaaaatatttgcaacatacatctgaaaaggggttaatatccaaaatatataaagtactcaaagttcaataataagaaaataagtaatccaattttaaaagggcccaaatagatgtttctcaaaagaagacatataattgggcaacaggtatatgaaaaaatgttcaacatcaataattatcagcaaaatgcaaaataaaaccaaaatgagacaccatctcaaatctgttaggatggttattataaaaaagacaagaggtaacaagttttggtgaggatgtgaacaaaaaaccccttgtatgctgctggtgggaatgtaaattagtacagccattatggaagacaccatggaggttcctcagaaaactatatgatccagcaatcccacttctgggcatatccaaaggaactgaaatcaggatcaaagaaacatctgcactcccatgttcatttcagcattattcacaatagccaagctatggaagcaacccaagtgtccatcagtagatgaatgtataaagaaaccatggtatgcatacccaatggaatactatttggccagaagaaagaatgaaatcaagtcatctgcagcaacatggatggaactgaaggttatcatgttaagtgaaataagccagactcagaaagacaactattgcatgacctcacctatatatggaatataaaaaaataaaactcatgaaagtaaagagtagaatagaagtcaccagaggatgaggggaaatacggagtcgttcatcaaaaggtacaaaatttctgttagacaggaagaacaagttttgaagatctattgcacagcacaatgaccatagttaataatgtaatgtatatttcaaaattgctaagagagattttatgagctcataccacaaatgttaaatatgtgatgaatatgttaattttagcttgatttaattattccataatgtatacacatatcaaaacatcactttgtatgtcataaatatataccattgttttttgtcaagtatttataaaaaaacttgtcatgttaaaaaaggcacatgcataccttcaaactagaaaaattctacttattgtttctggcttagaaaaataatcatagatgtatgtaaagattcatatgtaataatgttcatcttaatatttttatacacaatgaaaagttgaatataagctaaatgtttaattgtagctactaaaaattaggttttagaagaatattcaatgatatacaaaataaacattacattaaaaagaaaaaagaattgaaagtaaagtgatggaaacattaacaattaaaaattaatcaagtgaaaacttttatagctataataatactaaattggtctttgaggaagcactactagtaatgaataaattactttaataaaattatcaattaaaagtaatggccagaaattctaattttatgtaaaattaatttcatggcttcaaatgtatatataatgggataagatgacagaagtataattaaaaaacaaaagaaatccaggtacatagttggaaatcttaacacaattctctcaacaataaatagaagatagaagagttaaaaacatttatatatttattcatgaacaacatgaataatggacttaagaaactcatatgtaatgataattgaatttaagtaacatatataacactacactctcagcctaaaaaacacatatttctttcaagtttacatgcaacagatatctgaaaagaccataaactgggccattataatgatattgggaaaaaagcttctaagtttggaaattatgcaatatactgcaaaataatgccaaagaaaattacgatgaatatttaaaaatagttcatatttaatgatgattaaaatataatatgttaaatttgtggaatgcagctaaaggtgtgctcagtagaaatgtgaagctctaaatacatttgaaaggaaaaaaaattacataaaaagtcagaaccaaatttatcagaactctggaaaatggtcaaagttgagtaacagccaagcaaatgctgaatggagcaaaagacagcataaaaggtagaaattagtaagcattcctcaaaaacattgtaatacaaccaaacaatccacattcacttggtgcaaaatatcagaactgaataaagtaataaatactcaaaagcataaaaggaaaagcagggaacagagtttctttagaaaattggggcactcaaaagcacctatgtgtactaggaatttagaaagtcaagtgcatgcccagggcaggacatacatttagaaaaacactgaggaaaaacagtacagaagtttcccaaaaaattaaaaaataaaacgattatgtaatccagcaatcccactacttggtatacatccaaaggaaatgaaatcagtatgtcaaagaaatacatgtactctcatgtttactgcagcattatttacaataattaagacatggaagcaacctaagtgtccataaaggggtgaatggatatttttaaaaatgcgtcctgtatatacaatgaaatactatccagccttaataaagaaggaaatcctgtcatttgtgacaccatggataagcctggagggcattatgttaagtgaaataagccaggcacaaaaagacacataccgcatgatcttatttatatgtagaatctaaaaaagttgatctcgtggaagaagagagcagaatggtggtttcctgggactcagtagtggggtgagagttggggagatgttggtcaaaggctataaaatttcagctgggtaagaagaataagttcaagatatctgttgtacaacatcatgactatagttaataccaatgcatttttttccttgaaaattcctaacggtagattttgtggtcttaccacatacaaaaatgataaatatgtgaggtaatatgtatgttgattacattaccattccacagtgtatacatatctaaaaacatgttgtacaaaataaatatatacaattttacttgtctatgtaaataaattaaataaagaaagaaaataaaatgtatataataaaagaaaataagaagaaagaacaaacctgagaagaccctcaactttcacctctggctaacagctgggtcagtgcaagctctaagagaaggctaaggcagaattataaacagcctgttaagcattgaaggagtgttccagaactatgctaatctgcaatgattgagagagttttgttttgttttgttttgttttgtttttttgtggtcttttatttcttcatttatttttgggaagggacttgaaatggtacactaaaaaaataaactaaagtcgtttatcagttctaggagcatttgggcagagtcttcagggttttctagtataggatcatattgtcagagaagagagataatttgatttctcccttttctatgccgtttattttgttttctcttgcctgatcgctgtgattagacttccagtactatgctgaataggaatggcgagaatgagcatctttgtcttgttccagctctcaatgggaatgctttcagttgctgctcattcagtatgacattggctgtggattcgtcataggtggccttattattttgaggtatgttccttcaatgaagtttgttgtgggtttttaatcataaaggaatgttggattttatcaaaagctttttccttatagactttagtaaaatttcaagatacaaaatcgatgtacaaaaattagtagcaatttgatacactagtaatattcaagctgagagccaaatcaagaatgcaatcctatttacaatagccacaaaaattaaaatgcctaggaatacatctaaccaagaggtgaaagatctttacaaggagaactacaaaacactgctagaagaaataatagattacacaaacaaatggagaaatattccatgctcacagattagcagaatcagtattgttataattgccagactccccaaggcaatctacagattcagtgctattcttatcaaactaccaatgtcacttttcacacaattagaaaaaactcttctaaaattcatgtggaaccaaaaaggagcccagtcagccaaagccatccctagcaaaaagaacacagtcagaggcatcacattacctgtcttcaaaccacactataagggtatagtaacaaaaacagcatagtactgatacaaaaacagacacatagaccaatgcaacagaatagaggacccagaaataaagccttatacctactgctatctgatcttcgacaaagttgacaaaaacaagcaatgagaaaaggactccctgttcaataaatggtgttgggatagctggctagccacacacaaaggaatgaaactagacccctagccaggcacggtggctcacgcctgtaatcccagcactttggaaggctgaggcgggcagatcacgaggtcaggagattgagaccatcctggctaacatggtgaaatcccgtctctactaaaaatacaaaaattagctgggtgtggtggcaggcacctgtagtcccagctactcgggaggctgaggcaggagaatggcgtgaacccaggaggtggagcttgcagtgagctgagatcacgccactgcactccagcctgggcgacaaggcaagactctgtctcaaaacaaaacaaaacaaaaaaaaactagatccctacatttcaccatatacaaaaattagctcaagaaggattaaagatataaatacaagacttcaaactataagaatcctaaaagaaaacctaggaaacaccattctggacaattggctttgggaaagaatttatgactaagtcctcaaaaacaattgcagcaaaaacaaaaattgacaagtgagacctatttaaactaaagagtttctgcacagcaaaggaaactatcaatagtgtaatgagaaaacatacagagtgggagaaaatgttcacaaacaatccatctgacaaaggtctaatattcagaacctgtaggaaacataaacaaaccaacaagcaaaaaccaaacaaccctattaaaaagtgggcaaagtcatgaacagacacttctcaaaagaagacctctaagtggccaacaagcatatggaaaaatgctcaacattactaagcattagagaaatgcacatcaaaaccacaatgagataccatctcacatcagtcagaatggctattattaaaaagtcaaaaaataacagatgctggtgaggctgcagagaaaagagaatgtttacacactgttggtgggaatgtaaattatcccagccactgtggaaagcaggttggagacttctcaaagaacttaaaatagaattacctttcgatccagtaatcccattactgggtatatagctaaaagaaaataaattattctattgaaaagacatatgcactcatatgttcatcccagtactattcacaatagcaaagacacggaatcaacctagatgtccatcaacaatggacgggataaagaaaatgtggtacatatatatcatggaatactatgcagccataaaaaatgaatcacatcctttgcagccacgtggatgttactggaggccattatcctatgcaaattaatgcaggaacaggaaaccaaatactgcatgttctcacttataagtgggagttaaaaaaatgagtatttgtgaacataaagatggcaaaagtagacactgaagaaagggcggaggaagggaggggtccaagtataacaaatgattgggtactatgctcacaacctgggtgatgggatcaattgtaccccaaacttcagcatcacacaatatacccaggtaagaaaccgcacatgtaccccctgaatctaaaataaaagatgaaataatttaaaaaattaaaaatggactaaacataaaaagaaggtagtaatggaggaaatgagaggggtaaagtataatatagaaagaaaaagtaaaatggcaaaaataagttcttccttaccaatgattactaaatgtaagtgaatttaactccccagtcaaaaagcagagactcctatagagtcatttcagatctaaagatacacataggctgagagtgaaagaatggaaaaacatatttcatacaaataataatgaaaagagatcaaggcagaaatttccccaataatagttggataattcaatattccactttcaataatggataaagcattcatacaggagatcagtaaggacccagagacattgagcaacactaaaaactaaatagacctaacaatatagaacaatacactcaaccagagcagattatatatatattttctcaagagcacacggcatattctccaggatgttaggccacaaaataggtctcagtgaatttaaaaatgttgaaatcacgcaaagcatcttttctgactacaaaaaaaaaaaccaaactaaacaaaactacaaatcaataagagacgaggaactggaagatttacaaatctgtggaattcaacagcacactgttacacatccagcaggtcaaaggagaaatcacaatggaaattataaaatacttagagaggagtgagaataaaagtacaacataccaaaactaatgtgatgtagggaaaggagtgctcaaagggaagtttacaggtgtggacacctacattaaaaagaggaaaaatctcaaattaacataactttacaccttgaagaactaggggaaaagggcaaatgaaactcaaagctagtggaaggaaacaataaagatgagagtagagttcaatgaaattgagatagataaacaatagagagaatcaataaaaacatcagttgattctttgaaaagattaacaaaattgacaaacctttagttagaccagcaaagaaaaccagagaaaacacaaataactaaatccagaaatgaaagtgaggacattacttaccaaccttacagaaataaaaaagattatcagagagaataatgaaaaattattcaccagaaaattaaataaccaaaggcaatggacaaattactacatacgcaaatgaccaaaactgacttaagcagaaaaattgaacaaacctataaatgctaaatgaattgaataaataatcatgaaactctctgtacagggtgacatcagcaagacttttccagctgctgcttgagggtctgacaccagggagttctaatttctggagggatccaaaaaacaggagtaggaatttgcattttttattctctatgcccttttggggcacctccctttatctgcttggctgggaaaccatggtttttcccttgctgaggagacccactcataaggcaaagggctgtatgggcctcttatcatgaacatataaatgaacaaattgtgtgtgtatgtgtgtatgttgtgcatgtgtttgaacaattattaaattcagcacacagtgtctgccctgaaccagcacattacaccagggagtagatactccagggactcccaaaacacccacactttggaagcagaatggtccaaagttgtaaccaaagttgatcatcccgtgtgggatgatcaacactatgtttgaaatgcttgttttttggtgctgtaaagaaatagcacttgaacataaatttaattttctcagcaaggccatttttatactttctgcagaaagggtacactcgccagcagttttgccacaagagtacactgaacaaaggagacagggtcatttataacttgatgcgtccaccttactgctgtgtctggtttctattggctggaacaggacttcacattctgtatttgtcttgattggctaggaacttagaactttttaaaaggggcaaaggcagaggagaacaaaggaaggaggtagtaacttgtggaatgctgagaaaggtaaaaacaccttcaaataaggaagaggaacaggcaatgacctaatgcttgcttggaccagtataagcatgccagggcaaatatttaggctaaattgtgggagctaagaacataaagtacattgatttctttattacggctaacagatatttaaggatgttagcacaggtctttgaataaattttccttctaagagaagttactatttattcctaattagatgaggaggaaagtctttgaagaggaacctctactttacttttcacaattccttctctttttatttcataattcctcttcaaacttgtttaatatgttttgacttaattgctttatttgtctttctaagagaagtaatttttctgaatagggtggaggagagttaggagttaactctgtaagagtggcagagacaaatttttgtataaaactttgaaagcagggaataatagcctacaagaataagcacactaataacaaaagctaacaaggtgagaattgaagttaaaatttatttttatccacttaactaatactttattattttattattattattattatttttattttgttctttatttatttatttttttgagacggggtcttgctctgtcacccaggctggagtgcagtggcacaatcttggctcactgcaagctccgcctcccaggttcacgccattctcctgcctcagcctcccgagtagctgggactacaggtgcccactaccacgccagctaatttttttgcatttttagtggaggcggggtttcaccgtgttagccaggatggtctcgatctcctgacctcgtgatccacccacctcagcctcccaaagtgctgggattacaggcgtaagccaccgctcttggctgttttaatattttagaaaaaggattatttatttttgaatttttggcaagtttattggatagggctgttaatccttgtagcgcttttgttatagttccatcagggcagtattattaggaacaaaggtacaatattgagttttaattatgacacaaacatctcctttttctgctaatattatatttaaagctattttatttttctaggccatctggcttagcttagatatctctttgatgtttagcaatctctttgatgacgtcctcagtgtaatgtatgaattgttgctgattgtagtagatatagtttatttagtctacatttttttttatttaaagttacttaccagaaatacgtggattcaaattgtgcagctgtttgattttgtgctttaaacttatttggcacttctcaaaggaccttaatagcatttatgtaaaactgaggattaaaggattcataaggagtttctcttggcctgtggtgctttgtttttacttttttagattgatgaaatgccagggtgaaggggatagccaattggattagagcacaagtactgctccaattatttggcagagtgtccagtaaaggtgcttcacagtaccaccatacatttgcttggggatggctaagcatggactgatgggcaagctcttggaaaggctcgagctcctcgcatctttgtgtgcttccaaagaacaccaaattttcctcttgccatgagatgcataaagtaaacttggcatttagaggtggaagctggattgccttcaggggcttaccagcagagtgttgaatttcaggaaatagcagagagagcttggcatgatggattatcctaagtaattggattctgaaaaagagccaccatacagtccgtatctggtcgatgaggagaccatctgagtggaaagaggataatctgggcctctggcctaccgtgcatacaagtttaataatcgcttttatttaaagtgtgaacggaatatttaatccactccagctacgcatttgcatcttgatattttgtcttgatggctaagttctgtctgtcttagatctcttatttttacaatagacactctagttttattagatgtaggagcgaccagtgtgggatctagaactgaggctactgaagaaggggaagatgggggtaataatgcccgttttgtagagttagttaaggtggaggtagtgacagagagaaggacagggttacattgataaggctagcagttagaaggggtagtctttttagtgaaatagatgaagggttttagatctgcacaaacctttttcgtggaagtctaactttgctcctgagtagtttaaaggacgtagtcctatttactacaaggttaccaggctgtaggagcagaaaatcagtgtcttggctgcaggtgatcacaacgatgagtgctaggggtaactgtgtcaattagagggccaggatataaatatttgtgtgaaaaggctaactgtcgttgatcttttacatttccacaaggtatgatagagcaagcattaaaggcaatggtctgaggcagacttagttacattaataacaaaggagctagtaacagaataaggaaagaaaaggaagcaatatagaatgtatatgaaaattaagctttctttaacttagtagggcttgatcttagtacagtaacctaagatgttttcttgactcgagtatggtgggtccattctttcttggctgtgcggatggcagtctcagtggttaacagcataaaatagggtccttcctaggctggcgtgaattttttttctatcttttgatgaggatgtgatttttaggctggtgctggtgcactggaaattctaggggtggcacctgtgctaaaagacttttagttctgagggaagggaaagtggaagataaattaagcatatcatttctattgcatatcttggggcttgaggcctcatggtgatgcctcccactccattccttctcagcgccgcccagggtacgtggcggccttgatccctcttaaggtcttggccatcttgtggccttcaccgcccctgcgcgttgtggccttggggatgaggggccttgtgacttacctggccaccttcaggccttaagaaagctaaacaccattttatatttgacaatgctttttgtatgattttatacgagataagttaaattttaccttcatattaatgtgctattaatgttaaacttaattttaataaaatcttgtagacattatttatccaattttaatgtctgactataaggtaagatttttatagactctttttaaccttttataatttttgttaaagagcaggttagtgctttaagaaaaatctattgtgcttttattttaacgttcagttcacagaaaaactggatgatacctctttaactttagccaatatgtttacacacagaatttcctttacaattaacattttaaaacttgcttaaacctttaaaacaagttttttaaccttttaatataggtaaaaatccatattcttatgcctccttataatcctgttattaaaagtatattttatttttcttacatactttgtacataaactgtttttaaaatagttttacattcagaaggcctaattacttttaaattatacaatatttcttgcataaattcctttttataactttccttatgactttcacagacaatcttcaacatgtcttaactttctgccttccttttacactatttcttttcttagtttcaccttctgggtctttctttgatttctgtctcttccagtttctctcttactcttttattctatttctctctctctcatttgcactcttattttcctctctctcatttgcattctatttttctttctctgtctgtcatcctctgtttcttttttcctttctgagttttcctggtcttgcagctggtggggctgggcaaaggcatgggcctcgcccccaagtatgcgctgccatctatttctcctgtttttatttttttctgatttcattttttactttttttttccctttcttcctacacttagtttctcaggctgggtgggatttgcacggctgcagtcctggccctgggccttcaccggccttgaggcttggcagatgcctgccgcaacttgcaagaattgtaccttttcacctcttctgctgtcctcctggcactggtcctcaccctctttttcacacagagctgggctggggagagggacttaactttaggttagttaagttaaggtgcctggctgtctggcaccatgcttgctgtttttgctctctttctctctgaatttcctctcctaatttctttttcctctctgctggtctttcctttgcctctgccagccacctatgctgctgttttcctccctctccttcctcttcctctaggggagccaccggggagaggagcttagcctttttctttcctcgggaagagggggaaggggagttttgaaaaaaaaaaaaaatatatatatatatatatatatatatatatttttttttttttactaccagaggtttgtgtgaggttcaaccccctctcaatggggatttctcacctctttttgaggttcaagcccccctcaatggggatttctcacctctttttgaggttcaacttctacagtggggatttctcacctcttttttgacctccaagacatcctgactaaggaatacttcactgccccctgtcgctttctttccttagtcctgcccaaggaatgctttatcgcccctgcagtttctccctccttggtatgtcctaaccaaggaatgctttaccaccctgcagctttttttttagtcttgactaccaaggaaatagtttactggctctcctggtgtttctttccttggtctgtgcacacagtttcctggtttaggtgatatatgaggatcttttactccaggtcaccggccagtgttttttctttttttgcattgctgagagtccgggtttatttgtcacagtgggtgggtctcgagtccttatccctgaggccactgcaatgaggcagaggagcatgctccttcatgagagaggactggagaccatccccagaggagaatgtatccctgtaccagccaccaaattgtttgaaatgcttgttcttcggtgccataaagaaatagcacctgaacataaatttaattttctcggcaaggccatttttatactttctgcagaaatgttacactcgccagcagttttgccacaggagtacaccgaacaaagaagacaaggtcatttataacttgatgtgtccaccttactactgtgtctagtttctattggttggaacagggcttcacattctgtatttgtcttgattggctagcaatctagaacatttttaaaagaggaaaaggcagaggagaacaaaagaaggagaaagtaacttgtggaatgctgataaaggtaaaaacaccttcaaataacgaagaacaggctgtgacctaatgcttgcttggaccagtataaacatgccagggcaaatatttaggctaaattgtaggagctaagaacataaagtacattgatttctttattatgtctagcagatatttaagaacgttagcacaggtctttgaataaattttgcttctaagagaagttactatttattcctaattagatggggtggaaagtcttcgaagaggaacttctactttacttttcacaactgtatgaaccggttacagaaaagagaaatgttctttagaaagtgacaatccttatggagaaagtggaaaaatcctgaaatttactgccacacatgcatactttcagaaatttgcataattgtagaactcttcttcccatttgatcaccccaccccatctttttgttctttatttactattatttcagagggattcaggaaaacaagagagataaatgcatgaattccactctacactgtgctatggtgccaaattaagtccacttagttggtgaatttaaatggtttaaaacaacagtaaaggggaggagatgtgctgtagaagaaactgcttcagtatcatgaagtgattgatagaaatagtagattaccattccagagactgaagataaatttcatgaacacttctaatggatgacttgggtctggacctaacagaatcattggagtccttcctagagatgacagcaatctttgtttcctacaattcttggttcttccaagatccagcaatagggtgttgatggtttaagacataaagacaatataattcttactttcatctcatttaatcttagaggcatttggccaagctattttagtttaggttctacaaaagcaatgcccccaaaacaaggacttggctacagatagattatcctgtgggtgatcctgccttatttaactggggctcaatccaacacgcatatgcccccaaattgtccaactgggacaatgtgggcagcttggacctggctcccaacccacattggtaaaggtaccccccaaatatttcctcctctctacttctaggctgaacatgcacactgggcaaatgggctctcttggatctgaagactgctctacagcagaaaagcagagagacatgttgggaggacacctaattcaagttaatagagttggctggccagtttacagactctctctctttccctcccttgtcaacttaagaatttgggcaattgattcaaaattcttgcaaaggcagatttgggtaactagggtctattgccaggctctattgataacagagtacatcctcactgagcttcctcctctgggtaccagcaagcttctggtgtcaatggtggggaggtcattatgtgctcaggtccacatctctgatggataaatatattgaatattacccatggatacccagctaaagtcagcagcatgaagagatgaagagttcaaaagaggcaacgactgagaagagctaggatgaaagagaaccagcctacaacagatgggaagtaacccttgttcctggtcattccgtcctctgtgtcccttctgtcagggacctagatacacagcaggcatgcccctgtacccctgcccactacccagtctctacgtgagttggataaggagtactttattctatagtcttggatgaacatcagctagaacaatggaataataatgagaatttaaataactaaattcttcaggatttcttgaatgcctacacatacattatctacttcaacttcataaagcctgaatgaaatgaaaataactttaagataatgaatctcagacacaatggaggaaaagctccagacactggctgaggaggacctaggacctcagcccatttgcaggacactttcctcttctatcagacacccatgctcccctccatctgcagcctcccacacccagggactaaccatcagaaaaacgcctagtatctcttccctcacttgcgaattccgcactaaatgcatctcttcttgccaccttttacttaactggctgcacttgactcagccccctctgctcctactgtctttccaagaaagtcacatctgatggatgtacatttttggggttttggaaaccgttgactgttgccacaacaaggaggtaagatgcgctggcaaaatcctttggcacctgccttgctgtggctgagtggggctgggctgtaatggcaagagatagaggggctctcgttatgggtgaaatctgcatggggctctttgcatactagggcaccagaagttttcttagtgtggcacccaccgccctgaggggtatcactgatgatcaacatccaaagaacctgaggcccaaagcagagatagtagctccaaatctctcattagatggaagactgagattcccatctgattttttttcaaaccagccagagtatttggaacagaaatgcctaacttgcctgttaaaaagtaagagagtgttgatatttaagctctggctggaatttaagactctggctttttcttgaaggctccatatatgaaaaagaaaagtgaaatcagattatgctttttcctcttcccaacaaagccagtatttccaagagtgaaaggctgtctgtccagtactcaggctgcccggtgtggatggctcagtgagagaggggagggtgagaagccattggggccaaaactagggatctcagtgactgagaggagtggacaagtcttcagtcagcagagttggatttgggatgacagaccaggatttctggggtcagtgcaaaggccggtgagagcctcctccttcccttctctgctcagcccctggggtcttcttcctccacaatgagtactggtgaatctgaactcttttctctgcctatgctccactgagggagaccaggcctttgggtcctggggacagagtgagatagaattaaggaatctgctctggaatcactgaaagcgacttgatgtcttcacatcactgccccctgcatcacagctccaaaagggacacattatagtccccaagaattggctggaatactacacaggtttgttaattctctggccatgctcagggaatatactgtctcccggtcacgctcaggtaatcagaagtccagacattctaataaacaagccctagacccttgttgaacttaaatctccctcgccccagctcagtcctaccttggagtgagaaatcagcaggagggacaagaaaagagtcagcttctggtcttttctttcccctacctcctctgctatgagcatctgatgtttgggacccttacaaggtgtctgtgtgggagtggggagggtggtaaagggtagagaagtggggagaggagaggcagtggtgaaaatcaggacaagtctcgcttgtgatatggttgcaatctggctgtaatggcctctggggggtggtgaatgttactgactatcctctagtatgagggaccatgagggaccctctctaatattccttttgggatctttgagataggcaaagccctaatccgcagatttcctctcacctcctcggtctctgcaacaggtgagcccagtatctttcaactgaggtcctgttgactgtgttctgcacactgggctcttccctctagcccttactgttggcctttggtgaaggcacatccacgtgccctttctgcctcctcaatctgacagttgtcctgttctgacctgggcaaggagttgagggggcaaagccaatctcatagctgcataagtggttttgcaacttcttagttctgtaaatctccagaaagcagacatactatcatcttactagcctcatagccaccttgtgctggggcatctcttctcttactttaaacaccctgggggcttatggtccccatttaaaacaaggaaatgagattctctgagaggtgaagcagataaccaaggtcactgctagtataaacatgcatgtgcaagtgtctttttcatataatcacttcttttcctctgggtagacacccagtagtgggattgctgggtcaaatggcagatctacttttagttctttgaggaatctccatactgttttgcataatggttgtactagtttacattcccaccagcagtataaaagtgttccttttcaccacctgcatgccaacatctgtcattttttaatttttaaattatggccattcttaacaggagtaaggtggtatctcattgtgtttttaatttgcatttccctgattactagggatgttgagcatgttttttcatatgtttgttgaccatttgtctatcttcttttgagaactgtctattcatgtcctctgccccactttttgatgggattatttgttttttttcttgctgatttgtatgagttccttgtcgattctggatattggtcctttgtcagatgcatagtttgcaaagattttcccccactctgtggattgtctgtttactctgctgattatttcttttgctgtgcagaagctttttagtttaattaggtcccatttatttatttttgtttttgttgcatttgctttgggatcttagtcatgaattctttgcctatgtcaatgtctagaagaatttttcgaatgttatcttctagaatttttatggtttcaagttagatttcagtctttgatctatcttgagtttattttattattattattctttttgagacggagtctcgctctgtcaccaggcgggagtgcagtggcgcgatctcggctcactgcaacctttgcctcccagattcaagcaattctcctgcctcggcctcctgagtagctaggactacaggcacgcaccaccatgcccagctaattttttgtatttttagtagagacagggtttcaccatgttggccaggatggtctcaatctcttgggctcatgacccgcccgcctcagcctcccaaagtgctgcgattacaggcatgagccaccgcacctggccgagtttatttttgtgtaagatgagagctgaggatccagtttcattattctacatgaattatcacattgatttttcccgcagccttttctgataatgatcaaacagaggaaaagcctgggatttgatccacattgttttccgggcacatggagttctctgatgcaccagcctccacatctgtgctaaggccaggtcttactttgctataagtacctttgtttggggatcaagataattggcatggaattaactatatataacctcacatgggaaatctattaatctgtgttcttcattctgcatgttttactcatgaaattaattcattggattatgaccagcattaaaaaacaaacagatgaaaaacattcatagaatggaataggagttatagggtgtatttaaggcaaattgttctgtaatacctcacattcacctgtgtgcaggtatttgtgtgcatgtgtacttggttcctatatgctcacttagtaaatttaggaatatgctccttctaggatctggttctttttttttttgtatggctgccactctgtaattgaacctggttccacgactccctttagaagggcctcctcctcctcttccaaaaggactcctctgcccctgtctggaggaaggtatctggcaatatatctgggcaagatattcaaagagctgagcttggagcaattgtaacccaggctgaattctgatgacctcttctaaacttccaggtcagtgctcctggaggctcacccacacaaacacataggcacactaacaacacctggaagacacaccaacctcatgcagaggaaaccataccctcactggcctggcagtgacacaggggcctgggcaggcatagcacagaagagtcctggtgtaactgagataaagtatctcaattgtacaaataattattttcggctcggttgtctctagcgtgcagctggtgagccttcaccatgggcccaggagaagcggatcatatgaacaaggcctggggatgggacagttgagctggggctgcaggggctaaggctgtttcccatggggctcagcactggtggacaggtaagcagacaggtttgaagatgctggctcagttcacagacatggtcacagaaaaagcctggaaaactatagggttttctgctgacctcccacactcaccatggacagtcagtaccctgcactggcccgtgtcgtacccaagcagagtgtgcttgaaaattggatgtatattagtagaccccgtgctcagcgggtacagtttagaaagggaagttaacttatctgtcaattagtaagttaacaacacacaaagtgtactatgttttattaatcaaacaaaaatatgtttaacacctgctgggcacaaggagtacaatggtaaagagtttaatggaaatgtttaatggttaatgccaagacctgtgtatgtattaatatgatgccaatcatttaatacctgatgaagcaatagtttctgggactacttgggttagaaaatgggcctgccacaggcccaagcccatcccctaccctgcatgtgctcctgctccactcccttgtgcatctatccggtataatgttgtggggaaggggagtgctcgattcctcaccttaaccagcctgccagctatccatgcagagacatgtgggcaaaactcctaaggccagacctccccactccattctcctgctaggctgctgagggactccattcgaacctggtaattaccctgcctccttccctccagattccataggttacctcttcctcttt

SEQ ID NO: 48 - DNA, 15956 bp, Homo sapiens
acttgtcatgttaaaaaaggcacatgcataccttcaaactagaaaaattctacttattgtttctggcttagaaaaataatcatagatgtatgtaaagattcatatgtaataatgttcatcttaatatttttatacacaatgaaaagttgaatataagctaaatgtttaattgtagctactaaaaattaggttttagaagaatattcaatgatatacaaaataaacattacattaaaaagaaaaaagaattgaaagtaaagtgatggaaacattaacaattaaaaattaatcaagtgaaaacttttatagctataataatactaaattggtctttgaggaagcactactagtaatgaataaattactttaataaaattatcaattaaaagtaatggccagaaattctaattttatgtaaaattaatttcatggcttcaaatgtatatataatgggataagatgacagaagtataattaaaaaacaaaagaaatccaggtacatagttggaaatcttaacacaattctctcaacaataaatagaagatagaagagttaaaaacatttatatatttattcatgaacaacatgaataatggacttaagaaactcatatgtaatgataattgaatttaagtaacatatataacactacactctcagcctaaaaaacacatatttctttcaagtttacatgcaacagatatctgaaaagaccataaactgggccattataatgatattgggaaaaaagcttctaagtttggaaattatgcaatatactgcaaaataatgccaaagaaaattacgatgaatatttaaaaatagttcatatttaatgatgattaaaatataatatgttaaatttgtggaatgcagctaaaggtgtgctcagtagaaatgtgaagctctaaatacatttgaaaggaaaaaaaattacataaaaagtcagaaccaaatttatcagaactctggaaaatggtcaaagttgagtaacagccaagcaaatgctgaatggagcaaaagacagcataaaaggtagaaattagtaagcattcctcaaaaacattgtaatacaaccaaacaatccacattcacttggtgcaaaatatcagaactgaataaagtaataaatactcaaaagcataaaaggaaaagcagggaacagagtttctttagaaaattggggcactcaaaagcacctatgtgtactaggaatttagaaagtcaagtgcatgcccagggcaggacatacatttagaaaaacactgaggaaaaacagtacagaagtttcccaaaaaattaaaaaataaaacgattatgtaatccagcaatcccactacttggtatacatccaaaggaaatgaaatcagtatgtcaaagaaatacatgtactctcatgtttactgcagcattatttacaataattaagacatggaagcaacctaagtgtccataaaggggtgaatggatatttttaaaaatgcgtcctgtatatacaatgaaatactatccagccttaataaagaaggaaatcctgtcatttgtgacaccatggataagcctggagggcattatgttaagtgaaataagccaggcacaaaaagacacataccgcatgatcttatttatatgtagaatctaaaaaagttgatctcgtggaagaagagagcagaatggtggtttcctgggactcagtagtggggtgagagttggggagatgttggtcaaaggctataaaatttcagctgggtaagaagaataagttcaagatatctgttgtacaacatcatgactatagttaataccaatgcatttttttccttgaaaattcctaacggtagattttgtggtcttaccacatacaaaaatgataaatatgtgaggtaatatgtatgttgattacattaccattccacagtgtatacatatctaaaaacatgttgtacaaaataaatatatacaattttacttgtctatgtaaataaattaaataaagaaagaaaataaaatgtatataataaaagaaaataagaagaaagaacaaacctgagaagaccctcaactttcacctctggctaacagctgggtcagtgcaagctctaagagaaggctaaggcagaattataaacagcctgttaagcattgaaggagtgttccagaactatgctaatctgcaatgattgagagagttttgttttgttttgttttgttttgtttttttgtggtcttttatttcttcatttatttttgggaagggacttgaaatggtacactaaaaaaataaactaaagtcgtttatcagttctaggagcatttgggcagagtcttcagggttttctagtataggatcatattgtcagagaagagagataatttgatttctcccttttctatgccgtttattttgttttctcttgcctgatcgctgtgattagacttccagtactatgctgaataggaatggcgagaatgagcatctttgtcttgttccagctctcaatgggaatgctttcagttgctgctcattcagtatgacattggctgtggattcgtcataggtggccttattattttgaggtatgttccttcaatgaagtttgttgtgggtttttaatcataaaggaatgttggattttatcaaaagctttttccttatagactttagtaaaatttcaagatacaaaatcgatgtacaaaaattagtagcaatttgatacactagtaatattcaagctgagagccaaatcaagaatgcaatcctatttacaatagccacaaaaattaaaatgcctaggaatacatctaaccaagaggtgaaagatctttacaaggagaactacaaaacactgctagaagaaataatagattacacaaacaaatggagaaatattccatgctcacagattagcagaatcagtattgttataattgccagactccccaaggcaatctacagattcagtgctattcttatcaaactaccaatgtcacttttcacacaattagaaaaaactcttctaaaattcatgtggaaccaaaaaggagcccagtcagccaaagccatccctagcaaaaagaacacagtcagaggcatcacattacctgtcttcaaaccacactataagggtatagtaacaaaaacagcatagtactgatacaaaaacagacacatagaccaatgcaacagaatagaggacccagaaataaagccttatacctactgctatctgatcttcgacaaagttgacaaaaacaagcaatgagaaaaggactccctgttcaataaatggtgttgggatagctggctagccacacacaaaggaatgaaactagacccctagccaggcacggtggctcacgcctgtaatcccagcactttggaaggctgaggcgggcagatcacgaggtcaggagattgagaccatcctggctaacatggtgaaatcccgtctctactaaaaatacaaaaattagctgggtgtggtggcaggcacctgtagtcccagctactcgggaggctgaggcaggagaatggcgtgaacccaggaggtggagcttgcagtgagctgagatcacgccactgcactccagcctgggcgacaaggcaagactctgtctcaaaacaaaacaaaacaaaaaaaaactagatccctacatttcaccatatacaaaaattagctcaagaaggattaaagatataaatacaagacttcaaactataagaatcctaaaagaaaacctaggaaacaccattctggacaattggctttgggaaagaatttatgactaagtcctcaaaaacaattgcagcaaaaacaaaaattgacaagtgagacctatttaaactaaagagtttctgcacagcaaaggaaactatcaatagtgtaatgagaaaacatacagagtgggagaaaatgttcacaaacaatccatctgacaaaggtctaatattcagaacctgtaggaaacataaacaaaccaacaagcaaaaaccaaacaaccctattaaaaagtgggcaaagtcatgaacagacacttctcaaaagaagacctctaagtggccaacaagcatatggaaaaatgctcaacattactaagcattagagaaatgcacatcaaaaccacaatgagataccatctcacatcagtcagaatggctattattaaaaagtcaaaaaataacagatgctggtgaggctgcagagaaaagagaatgtttacacactgttggtgggaatgtaaattatcccagccactgtggaaagcaggttggagacttctcaaagaacttaaaatagaattacctttcgatccagtaatcccattactgggtatatagctaaaagaaaataaattattctattgaaaagacatatgcactcatatgttcatcccagtactattcacaatagcaaagacacggaatcaacctagatgtccatcaacaatggacgggataaagaaaatgtggtacatatatatcatggaatactatgcagccataaaaaatgaatcacatcctttgcagccacgtggatgttactggaggccattatcctatgcaaattaatgcaggaacaggaaaccaaatactgcatgttctcacttataagtgggagttaaaaaaatgagtatttgtgaacataaagatggcaaaagtagacactgaagaaagggcggaggaagggaggggtccaagtataacaaatgattgggtactatgctcacaacctgggtgatgggatcaattgtaccccaaacttcagcatcacacaatatacccaggtaagaaaccgcacatgtaccccctgaatctaaaataaaagatgaaataatttaaaaaattaaaaatggactaaacataaaaagaaggtagtaatggaggaaatgagaggggtaaagtataatatagaaagaaaaagtaaaatggcaaaaataagttcttccttaccaatgattactaaatgtaagtgaatttaactccccagtcaaaaagcagagactcctatagagtcatttcagatctaaagatacacataggctgagagtgaaagaatggaaaaacatatttcatacaaataataatgaaaagagatcaaggcagaaatttccccaataatagttggataattcaatattccactttcaataatggataaagcattcatacaggagatcagtaaggacccagagacattgagcaacactaaaaactaaatagacctaacaatatagaacaatacactcaaccagagcagattatatatatattttctcaagagcacacggcatattctccaggatgttaggccacaaaataggtctcagtgaatttaaaaatgttgaaatcacgcaaagcatcttttctgactacaaaaaaaaaaaccaaactaaacaaaactacaaatcaataagagacgaggaactggaagatttacaaatctgtggaattcaacagcacactgttacacatccagcaggtcaaaggagaaatcacaatggaaattataaaatacttagagaggagtgagaataaaagtacaacataccaaaactaatgtgatgtagggaaaggagtgctcaaagggaagtttacaggtgtggacacctacattaaaaagaggaaaaatctcaaattaacataactttacaccttgaagaactaggggaaaagggcaaatgaaactcaaagctagtggaaggaaacaataaagatgagagtagagttcaatgaaattgagatagataaacaatagagagaatcaataaaaacatcagttgattctttgaaaagattaacaaaattgacaaacctttagttagaccagcaaagaaaaccagagaaaacacaaataactaaatccagaaatgaaagtgaggacattacttaccaaccttacagaaataaaaaagattatcagagagaataatgaaaaattattcaccagaaaattaaataaccaaaggcaatggacaaattactacatacgcaaatgaccaaaactgacttaagcagaaaaattgaacaaacctataaatgctaaatgaattgaataaataatcatgaaactctctgtacagggtgacatcagcaagacttttccagctgctgcttgagggtctgacaccagggagttctaatttctggagggatccaaaaaacaggagtaggaatttgcattttttattctctatgcccttttggggcacctccctttatctgcttggctgggaaaccatggtttttcccttgctgaggagacccactcataaggcaaagggctgtatgggcctcttatcatgaacatataaatgaacaaattgtgtgtgtatgtgtgtatgttgtgcatgtgtttgaacaattattaaattcagcacacagtgtctgccctgaaccagcacattacaccagggagtagatactccagggactcccaaaacacccacactttggaagcagaatggtccaaagttgtaaccaaagttgatcatcccgtgtgggatgatcaacactatgtttgaaatgcttgttttttggtgctgtaaagaaatagcacttgaacataaatttaattttctcagcaaggccatttttatactttctgcagaaagggtacactcgccagcagttttgccacaagagtacactgaacaaaggagacagggtcatttataacttgatgcgtccaccttactgctgtgtctggtttctattggctggaacaggacttcacattctgtatttgtcttgattggctaggaacttagaactttttaaaaggggcaaaggcagaggagaacaaaggaaggaggtagtaacttgtggaatgctgagaaaggtaaaaacaccttcaaataaggaagaggaacaggcaatgacctaatgcttgcttggaccagtataagcatgccagggcaaatatttaggctaaattgtgggagctaagaacataaagtacattgatttctttattacggctaacagatatttaaggatgttagcacaggtctttgaataaattttccttctaagagaagttactatttattcctaattagatgaggaggaaagtctttgaagaggaacctctactttacttttcacaattccttctctttttatttcataattcctcttcaaacttgtttaatatgttttgacttaattgctttatttgtctttctaagagaagtaatttttctgaatagggtggaggagagttaggagttaactctgtaagagtggcagagacaaatttttgtataaaactttgaaagcagggaataatagcctacaagaataagcacactaataacaaaagctaacaaggtgagaattgaagttaaaatttatttttatccacttaactaatactttattattttattattattattattatttttattttgttctttatttatttatttttttgagacggggtcttgctctgtcacccaggctggagtgcagtggcacaatcttggctcactgcaagctccgcctcccaggttcacgccattctcctgcctcagcctcccgagtagctgggactacaggtgcccactaccacgccagctaatttttttgcatttttagtggaggcggggtttcaccgtgttagccaggatggtctcgatctcctgacctcgtgatccacccacctcagcctcccaaagtgctgggattacaggcgtaagccaccgctcttggctgttttaatattttagaaaaaggattatttatttttgaatttttggcaagtttattggatagggctgttaatccttgtagcgcttttgttatagttccatcagggcagtattattaggaacaaaggtacaatattgagttttaattatgacacaaacatctcctttttctgctaatattatatttaaagctattttatttttctaggccatctggcttagcttagatatctctttgatgtttagcaatctctttgatgacgtcctcagtgtaatgtatgaattgttgctgattgtagtagatatagtttatttagtctacatttttttttatttaaagttacttaccagaaatacgtggattcaaattgtgcagctgtttgattttgtgctttaaacttatttggcacttctcaaaggaccttaatagcatttatgtaaaactgaggattaaaggattcataaggagtttctcttggcctgtggtgctttgtttttacttttttagattgatgaaatgccagggtgaaggggatagccaattggattagagcacaagtactgctccaattatttggcagagtgtccagtaaaggtgcttcacagtaccaccatacatttgcttggggatggctaagcatggactgatgggcaagctcttggaaaggctcgagctcctcgcatctttgtgtgcttccaaagaacaccaaattttcctcttgccatgagatgcataaagtaaacttggcatttagaggtggaagctggattgccttcaggggcttaccagcagagtgttgaatttcaggaaatagcagagagagcttggcatgatggattatcctaagtaattggattctgaaaaagagccaccatacagtccgtatctggtcgatgaggagaccatctgagtggaaagaggataatctgggcctctggcctaccgtgcatacaagtttaataatcgcttttatttaaagtgtgaacggaatatttaatccactccagctacgcatttgcatcttgatattttgtcttgatggctaagttctgtctgtcttagatctcttatttttacaatagacactctagttttattagatgtaggagcgaccagtgtgggatctagaactgaggctactgaagaaggggaagatgggggtaataatgcccgttttgtagagttagttaaggtggaggtagtgacagagagaaggacagggttacattgataaggctagcagttagaaggggtagtctttttagtgaaatagatgaagggttttagatctgcacaaacctttttcgtggaagtctaactttgctcctgagtagtttaaaggacgtagtcctatttactacaaggttaccaggctgtaggagcagaaaatcagtgtcttggctgcaggtgatcacaacgatgagtgctaggggtaactgtgtcaattagagggccaggatataaatatttgtgtgaaaaggctaactgtcgttgatcttttacatttccacaaggtatgatagagcaagcattaaaggcaatggtctgaggcagacttagttacattaataacaaaggagctagtaacagaataaggaaagaaaaggaagcaatatagaatgtatatgaaaattaagctttctttaacttagtagggcttgatcttagtacagtaacctaagatgttttcttgactcgagtatggtgggtccattctttcttggctgtgcggatggcagtctcagtggttaacagcataaaatagggtccttcctaggctggcgtgaattttttttctatcttttgatgaggatgtgatttttaggctggtgctggtgcactggaaattctaggggtggcacctgtgctaaaagacttttagttctgagggaagggaaagtggaagataaattaagcatatcatttctattgcatatcttggggcttgaggcctcatggtgatgcctcccactccattccttctcagcgccgcccagggtacgtggcggccttgatccctcttaaggtcttggccatcttgtggccttcaccgcccctgcgcgttgtggccttggggatgaggggccttgtgacttacctggccaccttcaggccttaagaaagctaaacaccattttatatttgacaatgctttttgtatgattttatacgagataagttaaattttaccttcatattaatgtgctattaatgttaaacttaattttaataaaatcttgtagacattatttatccaattttaatgtctgactataaggtaagatttttatagactctttttaaccttttataatttttgttaaagagcaggttagtgctttaagaaaaatctattgtgcttttattttaacgttcagttcacagaaaaactggatgatacctctttaactttagccaatatgtttacacacagaatttcctttacaattaacattttaaaacttgcttaaacctttaaaacaagttttttaaccttttaatataggtaaaaatccatattcttatgcctccttataatcctgttattaaaagtatattttatttttcttacatactttgtacataaactgtttttaaaatagttttacattcagaaggcctaattacttttaaattatacaatatttcttgcataaattcctttttataactttccttatgactttcacagacaatcttcaacatgtcttaactttctgccttccttttacactatttcttttcttagtttcaccttctgggtctttctttgatttctgtctcttccagtttctctcttactcttttattctatttctctctctctcatttgcactcttattttcctctctctcatttgcattctatttttctttctctgtctgtcatcctctgtttcttttttcctttctgagttttcctggtcttgcagctggtggggctgggcaaaggcatgggcctcgcccccaagtatgcgctgccatctatttctcctgtttttatttttttctgatttcattttttactttttttttccctttcttcctacacttagtttctcaggctgggtgggatttgcacggctgcagtcctggccctgggccttcaccggccttgaggcttggcagatgcctgccgcaacttgcaagaattgtaccttttcacctcttctgctgtcctcctggcactggtcctcaccctctttttcacacagagctgggctggggagagggacttaactttaggttagttaagttaaggtgcctggctgtctggcaccatgcttgctgtttttgctctctttctctctgaatttcctctcctaatttctttttcctctctgctggtctttcctttgcctctgccagccacctatgctgctgttttcctccctctccttcctcttcctctaggggagccaccggggagaggagcttagcctttttctttcctcgggaagagggggaaggggagttttgaaaaaaaaaaaaaatatatatatatatatatatatatatatatttttttttttttactaccagaggtttgtgtgaggttcaaccccctctcaatggggatttctcacctctttttgaggttcaagcccccctcaatggggatttctcacctctttttgaggttcaacttctacagtggggatttctcacctcttttttgacctccaagacatcctgactaaggaatacttcactgccccctgtcgctttctttccttagtcctgcccaaggaatgctttatcgcccctgcagtttctccctccttggtatgtcctaaccaaggaatgctttaccaccctgcagctttttttttagtcttgactaccaaggaaatagtttactggctctcctggtgtttctttccttggtctgtgcacacagtttcctggtttaggtgatatatgaggatcttttactccaggtcaccggccagtgttttttctttttttgcattgctgagagtccgggtttatttgtcacagtgggtgggtctcgagtccttatccctgaggccactgcaatgaggcagaggagcatgctccttcatgagagaggactggagaccatccccagaggagaatgtatccctgtaccagccaccaaattgtttgaaatgcttgttcttcggtgccataaagaaatagcacctgaacataaatttaattttctcggcaaggccatttttatactttctgcagaaatgttacactcgccagcagttttgccacaggagtacaccgaacaaagaagacaaggtcatttataacttgatgtgtccaccttactactgtgtctagtttctattggttggaacagggcttcacattctgtatttgtcttgattggctagcaatctagaacatttttaaaagaggaaaaggcagaggagaacaaaagaaggagaaagtaacttgtggaatgctgataaaggtaaaaacaccttcaaataacgaagaacaggctgtgacctaatgcttgcttggaccagtataaacatgccagggcaaatatttaggctaaattgtaggagctaagaacataaagtacattgatttctttattatgtctagcagatatttaagaacgttagcacaggtctttgaataaattttgcttctaagagaagttactatttattcctaattagatggggtggaaagtcttcgaagaggaacttctactttacttttcacaactgtatgaaccggttacagaaaagagaaatgttctttagaaagtgacaatccttatggagaaagtggaaaaatcctgaaatttactgccacacatgcatactttcagaaatttgcataattgtagaactcttcttcccatttgatcaccccaccccatctttttgttctttatttactattatttcagagggattcaggaaaacaagagagataaatgcatgaattccactctacactgtgctatggtgccaaattaagtccacttagttggtgaatttaaatggtttaaaacaacagtaaaggggaggagatgtgctgtagaagaaactgcttcagtatcatgaagtgattgatagaaatagtagattaccattccagagactgaagataaatttcatgaacacttctaatggatgacttgggtctggacctaacagaatcattggagtccttcctagagatgacagcaatctttgtttcctacaattcttggttcttccaagatccagcaatagggtgttgatggtttaagacataaagacaatataattcttactttcatctcatttaatcttagaggcatttggccaagctattttagtttaggttctacaaaagcaatgcccccaaaacaaggacttggctacagatagattatcctgtgggtgatcctgccttatttaactggggctcaatccaacacgcatatgcccccaaattgtccaactgggacaatgtgggcagcttggacctggctcccaacccacattggtaaaggtaccccccaaatatttcctcctctctacttctaggctgaacatgcacactgggcaaatgggctctcttggatctgaagactgctctacagcagaaaagcagagagacatgttgggaggacacctaattcaagttaatagagttggctggccagtttacagactctctctctttccctcccttgtcaacttaagaatttgggcaattgattcaaaattcttgcaaaggcagatttgggtaactagggtctattgccaggctctattgataacagagtacatcctcactgagcttcctcctctgggtaccagcaagcttctggtgtcaatggtggggaggtcattatgtgctcaggtccacatctctgatggataaatatattgaatattacccatggatacccagctaaagtcagcagcatgaagagatgaagagttcaaaagaggcaacgactgagaagagctaggatgaaagagaaccagcctacaacagatgggaagtaacccttgttcctggtcattccgtcctctgtgtcccttctgtcagggacctagatacacagcaggcatgcccctgtacccctgcccactacccagtctctacgtgagttggataaggagtactttattctatagtcttggatgaacatcagctagaacaatggaataataatgagaatttaaataactaaattcttcaggatttcttgaatgcctacacatacattatctacttcaacttcataaagcctgaatgaaatgaaaataactttaagataatgaatctcagacacaatggaggaaaagctccagacactggctgaggaggacctaggacctcagcccatttgcaggacactttcctcttctatcagacacccatgctcccctccatctgcagcctcccacacccagggactaaccatcagaaaaacgcctagtatctcttccctcacttgcgaattccgcactaaatgcatctcttcttgccaccttttacttaactggctgcacttgactcagccccctctgctcctactgtctttccaagaaagtcacatctgatggatgtacatttttggggttttggaaaccgttgactgttgccacaacaaggaggtaagatgcgctggcaaaatcctttggcacctgccttgctgtggctgagtggggctgggctgtaatggcaagagatagaggggctctcgttatgggtgaaatctgcatggggctctttgcatactagggcaccagaagttttcttagtgtggcacccaccgccctgaggggtatcactgatgatcaacatccaaagaacctgaggcccaaagcagagatagtagctccaaatctctcattagatggaagactgagattcccatctgattttttttcaaaccagccagagtatttggaacagaaatgcctaacttgcctgttaaaaagtaagagagtgttgatatttaagctctggctggaatttaagactctggctttttcttgaaggctccatatatgaaaaagaaaagtgaaatcagattatgctttttcctcttcccaacaaagccagtatttccaagagtgaaaggctgtctgtccagtactcaggctgcccggtgtggatggctcagtgagagaggggagggtgagaagccattggggccaaaactagggatctcagtgactgagaggagtggacaagtcttcagtcagcagagttggatttgggatgacagaccaggatttctggggtcagtgcaaaggccggtgagagcctcctccttcccttctctgctcagcccctggggtcttcttcctccacaatgagtactggtgaatctgaactcttttctctgcctatgctccactgagggagaccaggcctttgggtcctggggacagagtgagatagaattaaggaatctgctctggaatcactgaaagcgacttgatgtcttcacatcactgccccctgcatcacagctccaaaagggacacattatagtccccaagaattggctggaatactacacaggtttgttaattctctggccatgctcagggaatatactgtctcccggtcacgctcaggtaatcagaagtccagacattctaataaacaagccctagacccttgttgaacttaaatctccctcgccccagctcagtcctaccttggagtgagaaatcagcaggagggacaagaaaagagtcagcttctggtcttttctttcccctacctcctctgctatgagcatctgatgtttgggacccttacaaggtgtctgtgtgggagtggggagggtggtaaagggtagagaagtggggagaggagaggcagtggtgaaaatcaggacaagtctcgcttgtgatatggttgcaatctggctgtaatggcctctggggggtggtgaatgttactgactatcctctagtatgagggaccatgagggaccctctctaatattccttttgggatctttgagataggcaaagccctaatccgcagatttcctctcacctcctcggtctctgcaacaggtgagcccagtatctttcaactgaggtcctgttgactgtgttctgcacactgggctcttccctctagcccttactgttggcctttggtgaaggcacatccacgtgccctttctgcctcctcaatctgacagttgtcctgttctgacctgggcaaggagttgagggggcaaagccaatctcatagctgcataagtggttttgcaacttct

SEQ ID NO: 49 - DNA, 17412 bp, Homo sapiens
acttgtcatgttaaaaaaggcacatgcataccttcaaactagaaaaattctacttattgtttctggcttagaaaaataatcatagatgtatgtaaagattcatatgtaataatgttcatcttaatatttttatacacaatgaaaagttgaatataagctaaatgtttaattgtagctactaaaaattaggttttagaagaatattcaatgatatacaaaataaacattacattaaaaagaaaaaagaattgaaagtaaagtgatggaaacattaacaattaaaaattaatcaagtgaaaacttttatagctataataatactaaattggtctttgaggaagcactactagtaatgaataaattactttaataaaattatcaattaaaagtaatggccagaaattctaattttatgtaaaattaatttcatggcttcaaatgtatatataatgggataagatgacagaagtataattaaaaaacaaaagaaatccaggtacatagttggaaatcttaacacaattctctcaacaataaatagaagatagaagagttaaaaacatttatatatttattcatgaacaacatgaataatggacttaagaaactcatatgtaatgataattgaatttaagtaacatatataacactacactctcagcctaaaaaacacatatttctttcaagtttacatgcaacagatatctgaaaagaccataaactgggccattataatgatattgggaaaaaagcttctaagtttggaaattatgcaatatactgcaaaataatgccaaagaaaattacgatgaatatttaaaaatagttcatatttaatgatgattaaaatataatatgttaaatttgtggaatgcagctaaaggtgtgctcagtagaaatgtgaagctctaaatacatttgaaaggaaaaaaaattacataaaaagtcagaaccaaatttatcagaactctggaaaatggtcaaagttgagtaacagccaagcaaatgctgaatggagcaaaagacagcataaaaggtagaaattagtaagcattcctcaaaaacattgtaatacaaccaaacaatccacattcacttggtgcaaaatatcagaactgaataaagtaataaatactcaaaagcataaaaggaaaagcagggaacagagtttctttagaaaattggggcactcaaaagcacctatgtgtactaggaatttagaaagtcaagtgcatgcccagggcaggacatacatttagaaaaacactgaggaaaaacagtacagaagtttcccaaaaaattaaaaaataaaacgattatgtaatccagcaatcccactacttggtatacatccaaaggaaatgaaatcagtatgtcaaagaaatacatgtactctcatgtttactgcagcattatttacaataattaagacatggaagcaacctaagtgtccataaaggggtgaatggatatttttaaaaatgcgtcctgtatatacaatgaaatactatccagccttaataaagaaggaaatcctgtcatttgtgacaccatggataagcctggagggcattatgttaagtgaaataagccaggcacaaaaagacacataccgcatgatcttatttatatgtagaatctaaaaaagttgatctcgtggaagaagagagcagaatggtggtttcctgggactcagtagtggggtgagagttggggagatgttggtcaaaggctataaaatttcagctgggtaagaagaataagttcaagatatctgttgtacaacatcatgactatagttaataccaatgcatttttttccttgaaaattcctaacggtagattttgtggtcttaccacatacaaaaatgataaatatgtgaggtaatatgtatgttgattacattaccattccacagtgtatacatatctaaaaacatgttgtacaaaataaatatatacaattttacttgtctatgtaaataaattaaataaagaaagaaaataaaatgtatataataaaagaaaataagaagaaagaacaaacctgagaagaccctcaactttcacctctggctaacagctgggtcagtgcaagctctaagagaaggctaaggcagaattataaacagcctgttaagcattgaaggagtgttccagaactatgctaatctgcaatgattgagagagttttgttttgttttgttttgttttgtttttttgtggtcttttatttcttcatttatttttgggaagggacttgaaatggtacactaaaaaaataaactaaagtcgtttatcagttctaggagcatttgggcagagtcttcagggttttctagtataggatcatattgtcagagaagagagataatttgatttctcccttttctatgccgtttattttgttttctcttgcctgatcgctgtgattagacttccagtactatgctgaataggaatggcgagaatgagcatctttgtcttgttccagctctcaatgggaatgctttcagttgctgctcattcagtatgacattggctgtggattcgtcataggtggccttattattttgaggtatgttccttcaatgaagtttgttgtgggtttttaatcataaaggaatgttggattttatcaaaagctttttccttatagactttagtaaaatttcaagatacaaaatcgatgtacaaaaattagtagcaatttgatacactagtaatattcaagctgagagccaaatcaagaatgcaatcctatttacaatagccacaaaaattaaaatgcctaggaatacatctaaccaagaggtgaaagatctttacaaggagaactacaaaacactgctagaagaaataatagattacacaaacaaatggagaaatattccatgctcacagattagcagaatcagtattgttataattgccagactccccaaggcaatctacagattcagtgctattcttatcaaactaccaatgtcacttttcacacaattagaaaaaactcttctaaaattcatgtggaaccaaaaaggagcccagtcagccaaagccatccctagcaaaaagaacacagtcagaggcatcacattacctgtcttcaaaccacactataagggtatagtaacaaaaacagcatagtactgatacaaaaacagacacatagaccaatgcaacagaatagaggacccagaaataaagccttatacctactgctatctgatcttcgacaaagttgacaaaaacaagcaatgagaaaaggactccctgttcaataaatggtgttgggatagctggctagccacacacaaaggaatgaaactagacccctagccaggcacggtggctcacgcctgtaatcccagcactttggaaggctgaggcgggcagatcacgaggtcaggagattgagaccatcctggctaacatggtgaaatcccgtctctactaaaaatacaaaaattagctgggtgtggtggcaggcacctgtagtcccagctactcgggaggctgaggcaggagaatggcgtgaacccaggaggtggagcttgcagtgagctgagatcacgccactgcactccagcctgggcgacaaggcaagactctgtctcaaaacaaaacaaaacaaaaaaaaactagatccctacatttcaccatatacaaaaattagctcaagaaggattaaagatataaatacaagacttcaaactataagaatcctaaaagaaaacctaggaaacaccattctggacaattggctttgggaaagaatttatgactaagtcctcaaaaacaattgcagcaaaaacaaaaattgacaagtgagacctatttaaactaaagagtttctgcacagcaaaggaaactatcaatagtgtaatgagaaaacatacagagtgggagaaaatgttcacaaacaatccatctgacaaaggtctaatattcagaacctgtaggaaacataaacaaaccaacaagcaaaaaccaaacaaccctattaaaaagtgggcaaagtcatgaacagacacttctcaaaagaagacctctaagtggccaacaagcatatggaaaaatgctcaacattactaagcattagagaaatgcacatcaaaaccacaatgagataccatctcacatcagtcagaatggctattattaaaaagtcaaaaaataacagatgctggtgaggctgcagagaaaagagaatgtttacacactgttggtgggaatgtaaattatcccagccactgtggaaagcaggttggagacttctcaaagaacttaaaatagaattacctttcgatccagtaatcccattactgggtatatagctaaaagaaaataaattattctattgaaaagacatatgcactcatatgttcatcccagtactattcacaatagcaaagacacggaatcaacctagatgtccatcaacaatggacgggataaagaaaatgtggtacatatatatcatggaatactatgcagccataaaaaatgaatcacatcctttgcagccacgtggatgttactggaggccattatcctatgcaaattaatgcaggaacaggaaaccaaatactgcatgttctcacttataagtgggagttaaaaaaatgagtatttgtgaacataaagatggcaaaagtagacactgaagaaagggcggaggaagggaggggtccaagtataacaaatgattgggtactatgctcacaacctgggtgatgggatcaattgtaccccaaacttcagcatcacacaatatacccaggtaagaaaccgcacatgtaccccctgaatctaaaataaaagatgaaataatttaaaaaattaaaaatggactaaacataaaaagaaggtagtaatggaggaaatgagaggggtaaagtataatatagaaagaaaaagtaaaatggcaaaaataagttcttccttaccaatgattactaaatgtaagtgaatttaactccccagtcaaaaagcagagactcctatagagtcatttcagatctaaagatacacataggctgagagtgaaagaatggaaaaacatatttcatacaaataataatgaaaagagatcaaggcagaaatttccccaataatagttggataattcaatattccactttcaataatggataaagcattcatacaggagatcagtaaggacccagagacattgagcaacactaaaaactaaatagacctaacaatatagaacaatacactcaaccagagcagattatatatatattttctcaagagcacacggcatattctccaggatgttaggccacaaaataggtctcagtgaatttaaaaatgttgaaatcacgcaaagcatcttttctgactacaaaaaaaaaaaccaaactaaacaaaactacaaatcaataagagacgaggaactggaagatttacaaatctgtggaattcaacagcacactgttacacatccagcaggtcaaaggagaaatcacaatggaaattataaaatacttagagaggagtgagaataaaagtacaacataccaaaactaatgtgatgtagggaaaggagtgctcaaagggaagtttacaggtgtggacacctacattaaaaagaggaaaaatctcaaattaacataactttacaccttgaagaactaggggaaaagggcaaatgaaactcaaagctagtggaaggaaacaataaagatgagagtagagttcaatgaaattgagatagataaacaatagagagaatcaataaaaacatcagttgattctttgaaaagattaacaaaattgacaaacctttagttagaccagcaaagaaaaccagagaaaacacaaataactaaatccagaaatgaaagtgaggacattacttaccaaccttacagaaataaaaaagattatcagagagaataatgaaaaattattcaccagaaaattaaataaccaaaggcaatggacaaattactacatacgcaaatgaccaaaactgacttaagcagaaaaattgaacaaacctataaatgctaaatgaattgaataaataatcatgaaactctctgtacagggtgacatcagcaagacttttccagctgctgcttgagggtctgacaccagggagttctaatttctggagggatccaaaaaacaggagtaggaatttgcattttttattctctatgcccttttggggcacctccctttatctgcttggctgggaaaccatggtttttcccttgctgaggagacccactcataaggcaaagggctgtatgggcctcttatcatgaacatataaatgaacaaattgtgtgtgtatgtgtgtatgttgtgcatgtgtttgaacaattattaaattcagcacacagtgtctgccctgaaccagcacattacaccagggagtagatactccagggactcccaaaacacccacactttggaagcagaatggtccaaagttgtaaccaaagttgatcatcccgtgtgggatgatcaacactatgtttgaaatgcttgttttttggtgctgtaaagaaatagcacttgaacataaatttaattttctcagcaaggccatttttatactttctgcagaaagggtacactcgccagcagttttgccacaagagtacactgaacaaaggagacagggtcatttataacttgatgcgtccaccttactgctgtgtctggtttctattggctggaacaggacttcacattctgtatttgtcttgattggctaggaacttagaactttttaaaaggggcaaaggcagaggagaacaaaggaaggaggtagtaacttgtggaatgctgagaaaggtaaaaacaccttcaaataaggaagaggaacaggcaatgacctaatgcttgcttggaccagtataagcatgccagggcaaatatttaggctaaattgtgggagctaagaacataaagtacattgatttctttattacggctaacagatatttaaggatgttagcacaggtctttgaataaattttccttctaagagaagttactatttattcctaattagatgaggaggaaagtctttgaagaggaacctctactttacttttcacaattccttctctttttatttcataattcctcttcaaacttgtttaatatgttttgacttaattgctttatttgtctttctaagagaagtaatttttctgaatagggtggaggagagttaggagttaactctgtaagagtggcagagacaaatttttgtataaaactttgaaagcagggaataatagcctacaagaataagcacactaataacaaaagctaacaaggtgagaattgaagttaaaatttatttttatccacttaactaatactttattattttattattattattattatttttattttgttctttatttatttatttttttgagacggggtcttgctctgtcacccaggctggagtgcagtggcacaatcttggctcactgcaagctccgcctcccaggttcacgccattctcctgcctcagcctcccgagtagctgggactacaggtgcccactaccacgccagctaatttttttgcatttttagtggaggcggggtttcaccgtgttagccaggatggtctcgatctcctgacctcgtgatccacccacctcagcctcccaaagtgctgggattacaggcgtaagccaccgctcttggctgttttaatattttagaaaaaggattatttatttttgaatttttggcaagtttattggatagggctgttaatccttgtagcgcttttgttatagttccatcagggcagtattattaggaacaaaggtacaatattgagttttaattatgacacaaacatctcctttttctgctaatattatatttaaagctattttatttttctaggccatctggcttagcttagatatctctttgatgtttagcaatctctttgatgacgtcctcagtgtaatgtatgaattgttgctgattgtagtagatatagtttatttagtctacatttttttttatttaaagttacttaccagaaatacgtggattcaaattgtgcagctgtttgattttgtgctttaaacttatttggcacttctcaaaggaccttaatagcatttatgtaaaactgaggattaaaggattcataaggagtttctcttggcctgtggtgctttgtttttacttttttagattgatgaaatgccagggtgaaggggatagccaattggattagagcacaagtactgctccaattatttggcagagtgtccagtaaaggtgcttcacagtaccaccatacatttgcttggggatggctaagcatggactgatgggcaagctcttggaaaggctcgagctcctcgcatctttgtgtgcttccaaagaacaccaaattttcctcttgccatgagatgcataaagtaaacttggcatttagaggtggaagctggattgccttcaggggcttaccagcagagtgttgaatttcaggaaatagcagagagagcttggcatgatggattatcctaagtaattggattctgaaaaagagccaccatacagtccgtatctggtcgatgaggagaccatctgagtggaaagaggataatctgggcctctggcctaccgtgcatacaagtttaataatcgcttttatttaaagtgtgaacggaatatttaatccactccagctacgcatttgcatcttgatattttgtcttgatggctaagttctgtctgtcttagatctcttatttttacaatagacactctagttttattagatgtaggagcgaccagtgtgggatctagaactgaggctactgaagaaggggaagatgggggtaataatgcccgttttgtagagttagttaaggtggaggtagtgacagagagaaggacagggttacattgataaggctagcagttagaaggggtagtctttttagtgaaatagatgaagggttttagatctgcacaaacctttttcgtggaagtctaactttgctcctgagtagtttaaaggacgtagtcctatttactacaaggttaccaggctgtaggagcagaaaatcagtgtcttggctgcaggtgatcacaacgatgagtgctaggggtaactgtgtcaattagagggccaggatataaatatttgtgtgaaaaggctaactgtcgttgatcttttacatttccacaaggtatgatagagcaagcattaaaggcaatggtctgaggcagacttagttacattaataacaaaggagctagtaacagaataaggaaagaaaaggaagcaatatagaatgtatatgaaaattaagctttctttaacttagtagggcttgatcttagtacagtaacctaagatgttttcttgactcgagtatggtgggtccattctttcttggctgtgcggatggcagtctcagtggttaacagcataaaatagggtccttcctaggctggcgtgaattttttttctatcttttgatgaggatgtgatttttaggctggtgctggtgcactggaaattctaggggtggcacctgtgctaaaagacttttagttctgagggaagggaaagtggaagataaattaagcatatcatttctattgcatatcttggggcttgaggcctcatggtgatgcctcccactccattccttctcagcgccgcccagggtacgtggcggccttgatccctcttaaggtcttggccatcttgtggccttcaccgcccctgcgcgttgtggccttggggatgaggggccttgtgacttacctggccaccttcaggccttaagaaagctaaacaccattttatatttgacaatgctttttgtatgattttatacgagataagttaaattttaccttcatattaatgtgctattaatgttaaacttaattttaataaaatcttgtagacattatttatccaattttaatgtctgactataaggtaagatttttatagactctttttaaccttttataatttttgttaaagagcaggttagtgctttaagaaaaatctattgtgcttttattttaacgttcagttcacagaaaaactggatgatacctctttaactttagccaatatgtttacacacagaatttcctttacaattaacattttaaaacttgcttaaacctttaaaacaagttttttaaccttttaatataggtaaaaatccatattcttatgcctccttataatcctgttattaaaagtatattttatttttcttacatactttgtacataaactgtttttaaaatagttttacattcagaaggcctaattacttttaaattatacaatatttcttgcataaattcctttttataactttccttatgactttcacagacaatcttcaacatgtcttaactttctgccttccttttacactatttcttttcttagtttcaccttctgggtctttctttgatttctgtctcttccagtttctctcttactcttttattctatttctctctctctcatttgcactcttattttcctctctctcatttgcattctatttttctttctctgtctgtcatcctctgtttcttttttcctttctgagttttcctggtcttgcagctggtggggctgggcaaaggcatgggcctcgcccccaagtatgcgctgccatctatttctcctgtttttatttttttctgatttcattttttactttttttttccctttcttcctacacttagtttctcaggctgggtgggatttgcacggctgcagtcctggccctgggccttcaccggccttgaggcttggcagatgcctgccgcaacttgcaagaattgtaccttttcacctcttctgctgtcctcctggcactggtcctcaccctctttttcacacagagctgggctggggagagggacttaactttaggttagttaagttaaggtgcctggctgtctggcaccatgcttgctgtttttgctctctttctctctgaatttcctctcctaatttctttttcctctctgctggtctttcctttgcctctgccagccacctatgctgctgttttcctccctctccttcctcttcctctaggggagccaccggggagaggagcttagcctttttctttcctcgggaagagggggaaggggagttttgaaaaaaaaaaaaaatatatatatatatatatatatatatatatttttttttttttactaccagaggtttgtgtgaggttcaaccccctctcaatggggatttctcacctctttttgaggttcaagcccccctcaatggggatttctcacctctttttgaggttcaacttctacagtggggatttctcacctcttttttgacctccaagacatcctgactaaggaatacttcactgccccctgtcgctttctttccttagtcctgcccaaggaatgctttatcgcccctgcagtttctccctccttggtatgtcctaaccaaggaatgctttaccaccctgcagctttttttttagtcttgactaccaaggaaatagtttactggctctcctggtgtttctttccttggtctgtgcacacagtttcctggtttaggtgatatatgaggatcttttactccaggtcaccggccagtgttttttctttttttgcattgctgagagtccgggtttatttgtcacagtgggtgggtctcgagtccttatccctgaggccactgcaatgaggcagaggagcatgctccttcatgagagaggactggagaccatccccagaggagaatgtatccctgtaccagccaccaaattgtttgaaatgcttgttcttcggtgccataaagaaatagcacctgaacataaatttaattttctcggcaaggccatttttatactttctgcagaaatgttacactcgccagcagttttgccacaggagtacaccgaacaaagaagacaaggtcatttataacttgatgtgtccaccttactactgtgtctagtttctattggttggaacagggcttcacattctgtatttgtcttgattggctagcaatctagaacatttttaaaagaggaaaaggcagaggagaacaaaagaaggagaaagtaacttgtggaatgctgataaaggtaaaaacaccttcaaataacgaagaacaggctgtgacctaatgcttgcttggaccagtataaacatgccagggcaaatatttaggctaaattgtaggagctaagaacataaagtacattgatttctttattatgtctagcagatatttaagaacgttagcacaggtctttgaataaattttgcttctaagagaagttactatttattcctaattagatggggtggaaagtcttcgaagaggaacttctactttacttttcacaactgtatgaaccggttacagaaaagagaaatgttctttagaaagtgacaatccttatggagaaagtggaaaaatcctgaaatttactgccacacatgcatactttcagaaatttgcataattgtagaactcttcttcccatttgatcaccccaccccatctttttgttctttatttactattatttcagagggattcaggaaaacaagagagataaatgcatgaattccactctacactgtgctatggtgccaaattaagtccacttagttggtgaatttaaatggtttaaaacaacagtaaaggggaggagatgtgctgtagaagaaactgcttcagtatcatgaagtgattgatagaaatagtagattaccattccagagactgaagataaatttcatgaacacttctaatggatgacttgggtctggacctaacagaatcattggagtccttcctagagatgacagcaatctttgtttcctacaattcttggttcttccaagatccagcaatagggtgttgatggtttaagacataaagacaatataattcttactttcatctcatttaatcttagaggcatttggccaagctattttagtttaggttctacaaaagcaatgcccccaaaacaaggacttggctacagatagattatcctgtgggtgatcctgccttatttaactggggctcaatccaacacgcatatgcccccaaattgtccaactgggacaatgtgggcagcttggacctggctcccaacccacattggtaaaggtaccccccaaatatttcctcctctctacttctaggctgaacatgcacactgggcaaatgggctctcttggatctgaagactgctctacagcagaaaagcagagagacatgttgggaggacacctaattcaagttaatagagttggctggccagtttacagactctctctctttccctcccttgtcaacttaagaatttgggcaattgattcaaaattcttgcaaaggcagatttgggtaactagggtctattgccaggctctattgataacagagtacatcctcactgagcttcctcctctgggtaccagcaagcttctggtgtcaatggtggggaggtcattatgtgctcaggtccacatctctgatggataaatatattgaatattacccatggatacccagctaaagtcagcagcatgaagagatgaagagttcaaaagaggcaacgactgagaagagctaggatgaaagagaaccagcctacaacagatgggaagtaacccttgttcctggtcattccgtcctctgtgtcccttctgtcagggacctagatacacagcaggcatgcccctgtacccctgcccactacccagtctctacgtgagttggataaggagtactttattctatagtcttggatgaacatcagctagaacaatggaataataatgagaatttaaataactaaattcttcaggatttcttgaatgcctacacatacattatctacttcaacttcataaagcctgaatgaaatgaaaataactttaagataatgaatctcagacacaatggaggaaaagctccagacactggctgaggaggacctaggacctcagcccatttgcaggacactttcctcttctatcagacacccatgctcccctccatctgcagcctcccacacccagggactaaccatcagaaaaacgcctagtatctcttccctcacttgcgaattccgcactaaatgcatctcttcttgccaccttttacttaactggctgcacttgactcagccccctctgctcctactgtctttccaagaaagtcacatctgatggatgtacatttttggggttttggaaaccgttgactgttgccacaacaaggaggtaagatgcgctggcaaaatcctttggcacctgccttgctgtggctgagtggggctgggctgtaatggcaagagatagaggggctctcgttatgggtgaaatctgcatggggctctttgcatactagggcaccagaagttttcttagtgtggcacccaccgccctgaggggtatcactgatgatcaacatccaaagaacctgaggcccaaagcagagatagtagctccaaatctctcattagatggaagactgagattcccatctgattttttttcaaaccagccagagtatttggaacagaaatgcctaacttgcctgttaaaaagtaagagagtgttgatatttaagctctggctggaatttaagactctggctttttcttgaaggctccatatatgaaaaagaaaagtgaaatcagattatgctttttcctcttcccaacaaagccagtatttccaagagtgaaaggctgtctgtccagtactcaggctgcccggtgtggatggctcagtgagagaggggagggtgagaagccattggggccaaaactagggatctcagtgactgagaggagtggacaagtcttcagtcagcagagttggatttgggatgacagaccaggatttctggggtcagtgcaaaggccggtgagagcctcctccttcccttctctgctcagcccctggggtcttcttcctccacaatgagtactggtgaatctgaactcttttctctgcctatgctccactgagggagaccaggcctttgggtcctggggacagagtgagatagaattaaggaatctgctctggaatcactgaaagcgacttgatgtcttcacatcactgccccctgcatcacagctccaaaagggacacattatagtccccaagaattggctggaatactacacaggtttgttaattctctggccatgctcagggaatatactgtctcccggtcacgctcaggtaatcagaagtccagacattctaataaacaagccctagacccttgttgaacttaaatctccctcgccccagctcagtcctaccttggagtgagaaatcagcaggagggacaagaaaagagtcagcttctggtcttttctttcccctacctcctctgctatgagcatctgatgtttgggacccttacaaggtgtctgtgtgggagtggggagggtggtaaagggtagagaagtggggagaggagaggcagtggtgaaaatcaggacaagtctcgcttgtgatatggttgcaatctggctgtaatggcctctggggggtggtgaatgttactgactatcctctagtatgagggaccatgagggaccctctctaatattccttttgggatctttgagataggcaaagccctaatccgcagatttcctctcacctcctcggtctctgcaacaggtgagcccagtatctttcaactgaggtcctgttgactgtgttctgcacactgggctcttccctctagcccttactgttggcctttggtgaaggcacatccacgtgccctttctgcctcctcaatctgacagttgtcctgttctgacctgggcaaggagttgagggggcaaagccaatctcatagctgcataagtggttttgcaacttcttagttctgtaaatctccagaaagcagacatactatcatcttactagcctcatagccaccttgtgctggggcatctcttctcttactttaaacaccctgggggcttatggtccccatttaaaacaaggaaatgagattctctgagaggtgaagcagataaccaaggtcactgctagtataaacatgcatgtgcaagtgtctttttcatataatcacttcttttcctctgggtagacacccagtagtgggattgctgggtcaaatggcagatctacttttagttctttgaggaatctccatactgttttgcataatggttgtactagtttacattcccaccagcagtataaaagtgttccttttcaccacctgcatgccaacatctgtcattttttaatttttaaattatggccattcttaacaggagtaaggtggtatctcattgtgtttttaatttgcatttccctgattactagggatgttgagcatgttttttcatatgtttgttgaccatttgtctatcttcttttgagaactgtctattcatgtcctctgccccactttttgatgggattatttgttttttttcttgctgatttgtatgagttccttgtcgattctggatattggtcctttgtcagatgcatagtttgcaaagattttcccccactctgtggattgtctgtttactctgctgattatttcttttgctgtgcagaagctttttagtttaattaggtcccatttatttatttttgtttttgttgcatttgctttgggatcttagtcatgaattctttgcctatgtcaatgtctagaagaatttttcgaatgttatcttctagaatttttatggtttcaagttagatttcagtctttgatctatcttgagtttattttattattattattctttttgagacggagtctcgctctgtcaccaggcgggagtgcagtggcgcgatctcggctcactgcaacctttgcctcccagattcaagcaattctcctgcctcggcctcctgagtagctaggactacaggcacgcaccaccatgcccagctaattttttgtatttttagtagagacagggtttcaccatgttggccaggatggtctcaatctcttgggctcatgacccgcccgcctcagcctcccaaagtgctgcgattacaggcatgagccaccgcacctggccgagtttatttttgtgtaagatgagagctgaggatccagtttcattattctacatgaattatcacattgatttttcccgcagccttttctgataatgatcaaacagaggaaaagcctgggatttgatccacattgttttccgggcacatggagttctctgatgcaccagcctccacatctgtgctaaggccaggtcttactttgctataagtacctttgtttggggatcaagataattggcatggaattaactatatata

SEQ ID NO: 50 - DNA, 41680 bp, Homo sapiens
cgtgtcagttcatctttctacatttaacatttactgaaggtagcagaagtaacgttttggaagaaaaggatgtttggtaaatcagaacactatttcttgcaataactaaagatcattaataacatttcttccaaacttccccctccccaactccaactccagaaataaccaactagtttgataattactagaagaaaaaaagagaaacaattgtaatatttatacagacataaaggaatggtctggtaaatatggtacaaacaatgaaataaaacacggcaactgagcactatctattatattggtagttaacaaaaagcaaaatacaaaattgcaccttctcaacaccaaaaaaattgcagattttgccattacttttagaatggtaaaaactgcattacttttgcaccaacccaaaacaattatctataataaagtcatgaatatatatattgtcaatttgtcactaataaaattattttggtggtattttgttccatttcttcttacaggggtaattttttctgttatacctcaaatgtaactggcttaaactgatttcttttttcaaccaaatatgtgtctttggaaacaaacattctaatggcatgcctctatacatatctacctagttcaagggaatgcagtttgggagactgtgtgtacatgtgtgcacactcctgtgcgtacatgttaaagtgtaacgtgatccacctgaaatgtacatgcagctgtttatatcatgtagccatccatttcatgataaatatgtttggaaataaatttgtagtactacctcccaacagcaaatcttatttccttttagtttcagtaatagtatttagtattagttgtcactaataaggattatttttaatttgcagatggaaagcttcttcctttccatccataaatcgagtgtttcttctcaaaggcaatggttctcaaactttagtatgcaacagaatcacctgaggagcttttctttttttgagatggagtctcgctctgtcgcccaggctggagggcagtggcgcgatctctgctcactgcaagctccgcctcccgggttcaggccattctcctgcctcaccctcccgagtagctgggactacaggcacccgccaccactcaaaatcctggtccttatctgcaaagattctatttcagtgggcctatgacggagccaagaattctgcatttttaaggcaacttgctgtcctttgagaaacattgcactgaagtatttgggaactttgtttcactgtgatagctgtctgggacttaaatcttccgccaaaggaaaacctggaaaattttgtgattgagcaagcaaatcaagcccatgcgtagtagtagactgggaaccggtgggtgtgagacccaggctctatgtggcctacactcttctgaactcttctgagtcttgattcctggtctgtgaagtgtgcagtgtatccgaattaaatgagaaaatcattccgtgcttttagggtgagtttgaataacttttaggcagtccaccagatggcgatataacttttttttcaaatggagtggttagcctgccgaagttgtgagagtcagtcctacaacattcctagcagatcaagattttatgttcccagttctggcttcagagactgtagcgataacacagggctcatgcagtccaacatcccgtataatacaggttgccagttgttgccttttcagtatttctcctgtgtgatcctggactgcttgtgtcagattcacacaggagcatttgcttacaaatgcagcttccagggccctgcttcagacgtactgaccgagaatctctggaactggttcttcagtatctgctttgcaaaaacaatccgtaagtgctcaacaaacaggttaaagtctgagagccacgtgccagtgaaaaggaggttcacgtcttgctgaagccaccccttattagctgttttgttagaattcctccctcggtgagagtgggattaaggattcagggatgctagttctgccctcttgaggccacactgaagagatcaacttcctttttcttgggaaatgtctgaacattttgaaggtcgctaatcatgacttacctcacctccgcccctatcttctctgggggtggggaagaagtcatactttgcattacaggttggctgtcatcctccttccctttccaggaacactataaccagagactaagagcgaggaccttcactatttcttagctttgtgatcgtgagcaaataacataaactctttgagcctcaatttcctcttctgtaaaatacgagtgaaaataattatacctacttcaaaggattgttatgattattacatggggtgatgaatgcaaagtgaaaaggtaaaatatagcaaaatgtgatctattattaacaataatgagcttcagtttctacatctgtaaaatggtgatgataactactagagcatggggagaattaaatgaggtaatataagtaaggtagttggttaatgtctgacttagaagaggctctcaatagtagtaattataagatggccaataatgtaaaaacaccaatggtctatgcccctaatgatgtgggattttaaaaatcactgaagtaatgagattagcaatttccttactgttatcctgtaggatcagccttagaacaagtataaaacttgtatctcttctatactaagttccttttagaaaatgtttcttaatgaatccacaattatttaataaaacacaaagtattcaatttttaagtattaattcctcacagaaattgctttctaaagttttaagggtgcaaaaaacattaaaaatctttcagtaagctaaaactttaattaggcccttatataattcttgctaaagagagagaatggaactgagactgtgaaatgaaatgacaatgataatatttcctttgaaatttttaaggccaagttgcattaatgcaactttgaaattgttccaatcacacaaggtatttaattaaagcaaatgaaaggctcttcaattcccataaagatttacatggtaggaaaaatgtttctgttttagcaggtctataacatcatttttaaaaattacaaaaattattgtatctacttttaaagctggacagcaatagttatagagagaatcatttaattttagagtcaagcagaccaaattcccatctggctccaccagcgtgttccctttagaaagtaacatttaagagtttcattgcccttgtttgtaaaaaaggggatcatatttgcctccacagtgccgctgaggggtttaaacaaggtgctgaatctagaacacttacagagagcctgtaataagtactcagtgcttaaatgttacctaaaaacaaaggaagatcattagcactaccgtaaaaaattatatatgggtggggcacattggcttgattggtttcgctatatgggtttcaaccaaacgtcttggggaaaaattcggaaggcaataaaaggaaagtggaaaggacaaagaggattggagttggggagggtaagagacagttataagtctgaggaaaaattaggaaatagcatagaattctaattcaaataacttaattacccttgtatttatattttttcttaaagttgttttactttagtgagcagtctttcttctcagattgtgtcttagcatattaatgaaaaaaacagatgataatattactgtacaataagagtttagcagtgattgaaattcagtgtcaatgaagacacagggcaatggagagaaaaatcatagatatgtcatgaaaacagttttagtaatttttcatttcaacaacaaatttcataataatgatataagtacattctttattttatatatatatatgttctttttatagagatggggtctcactgtgttgaccaggctggtcttgaactcctggtctcaagcaatcctcccatcttggcctcccaaagtgctgggattacagatgcgaaccaccatgcctggcctctgaattttaaaatagttatgagtgcctttagaatttctactattggagccctttatgcttctatttaccttcaatcaagatttgcacctcagaaaacatagttacttgttgttgttgttgttgttgttaggaaaagttcagtatgaatgctgttgtctcattctacatagcaattgtttgggtcatgtataataaagaattgatacctactctaaaaatgaagatattttgtgttctaggaattgagtggcacttggtcaaagaatgatttatggaatctctgggcataaggggaattgattgctctttagtttttcttttccacacttagtactaaattattttgaatttatgggaagttaagctaagtgaaccacatctttccattttgttgcaaggagcttatcactttctaaacggagaactatactgtctcggagtaatggattgaatagtggcccccccaaaattatgtccacttcctaaatcgcagaacctgtgaatgttactttgaaaaaaaaagggggtctttgtagatgtcattaagttaaggatctccagatggggaggtgatcctggattatctgagtgggttctaacccagtgacaagagtccttataaaagacacacgaaggactgacacacagagatgagaaagaggcaatgtaaccatggagacagagactggagtgatgtgccacaaatcaaggcaagtttgtagccaccagaagacggaagaggtaagaagtacatcatcccctggcctccagaggagtgtggccctgctaacactctgattttggactcctggcatccaactgcgtgagtataaatttctgttgttttaagccaccaagtttgtggtcatttgttacagcggccacaggaagctaatacacagggtaagctgataggggaatgagagagttttttcacagttgcatgaatgggttaagaattctaaagaataattagccaggtgtggtggtggatgcctgtaatcccagctactcgagaggctgggaggcaggagaatcactggaacccgagaggcggaggttgcagtgagccaagatggcgccactacactctagcctgggcgacagagggcgactctgtctcaaaaaaaaaaaaaaaaagttatttgaaagaataaacattattgggtaaggggagatgacatggtagccattagaaagaggggtggggggagtgaggaaaaaaggcaaaaaacagagaccaggaaggtgaataaccagaatgtgagctaaggagatggaataggaaggacactgtacccaggcagagtatggactgaggagaaaaataaatgatatccctaaatatgttttaatttcagggagttactttgtcttctcatattttactcagatcgctttgtgtgtgtgtgcgtgcgtgtgtgtgtgtgtgtgtgtgtgatgaaatacatattttaattaaatattttacctcagaaacagcctctcagagaatgtttttggataaaatgcaatgttttggtaatattctcttcagaaacattaagttaggatgttagggtgatggaaaaacctcaataaaaaccagtagcttaagtatggagacactcagaactcagtcatcacattgggaagaaaatgagatagtggaaaagaagaaaaagtcacccaggaaagagcccgagaaaacttctaagagtcggagtttttcactgatgcttaccaaagcttagctgtatggaataatggaggaatacatccttttaactttagtcaagctttttaaattctgaaaaggggactctttcacttagagtgctgcagtacaaggaaagcaattgtttggagaaaataggctatgcattctgaaaaaaaatatttctttttggcaagggctatggattcctgtcaatctaaagggatctctaaacttagggagagggtaggaagtagctctgccctctgagaggctctattttattctgaaaggccgaatgtgacaaaagcagctttaatgatcagacagagctgaggtatccaaagctacatataaaatagaagcttaggacacctgaaaaaacagacaagaattaacacaatagcaaacaaaatggcagactcaatcactgcacctggccgaaatatttctatgaagtcagagtttagctgggtaccagagcaattttctccctaaaattgggtaatgaaaatttgaacagaagaggtggtatgtgctgattaattttatgtgttaacttgactgggctgaaggatgcccagatagctggtaaaacattatttctggatgtatctgtgaagatgtttccagaagaggttagtatttgaattggtaggctgagtaaagtagattactctcaccaatgtggtggttagagagtccatcaaccaacccagtgaggactcgaatagaagaaaaaggtggaggaaaggcaaatttgttctcttttcttgagctggcacatccatcttctcccatccttggatgacagaatttctggttctctgatcttcacacttgggctaaattacccactggctttccaaattctccaacttgcagatagcaggttgcagagcttctcagcctctgtaatcacatgagctaattcccataattaatctctgtctctgtctctctctttttctttcacttaataaatatggagatttattgaagaaccaagaggatataccactggttctgtttctctggtgaatcttaatacataaggttaaaatagattaacattagaagcgaaaagtgaaaatgcctcaaaatatattttaaaacttctacttcaaactatagaaaacacgatttcttggtcatcaaatcatggaagaacatctcattcttggaatatgttgaggtatatgagaaatcttctcattgcttctcagaattcttagcacctgcaaaaccattattttgtttatataatcttacagaaatgttacccaactactagattcacgtgaaataattttttcttttgatagaaaaccagcgaggtcagtaatttctgtcgggagaaagagcaggagaaacaattctccttacatgaattcttaggtgtccagttgaaaacattccagaagagggggtggaccatggatggtgggaagcacaaacttcagagccagatccccaaagtttggtgaaaaggccaggaaaagcaccaaataaacacacagccatgcagcccttaacaagtctactttgtaaaagcaattttgttaatctctttcttcaggaaacactttttcttgtggcggtatttactttgttaaacgaagaaagttccctgccttctctctctccagttagggctaaaacctggacactgacagagctaatgtatgtttgatctaatcagtcaagatcaagtgggggaaagcaataaaaataaatttcaaaatgttctctatcaaaaatttttcaagaaaaatgttctaattaagaatctccctcaagtatgtttctgtacaattggaccagtgaactgggactggaagtgtcaagagggttgtagaaatgaaagtattgcctcattttctgatttttgttcccacctacaggagctcccacagtgttctactctttccattttagggagaagatgtagagcagtacaacttttttccctctatgacatgtcccagacctttccgaactctttagtgcctctgattattagtaaacaattcaagcttactgatggagactgtaactttgatgtcatttttcttctccttggtttacagccaggaatcattgcatgtcttccaggtattggcaggaacacatacatttcccaagcatataggtgggattagtataaaataaacttatgaggcctttcatattttatgttgcctcagaccaggtaagttttgtcttaattttctgattatcctgagatgtttctccatttactccattgaatctacttgactctgagttctttttttctttattcttctctattcttattctttttttttaaattcttgatggtgataatatctcttcgcttcaagtgataatgttcattccttaccctgttagatatttttaatataattcttataaacttcttaattttctcaaaggcccatgcctctatgataatgatcagcacttgtttaatttgaaaatgtcaggcatatgtaagaggttcaattgcccaggagctcataactccttactcattcattaaaaacaaatcatcgggatgctcctgctctaatgtttagagcctttcttttaacaaatggcctcttaattttcatggtagaaaagacttttttttccttctgtgatacagaacagttttcaattatttagtcgtcatgagctgaagcagggtagccgtagatatgctagactatttttctacaataaccccagcatgtcctttatttaggagaaattttgactgatggtggaaagaaatttaaagtactcctgcattaaatgaagttatgattcatactaacagtgaaaatgattatttgaatctcagaaggcatacatttctaaaacaatgtttgttttgattatcttctaagagaatatcgagatttacaaaatttattctttctttcatttcattgtatcatccttttcctatgtgaacaatctcacatggcttttccttctttcagagtggatttggtattttttctctttcatttgtatgctttccatttactttgtatttaaagacaatctcaaacttgtaaaaagttacaagtacagtaaaagaactttcttttgaaattttttgagtgtagttgctaacatgctcattcaacttacctgactacttctatgtattccactacaaacaagaatgtttcctacaaacattcttctacataaccatattaccatcaaagtcagcaaattaacagtgataggttactaccatataatcctcaaattctttcaagtttcctcaattttctcaatgatgtccttcatagcaaagggatccagttcagcgtcatgtgtttcattttgttgtcatatctgtttggttttcttcaatgtggaacagttccctagtctttcttggcctttatgaccttaacacttttgaagattacaggccaattattttgtagaatagctctcaatttgagttcacctaatgttttcttatgaatagatttaggtttgcatctttgataggaatatcatagcaatggtgacaattttgattcacctcattactggtgatgttaactttggtcactgattggtgtctgctagacttctccactgtaaagttactctttcttccctttgtaattaataaatattttgtaaggtggtactttgagactatgcaaatatcctgttcctcatcagactttcaatttgtccattcatttatttatttcagtgtggactcatgggttcctattttattcagtaggttaaaaccagttgctttcattatttagtttgatgctcagtgtgggggttcaataaggctggtgggaaaaatattaaagatagttatagtaatagccacaaactctcttggaaggcctgagagtttgtataacatcagtaatagatctggctgaaggcggcctggtccctttacctttagttaaataagttaaagtagtaactaaggaatgtggggaagttatctagctagcttgtttactcatgtggtcttaagactaacctttgatgtacggcaggtgcttaattgctttctacttgggaattccacagtgtcaattaccctctagtggtgttgactcaagcctttgtcaattaatcttccccaaataaatgtgagtctcactagctggtcagggccacagtcacaactgtttacagtactctccagggagtctgtaagtggcttggacactcagctggactggcaaagcagaatatctgtgtgtcagtgtacttcattcatccatggctggctcagggtctgcgggtcagaccgccccaagtgagaactctttcaagagtctttttgatatgttctcataagtctttcagtgcttctttacttcctggcaaagatgtcccaggctcatcttatagtttccctgccctagacttgggatcagccatttctccaaggagacttggatcctgttttggagtatggtcttcagaaaagatgtcagaaccaggtgtgctcattgttactgagggcttgttacttcctgttttcaatggacagagctagttaatatatatatatacttatatacatacataagcacatttttacacctatacttctatatccctattgaaaaccatgggttcactttgatatctccaattccaatctaacagcacagggctcattcatgttttctctccttctatatttgaaacttccttctccaatagtgagaagtcttgatatatttttgatcaagccttctgtatgtcaccagtctgtcattgctgctgcatcccacactccctgtgcaatgctttccctacctgcttgggcttcaatatcccacaccaggcttctcctctcgttgatgttcttcttgctctacttgagctccattacccctaactagtccagcatcctcaccttgcctgggctttagcactctgatttgggtaaccacaggattccccctatccttgccatattcatttctcttgccacttagtggcctttggattgatctgaacaaggaaaggataaaagagaagttatcattttattttcaagttagtatttgctgagtactatttatcaagctctgtattatctcattttagtgacataatgaacttgattacattttactaattgaagcagtcaagatgaaagaagttgtcacttgccagactccacagccagtaagtggcagatccaggactggatgttgtcttgctgactataaaccaatgttccacttggaagctgtgtatgtgtgattcatagaaaaagtggttaattttcaaaggcaataatcatagaattggtagtgtataaattttttggggatataattgtcagatgtctcaattacaagcccaagatagatgaggcagtattaatttgctaattacatattttgaaaagattgtacataaagaaaatgttttctctttaattacggcattaaggatttcaaaaggtactttataatttataccatttcatttcataattttatttcttttctctgtgttttaaagcatgttctaagggttaaacttttaaactttaaactacacagtgaatcactttcttttcttttctttttttttatttttttgagatggagactcagtctgtctcccaggctggagtgcaatggtgcaatctcagctcactgtgacctttgcctcccaggttcaagcgattctcctgtctcagcctcctgagtagctgggattacaaacatgctccactacacctggctaatttttgtatttttagtagagacagcgtttcacagtcttggtcaggctggtctcgaactcctgacctcaggtgatccacccgccttggccttccaaaatgctgggattacaggcatgagccaccgcgcctggcctgtgaatcactttcaataagcctttccataatttagaaaaagacatataagaaggaagatttcttacgctgtttgccttttgttaaataatggtgacccagtttctaaaaggaaccagtttctaaaaggaaaacctgagtaattacttagaagaggctggctttctaaacttagttaacagctattattatttaattgtcagttttacagtaacttggtaagtttcctgcttaatctaactactctaaattgtactaaaaaacctaccctgttccctgcattgtatttttcatgtctttacaagcttgcactgaggccttaccttcctacattattggccagcttatgtaatgcccatgccaggcaaccaccatttgctttctacaaggtgtctcatttaaatttcagaactacattcttattctgtagttccattgttactccaattttataggtgaaaaaactgaaactcagtggggtaaagtaacttgaccaaaatcacatttctaggataacaatggcttcttctgcaataccttctgaaggacctacctgaggctgttttacagttaacttttttaaataagataaatagttgggacttaattaaactaaagggcttttgcatggcaaaaggaacagtcagcagggtaaacagacaacccacagagtgggagaaaatcttcacaatctatacatctgacaaaggactaatatccggaatctacaacaaactcaaacaaaccagtaagaaaaaaaaatcccatcaaaaagtgggcaaaggacatgaatagacaattctcaaaagaagatatacaaatggtcaatgaacatacatgaaaaaatgctcagcatcactaatgatcagggaaatgcaaatcaaaaccacaatgtgataccaccttactcctgcaagaatggccataatcaaaatattaaaaaatggccaggcatggtggcttatgcctgtaatcccagcactttgggaggccgaggcagatcacctgaggtcgggagtttgagaccagcctggccaacatggtgaaaccctgtctctactgcaaatacaaaaattagcctggcgtggtggcaggtgcctgtaatcccagctactcgggaggctgagggaggagaatcatatgaacctgggaggccaaggttgcggtgagccgagatcgtgctattgcactacagcctgggggacaagagcgagacttcgtctcaaaaaaaaaaaaaattaaaaaacagtagatgttggcatggatgtggtgatcagggaacacttccacactgctggtgggaatgtaaactagcacagccactatggaaaacaccgtggagattccttaaagaactaaaagtagaactaccatttaatccagcaatcacactactgggtatctatccagaggaattgaagtcattatatgaaaaagatacttgcacatgcatgtttgtaacagtacaatttgcaattgtgaaatcatggaactaacccaaatgcccgtcaatgagtggaaaaagaaactgtgtgtgtgtgtgtgtgtgtgtgtgtgtgtgtgtatatatatatatatatatatatatatatatatatatatatatatatgatggaatactactcagccataaaaaggaatgaattaatggcatttgcagtgacctggatgtgattggagactattattctaagtgatgtaactcaggaatggaaaaccaaacatcatatgttctcactgatatgtgagagctaagctatgaagacgcaaaggcataagaatgatacaatggactttggggacttggggggaagggtgtgaggggagtgagggataaaagactacaaatagggtacagcatatactgcttgggttatgagtgctccaaaatctcacaaatcaccactaaagaacttactgatataactaaataccacctgtactccaataacttatggaaaaacaaaatatttttttttttgagatgcagtctcactctgtcgcccaggctggagtgcagtggtgtgatattggctcactgcaagctctgcctcccaggttcacaccattctcctgcctcagcctcccaagtagctgggactacaggcgcccaccaccatgcctggctaattttttgcatttttagtagagatggggtttcactgtgttagtcaggatggtcttgatctcccggcctcatgattcacatgccttggcctcccaaagtgctgacattacaggcgtgagccaccgtgcccggcccaaaaaaattttttaaaaaaagatcagtaagatcttatacaaaaatagtggacatgaaaacactataaatcaattgaacataaaagatgtatacagaacgctctaccccaaaacaacataatatacatttttatcaaagcacatagaacattccccaggacagaccatatgttaagtcacaaaataattttaataaatttttaaaggattaaaatcatacaaagtattttatctgaccacaaggaatgaaattagaagtaaaaaatagaaagaaattggaaaatttgcaaatacataaaaattaaacagcacattttacaacaaccaatatgttaaacaagaaatcgcaagataaattagaaaatacttagagatgaatgaaaataaaaatacaaactaataaaacttatagggtgcagttaatgcagtactcagagggaaattatagctgtaaacccatacattaaaaaatgaagatggatctcaagttaataatataacttataatgtaacttaaagaactaaaaaaagaacaaactaaagcaaacctaacagaaggaaggaaataattaagattagattagtgataaataaaatagagaatagaaaagcaattgagggagttaatggaaacaaaagttggctctttgaaaagatcaacaaaattgacaaacttttaaagctggaccaattttaaaaagagagaagactcaagttactaaaataagaagttaaatgaaggcattttcctggacacacaaaaagaaaatggattaaaagagaatactatggacaattgtataccaacacattagaaaacctggatgaaatgggcaagaaacacacaaaccctgaaatctgactcaagaagaaatggaaaatctgaacatatctgtaaaagtggatatgtttacaccttctaaacactttacttcttctaaaaagacagaatcagtaatcagaagcctcccgacaaagaaaagcccaagaccagatggtctcattggtgatttctgcctaacatttgcagaagaatgaacaccaatccctttcaaactcttcaagagatagaaggggagaaaacactttctaaccgattttttgaggccaacattaccctgatatgaaagccagacaaagacacctcaagacaagaaaaccacaaaccaacattccctatgaaaacatatgcaaaaatagtcaatgtatactagtaaaccaaatcaagtaacataccaaaaaggctatacactatgattaagttgaatatatcacaggaatacaagggtggctcaccttatggacattattcaatgtaatacaccaccgtaacaagatgaaggtgaaaatgaatgaccatcttgatttatgcaaagtatttgacaatcacaagaatgacaagaatactcaacaaattagaaatagaatggaacttacttaacatgatgtagagacctaattagagaaaaggagtcaggctggcaggaccaagggaaagcaaaaagatagaacaaataaactataaatatggctttcttcatagttatataaacaaaagaggaattaaatgaattataggtctgtttttctttatggcccaagacatatagccctcctgaacaaataaaatacataacttacaaacttcctgcttgccataaaatgcctcaatttatcaaacatcctggctgacagaagaatgcaagtttccaagttccatcctataaaatctccagcaagcctttgtttctttgcagtcagctcctcttctgctggcttgcacattgcctcctcacaacatgttttcatactttctttaataaatctgcctttctttacctacaattgtcttggtaaattcttttatctctacaccaccaacccagatagtcatcactcacctacaacacatgataaacggcatttagggaaaacacatagctacatcatactccatgaagaatgaataaaagctttcccctaagtataggaaaaatacacgatgcctgcttttgtcccttctattcagtactgaaagttctggctagaacaattatgcaagaaaaaaacaaacgaataaaacagatccaaattataaaggaaggagtaaaactatttgcagatcatatgatcctatagataggaaatcttaaaagatatacacacacaaactattagagctaataaattcaggaaagtattgagtatataactagcacttaaaacttagttttgtcaacatgctgttcgctatgttaaaaaaaaagattagttttgtttctactcatagcaatgaataatccaaaactaaattaagaaaataatttcagaagggtggagcaagatggcacaatagaaaactccactgattgtccctcaatgctagcacaccaagctgtctacacagacaaaacaccttcataagaatgaaaaatcaagtgaccactcatagtacctggttttaaattcatattgctgaaagaagcactgaagaggttaaaaaaaaaaaaaagccctgaatcgcagacaccacccctcccttacccctggcagcagcagtgggcatctctgggtactgggggagggagaacacaccaactgtgaagcattgaaagtgctgttctattagagcagaaaggaaacccagaccaaactcaactgacctgcctgcaaagggagggacccagtgatctaaacttgagttcctgcaaacctcaccaccacgggctacagcaccgtgtgtctccaagtaaacttgaaaggcagtctaggcgataaggattgcaacttgtaggtgagtcctggggctgaattaggcccagagacagtggactagggggacacgtgacatactgagacaccggccgggtcagctaaggaagtactggcatcacccttcccctaaccccaggctgcacagcttgtggcttcaaagagaacccctgtcttctgtttgaggagaacagagggaagagtagggagaactttgtcttgcatctaggatcccagcccagccacagcaggatagggcactggtcagaattgtgaggcccctattccaggccctggttcccagacaacttttctagatatgctctgggccagaagataactggcagccttgaaggaaaggacccagtactgctaccattaatcacttgctaatcaaagagcccttgtgccctaaaaaaccagcagcaatatctaggtactacatccagggccttgggtgaacttctgagatttgatgacttcaggtgagactcaggacataaccagctatggtggctatgtgaccaaactccttccacttgagaaaagcagagggaaaagtaaagaagactttgtcttacatcttagatactagtatggtcacagttgtgtagagcaccaagcaggctcttggggtcctcaatcccaggacttgactcttggatgacatttctggacctgccctgggccagagcggtacccactgccctgaaagatgagtccctggccaggcagcattcaccacaagcttgcttaaaataccttgggccttaacagaacaccgtggtagtctggcagtattcttcatggcctggggtggcagtagctatggtgaggctcctcttcctttggaaaggggagggaagagtgggaagaaatgcattgtgtggtttgagtgccagctcagctgaatgcaacagaacaccatgtagacttctaaggtttttgactctagtccctgactcccaggtggcacttctgaacccacctggggcttgggggaccttgctgctctgaagagaaggacacaggcctgactggctttaccacctgctgattgtagagccccagggccttgagtaaacataagaagtagccagggaaaagttacagtgggccttgggcaagaaccagctctgttctggcttcaggtttgacccggtgcagtcatagtggtggtggccacaggggtgcttgtgtcactccgtccaaatctttaggtggctcagaacagagagagagactctgtatgtttgagataaagtaagggaagggaacaagggtctctgccttgttcccttttctagaattttctctagccagaaaattctcctagatcttgttcaagattagcaagatggtacctctgcaatactgcaagaaccacagcattactgggcttgggttgcccactaaagcagatacagcttagatcacaaaacccaagtcctttcaaatatctgaaaagccttcgcaagaaggatggctacaaataagcttagacagtgaagactacaataaatacctaatcattcaatgcaagactttgaagaacatctactagcatcgatgccatccaggaaaatgtgacctaaccaaataaggcactaggaccaatcctggagaaacatatatgtgacctttcagacagagaattcaaaatagctatgttgaagaaactcaaagaaattcaagataacaccaagaaggaattcagaattctatcagataaatttaacaaagagattgaaataattaaaaagaaccaagcagaaattctggagttgaaaaatgcaaactactaaagaatacattaaagtcctttaatggcagaattgaacaagcagaagaaagaattagtgagcttgaagacaggctaattgaaaacacatagaggagacaaaacaagattctaaaagcagcaggataaaagaaagaaataacatacaatggagctccaatacatatggcagcaggcttttaagtggaaaccttagaggccaggagaaagaggcatgacatatttaacgtgatgaaggaagaaaactttcagcctagaatagtattatccagtgaaaatgtccttcaaacatgaagaataaagactttcccagacaaacaaaagctgaggaatttcatcaataccagacttctcctacaagaaatgctaaagggagtacttcaatccaaaagaaaaggaagttaaaaagcaataagtaatcacctgaaggtaccaaacccatggataatagtaagtacacagaaacacagaatattataacactgtaactgtggtgtgtaaactacccttatcctaagtagaaagactaaatgatgaactaaagactaaagaaatcaataaaaaataacaactacaataactcttcaagacatagtcaatacaaggtataaatagagacaaaaaaactgttaaaaagcaggtggatgaagttaaggcatagagttcgtattagttttctttttgcttatttgtgtatacaaatagtgttaagttgttatcacattaaaataatgggttataagatagtatttgttggccgggcacagtggctcatgcctgtaatcccagcactttgggaggccaaggcaggcagatcacaaggtcaggagattaagaccatcccggctaacacggtgaaacctcgtctctgctaaaaatacaaaaaattagccaggtgtggtggcatatgcctgtagttccagctactcgggaggctgaggcaggagaatcgcttgaacccaggaggcagaggttgcagtgagccaagattgagccactgcactccagcctgggtgacagagtgagactccacctcaaaaaaaaaaaaaaaaatagtatttgtgaccttcatggtaatctcaaaccaaaaaaacatgcaatggatgcacaaaaaataaaaagcaagaaactaagtcttatcaccagagaaaatcaccttcactagaggaagacaggaaggaaagaaagaaggaagaaatgaccacaaaacaactaggaaacaaataacaaaatagcaggagtaagtattcacttcttaatgacaacattgaatgtaaatggactaaactctccaatcgaaagacatagactggctgaatgaataaaaaaaaagatctattgatctgctgcctataagaaacacacttcacctataaagacacacataggctgaaaataaagggacagaaaaagatatttcatgccaatggaaaccaaaaaagagcaggagtcactatatttgtatcagatgaaatagattttaatcaaaaactataagaagagacaaagaggttactatgtaacaataaagtggtgtattagtccgttttcatgttgctgataaggacatacctgagactgggaagaaaaagaggtttaattggatttacagttccacatggctaaggagccctcagaatcatggtgggaggtgaaagacacttcttacatggtggcagcaagagaaaaatgaggaagaaacaaaagcagaaacccctgataaacccatcagatctcatgagacttatccattatcatgagaatagcatgggaaagactggcccccatgattcaattacctcccccgggtctctcccacaacatgtgggaattctgggagatacaattcaaattgagatttgggtggggacacagccaaaccatataattccacccctggcccctccaaatctcacatcctaacatttcaaaaccaatcataccttcccaacagtcccctaaagtcttaactcatttcagcattaacccaaaagtccacagtcggaagactcatctgagacatggcaagtcccttccaccaatgagcctgtaaaatcacaagcaagctttacttcctggatacaatgggggtattgggtaaatacagccattccaaatgggagaagttggccaaaacaaaggggttacggggcccatgaagtctgaaatccagagaggcagtcaaattgtaaagctccaaaatgatctcctttgactccaggtctcacatccaggttacgctgatgcaagagatgggttcccatggtcttggacagctctgcccctgtggctttgcagggtagagccttccttcaggctgctttcatgggctggcattgagtgtctgaggcttttccaggtgcacggtgcaagctgtcggttgatctaccattctgggttctggagaacagtggccctcttcttacacctccactaggcagtgccccagtagagactgtgtgtgggggctccaaccccacatttcccttctgcactgccctagcagaggttctccatgagggccctacccctgtagcacacttttgcctgtgcatccaggtgtttccattcatcttctgaaatctaggtggaggttcccaaacctcaattcttgacttctgtgcacccacatgctcaacaccatgtggaagctgcctaggcttggggcttccaccctctgaagccacagcccgagctgtatattggcccctttaagccacagctagagcagctgggacaagtggaccaagtccctaggctgcacacaacctggagaccctgggcctggcccatgaaaccattatttcttcctgggcctctgggcctgtgatgggaggggcgccatgaaggtctctgacatggcctggagacattttccccatggtcttggggattaacattagactccctgatacttatgcaaatttctgcagccagcttgaatttctccccagaaaaatgggtttttcttttctatcacttagtcaggctgcaaattttccaaacattaatgctcttctttctttataaatctgaatgtctttaacggtacccaagttaccgcttgaaggctttgctgcttagaaatttcttctaccagttaccctaaatcatccttctcaagttaaagttccacaaatctctagggcagaggcaaaatgctgccagtctctttgctaaaacataacaagagtcacctttgctccagttctcaaaaagttcctcagctccatatgagaccacctcagcctggacctcatagtccatatcattatcagcattttaggcaaagccattcaacaagtctctaggaagtttcaaactttcccacattctcctatcttcttttgagccctccaaactgttccaacctctgtctgtaatcccagcacgggcaaatttcttactgtctgtgagactcacttaaaattataataggtgtacccaactaataaacgaagtcatttgatcttatgagtaagcaatgatatggggagagctcaacttctcttttgcttctttttcataaccactctttgttgtctatgctggacatatatttagcatgaagaaggatatccagtagtcctttcttatccacagggaatatgttgcaaaacctccagtggatgcttcaaactttggatagtactgaactcaatcgttgtcaattggaacattttctgtcgatgtcttccacccgcaaatttaatgccttttccatcttaactaagcacttatcacacactgtggatgtaacttttacagtttgagatgtgagcaaaactagcaaaattttttttccttcagcgtttaatggatagaagattcattcttactgtagatattagcaacctagtatatgacttttccccttattaagtcaagaattttcaccttttcacttaaaggaagcactttacaacttctctttggtgtatctgaattgccagcatcactcttcttgaactttggggccattattaagtaaagtaagagttacttgaatataagcgtgtggtattatgatacatctgataatgaaggcagctactaagtgactaacaggcaggtactgtctatagtgtggatatcctgaacaaaggaataatttacgtcctgagtgggatgaagtggtgcaagatttaatcacccaattcagaatgatgtgcaattcaaaatttatgaattgtttatttctggaattttccatttattattttcagattgcagttggctgtggataaccgaaactgcagaaagtgaagctgtggataagggacggacaacagtgcatcacattaacagaatgaaaaacaaaaaccatataatcatcttggtacatgcagaaaaaacatttgataaaattcaacctccctttatgatttaaaaaaccaacaaattaagtatacaaagaatataactcaaggaaataaagtccatatatgaaaaacctacagctaacatcatattcaatgttgaaaagctgaaagttttttctcagtatcagaaacaagacaaagatgcccactcttaactcttctattcaacatattcctgcaagttcctagccagaccaattaggaaaaaaaaagtcatgtaaataacatttgacccagccatccccttattgggtatatacccaaaggaatataaatcatgctgctgtaaagacacctgcacacatatgtttattgcggcactactcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacactgcatgttctcactcataggtgggaactgaacaatgagaacacttggacacaggaaggggaacatcacacactggggcctgttgtggggtggggggaggggggagggatagcattaggagatatacccaatgtaaatgacaagttaatgggtgcagcacaccaacatggcacatatgtacacatgtaacaaacctgcatgttgtgtacatgtaccctagaacttagagtataattatatatatatatatatatataaagaaaagtaagaagtgaaattgtctctctttgctgatggcatgatcttctatatacaaaaccctaaagactccaccaaaaaactggtagaattagtaaacaaattcagtaaagttgtaggatacaaaatcaacacagaaaaattaggagcatttctatatactaacagtgacctatctgaaaaggaaatttaaaaaaattccatttacagtagtatcaaaagaataaaaacaattttatttaaaatttagaagtaaattttttaaaatttaggaataaatttaataatttaataatagaagataaaacttagaaataaatctaactaagagggtgaaatatctgtacactggaaattatgaaacattgatgaaagaaattgaaaagacacaaataaatggaaacatataccagttcacgggttggaagaattaatattgttaaaatgtccatactacccaaagtgatctacagattcaatgcaatctctacaaaatttcaatgttatttttcacattagaggtagaaacaatccaaaaatttatatgaaactaccaaagacactgcctgaatagccaaagcaatcttgaacagaaagaacaacatttgaggcattatgctacctgacttcaaaatatattacaaagctatagtaattaaaacagcatagtattgtcacacagacagacacacaaaccaatgagacagaataaataatagaattaaacccatgcatttatggtcacttgatttttgacaaaggtatcaagaaaatacaatggggataagacactcttcaataaatggtgttggaaaaactggatatccacatgcagaataatgaaattggacatttatctcacaccctgtatgcaaatcaactgaaattagattaaatacttaaatgtaagacccgaaactgtaatagtcccagaagaaaacataggggaaacgctccatgactttgttctgggcaatgattttttagatataacccctaaagcacaggcaacagaaacaaaaatacacaaatgggactgtatcaaactaaaaagcttctgcacagcataggaagcaagtaatagagtaaagagataacctacagaatggaagaaaatatttgcaacatacatctgaaaaggggttaatatccaaaatatataaagtactcaaagttcaataataagaaaataagtaatccaattttaaaagggcccaaatagatgtttctcaaaagaagacatataattgggcaacaggtatatgaaaaaatgttcaacatcaataattatcagcaaaatgcaaaataaaaccaaaatgagacaccatctcaaatctgttaggatggttattataaaaaagacaagaggtaacaagttttggtgaggatgtgaacaaaaaaccccttgtatgctgctggtgggaatgtaaattagtacagccattatggaagacaccatggaggttcctcagaaaactatatgatccagcaatcccacttctgggcatatccaaaggaactgaaatcaggatcaaagaaacatctgcactcccatgttcatttcagcattattcacaatagccaagctatggaagcaacccaagtgtccatcagtagatgaatgtataaagaaaccatggtatgcatacccaatggaatactatttggccagaagaaagaatgaaatcaagtcatctgcagcaacatggatggaactgaaggttatcatgttaagtgaaataagccagactcagaaagacaactattgcatgacctcacctatatatggaatataaaaaaataaaactcatgaaagtaaagagtagaatagaagtcaccagaggatgaggggaaatacggagtcgttcatcaaaaggtacaaaatttctgttagacaggaagaacaagttttgaagatctattgcacagcacaatgaccatagttaataatgtaatgtatatttcaaaattgctaagagagattttatgagctcataccacaaatgttaaatatgtgatgaatatgttaattttagcttgatttaattattccataatgtatacacatatcaaaacatcactttgtatgtcataaatatataccattgttttttgtcaagtatttataaaaaaacttgtcatgttaaaaaaggcacatgcataccttcaaactagaaaaattctacttattgtttctggcttagaaaaataatcatagatgtatgtaaagattcatatgtaataatgttcatcttaatatttttatacacaatgaaaagttgaatataagctaaatgtttaattgtagctactaaaaattaggttttagaagaatattcaatgatatacaaaataaacattacattaaaaagaaaaaagaattgaaagtaaagtgatggaaacattaacaattaaaaattaatcaagtgaaaacttttatagctataataatactaaattggtctttgaggaagcactactagtaatgaataaattactttaataaaattatcaattaaaagtaatggccagaaattctaattttatgtaaaattaatttcatggcttcaaatgtatatataatgggataagatgacagaagtataattaaaaaacaaaagaaatccaggtacatagttggaaatcttaacacaattctctcaacaataaatagaagatagaagagttaaaaacatttatatatttattcatgaacaacatgaataatggacttaagaaactcatatgtaatgataattgaatttaagtaacatatataacactacactctcagcctaaaaaacacatatttctttcaagtttacatgcaacagatatctgaaaagaccataaactgggccattataatgatattgggaaaaaagcttctaagtttggaaattatgcaatatactgcaaaataatgccaaagaaaattacgatgaatatttaaaaatagttcatatttaatgatgattaaaatataatatgttaaatttgtggaatgcagctaaaggtgtgctcagtagaaatgtgaagctctaaatacatttgaaaggaaaaaaaattacataaaaagtcagaaccaaatttatcagaactctggaaaatggtcaaagttgagtaacagccaagcaaatgctgaatggagcaaaagacagcataaaaggtagaaattagtaagcattcctcaaaaacattgtaatacaaccaaacaatccacattcacttggtgcaaaatatcagaactgaataaagtaataaatactcaaaagcataaaaggaaaagcagggaacagagtttctttagaaaattggggcactcaaaagcacctatgtgtactaggaatttagaaagtcaagtgcatgcccagggcaggacatacatttagaaaaacactgaggaaaaacagtacagaagtttcccaaaaaattaaaaaataaaacgattatgtaatccagcaatcccactacttggtatacatccaaaggaaatgaaatcagtatgtcaaagaaatacatgtactctcatgtttactgcagcattatttacaataattaagacatggaagcaacctaagtgtccataaaggggtgaatggatatttttaaaaatgcgtcctgtatatacaatgaaatactatccagccttaataaagaaggaaatcctgtcatttgtgacaccatggataagcctggagggcattatgttaagtgaaataagccaggcacaaaaagacacataccgcatgatcttatttatatgtagaatctaaaaaagttgatctcgtggaagaagagagcagaatggtggtttcctgggactcagtagtggggtgagagttggggagatgttggtcaaaggctataaaatttcagctgggtaagaagaataagttcaagatatctgttgtacaacatcatgactatagttaataccaatgcatttttttccttgaaaattcctaacggtagattttgtggtcttaccacatacaaaaatgataaatatgtgaggtaatatgtatgttgattacattaccattccacagtgtatacatatctaaaaacatgttgtacaaaataaatatatacaattttacttgtctatgtaaataaattaaataaagaaagaaaataaaatgtatataataaaagaaaataagaagaaagaacaaacctgagaagaccctcaactttcacctctggctaacagctgggtcagtgcaagctctaagagaaggctaaggcagaattataaacagcctgttaagcattgaaggagtgttccagaactatgctaatctgcaatgattgagagagttttgttttgttttgttttgttttgtttttttgtggtcttttatttcttcatttatttttgggaagggacttgaaatggtacactaaaaaaataaactaaagtcgtttatcagttctaggagcatttgggcagagtcttcagggttttctagtataggatcatattgtcagagaagagagataatttgatttctcccttttctatgccgtttattttgttttctcttgcctgatcgctgtgattagacttccagtactatgctgaataggaatggcgagaatgagcatctttgtcttgttccagctctcaatgggaatgctttcagttgctgctcattcagtatgacattggctgtggattcgtcataggtggccttattattttgaggtatgttccttcaatgaagtttgttgtgggtttttaatcataaaggaatgttggattttatcaaaagctttttccttatagactttagtaaaatttcaagatacaaaatcgatgtacaaaaattagtagcaatttgatacactagtaatattcaagctgagagccaaatcaagaatgcaatcctatttacaatagccacaaaaattaaaatgcctaggaatacatctaaccaagaggtgaaagatctttacaaggagaactacaaaacactgctagaagaaataatagattacacaaacaaatggagaaatattccatgctcacagattagcagaatcagtattgttataattgccagactccccaaggcaatctacagattcagtgctattcttatcaaactaccaatgtcacttttcacacaattagaaaaaactcttctaaaattcatgtggaaccaaaaaggagcccagtcagccaaagccatccctagcaaaaagaacacagtcagaggcatcacattacctgtcttcaaaccacactataagggtatagtaacaaaaacagcatagtactgatacaaaaacagacacatagaccaatgcaacagaatagaggacccagaaataaagccttatacctactgctatctgatcttcgacaaagttgacaaaaacaagcaatgagaaaaggactccctgttcaataaatggtgttgggatagctggctagccacacacaaaggaatgaaactagacccctagccaggcacggtggctcacgcctgtaatcccagcactttggaaggctgaggcgggcagatcacgaggtcaggagattgagaccatcctggctaacatggtgaaatcccgtctctactaaaaatacaaaaattagctgggtgtggtggcaggcacctgtagtcccagctactcgggaggctgaggcaggagaatggcgtgaacccaggaggtggagcttgcagtgagctgagatcacgccactgcactccagcctgggcgacaaggcaagactctgtctcaaaacaaaacaaaacaaaaaaaaactagatccctacatttcaccatatacaaaaattagctcaagaaggattaaagatataaatacaagacttcaaactataagaatcctaaaagaaaacctaggaaacaccattctggacaattggctttgggaaagaatttatgactaagtcctcaaaaacaattgcagcaaaaacaaaaattgacaagtgagacctatttaaactaaagagtttctgcacagcaaaggaaactatcaatagtgtaatgagaaaacatacagagtgggagaaaatgttcacaaacaatccatctgacaaaggtctaatattcagaacctgtaggaaacataaacaaaccaacaagcaaaaaccaaacaaccctattaaaaagtgggcaaagtcatgaacagacacttctcaaaagaagacctctaagtggccaacaagcatatggaaaaatgctcaacattactaagcattagagaaatgcacatcaaaaccacaatgagataccatctcacatcagtcagaatggctattattaaaaagtcaaaaaataacagatgctggtgaggctgcagagaaaagagaatgtttacacactgttggtgggaatgtaaattatcccagccactgtggaaagcaggttggagacttctcaaagaacttaaaatagaattacctttcgatccagtaatcccattactgggtatatagctaaaagaaaataaattattctattgaaaagacatatgcactcatatgttcatcccagtactattcacaatagcaaagacacggaatcaacctagatgtccatcaacaatggacgggataaagaaaatgtggtacatatatatcatggaatactatgcagccataaaaaatgaatcacatcctttgcagccacgtggatgttactggaggccattatcctatgcaaattaatgcaggaacaggaaaccaaatactgcatgttctcacttataagtgggagttaaaaaaatgagtatttgtgaacataaagatggcaaaagtagacactgaagaaagggcggaggaagggaggggtccaagtataacaaatgattgggtactatgctcacaacctgggtgatgggatcaattgtaccccaaacttcagcatcacacaatatacccaggtaagaaaccgcacatgtaccccctgaatctaaaataaaagatgaaataatttaaaaaattaaaaatggactaaacataaaaagaaggtagtaatggaggaaatgagaggggtaaagtataatatagaaagaaaaagtaaaatggcaaaaataagttcttccttaccaatgattactaaatgtaagtgaatttaactccccagtcaaaaagcagagactcctatagagtcatttcagatctaaagatacacataggctgagagtgaaagaatggaaaaacatatttcatacaaataataatgaaaagagatcaaggcagaaatttccccaataatagttggataattcaatattccactttcaataatggataaagcattcatacaggagatcagtaaggacccagagacattgagcaacactaaaaactaaatagacctaacaatatagaacaatacactcaaccagagcagattatatatatattttctcaagagcacacggcatattctccaggatgttaggccacaaaataggtctcagtgaatttaaaaatgttgaaatcacgcaaagcatcttttctgactacaaaaaaaaaaaccaaactaaacaaaactacaaatcaataagagacgaggaactggaagatttacaaatctgtggaattcaacagcacactgttacacatccagcaggtcaaaggagaaatcacaatggaaattataaaatacttagagaggagtgagaataaaagtacaacataccaaaactaatgtgatgtagggaaaggagtgctcaaagggaagtttacaggtgtggacacctacattaaaaagaggaaaaatctcaaattaacataactttacaccttgaagaactaggggaaaagggcaaatgaaactcaaagctagtggaaggaaacaataaagatgagagtagagttcaatgaaattgagatagataaacaatagagagaatcaataaaaacatcagttgattctttgaaaagattaacaaaattgacaaacctttagttagaccagcaaagaaaaccagagaaaacacaaataactaaatccagaaatgaaagtgaggacattacttaccaaccttacagaaataaaaaagattatcagagagaataatgaaaaattattcaccagaaaattaaataaccaaaggcaatggacaaattactacatacgcaaatgaccaaaactgacttaagcagaaaaattgaacaaacctataaatgctaaatgaattgaataaataatcatgaaactctctgtacagggtgacatcagcaagacttttccagctgctgcttgagggtctgacaccagggagttctaatttctggagggatccaaaaaacaggagtaggaatttgcattttttattctctatgcccttttggggcacctccctttatctgcttggctgggaaaccatggtttttcccttgctgaggagacccactcataaggcaaagggctgtatgggcctcttatcatgaacatataaatgaacaaattgtgtgtgtatgtgtgtatgttgtgcatgtgtttgaacaattattaaattcagcacacagtgtctgccctgaaccagcacattacaccagggagtagatactccagggactcccaaaacacccacactttggaagcagaatggtccaaagttgtaaccaaagttgatcatcccgtgtgggatgatcaacactatgtttgaaatgcttgttttttggtgctgtaaagaaatagcacttgaacataaatttaattttctcagcaaggccatttttatactttctgcagaaagggtacactcgccagcagttttgccacaagagtacactgaacaaaggagacagggtcatttataacttgatgcgtccaccttactgctgtgtctggtttctattggctggaacaggacttcacattctgtatttgtcttgattggctaggaacttagaactttttaaaaggggcaaaggcagaggagaacaaaggaaggaggtagtaacttgtggaatgctgagaaaggtaaaaacaccttcaaataaggaagaggaacaggcaatgacctaatgcttgcttggaccagtataagcatgccagggcaaatatttaggctaaattgtgggagctaagaacataaagtacattgatttctttattacggctaacagatatttaaggatgttagcacaggtctttgaataaattttccttctaagagaagttactatttattcctaattagatgaggaggaaagtctttgaagaggaacctctactttacttttcacaattccttctctttttatttcataattcctcttcaaacttgtttaatatgttttgacttaattgctttatttgtctttctaagagaagtaatttttctgaatagggtggaggagagttaggagttaactctgtaagagtggcagagacaaatttttgtataaaactttgaaagcagggaataatagcctacaagaataagcacactaataacaaaagctaacaaggtgagaattgaagttaaaatttatttttatccacttaactaatactttattattttattattattattattatttttattttgttctttatttatttatttttttgagacggggtcttgctctgtcacccaggctggagtgcagtggcacaatcttggctcactgcaagctccgcctcccaggttcacgccattctcctgcctcagcctcccgagtagctgggactacaggtgcccactaccacgccagctaatttttttgcatttttagtggaggcggggtttcaccgtgttagccaggatggtctcgatctcctgacctcgtgatccacccacctcagcctcccaaagtgctgggattacaggcgtaagccaccgctcttggctgttttaatattttagaaaaaggattatttatttttgaatttttggcaagtttattggatagggctgttaatccttgtagcgcttttgttatagttccatcagggcagtattattaggaacaaaggtacaatattgagttttaattatgacacaaacatctcctttttctgctaatattatatttaaagctattttatttttctaggccatctggcttagcttagatatctctttgatgtttagcaatctctttgatgacgtcctcagtgtaatgtatgaattgttgctgattgtagtagatatagtttatttagtctacatttttttttatttaaagttacttaccagaaatacgtggattcaaattgtgcagctgtttgattttgtgctttaaacttatttggcacttctcaaaggaccttaatagcatttatgtaaaactgaggattaaaggattcataaggagtttctcttggcctgtggtgctttgtttttacttttttagattgatgaaatgccagggtgaaggggatagccaattggattagagcacaagtactgctccaattatttggcagagtgtccagtaaaggtgcttcacagtaccaccatacatttgcttggggatggctaagcatggactgatgggcaagctcttggaaaggctcgagctcctcgcatctttgtgtgcttccaaagaacaccaaattttcctcttgccatgagatgcataaagtaaacttggcatttagaggtggaagctggattgccttcaggggcttaccagcagagtgttgaatttcaggaaatagcagagagagcttggcatgatggattatcctaagtaattggattctgaaaaagagccaccatacagtccgtatctggtcgatgaggagaccatctgagtggaaagaggataatctgggcctctggcctaccgtgcatacaagtttaataatcgcttttatttaaagtgtgaacggaatatttaatccactccagctacgcatttgcatcttgatattttgtcttgatggctaagttctgtctgtcttagatctcttatttttacaatagacactctagttttattagatgtaggagcgaccagtgtgggatctagaactgaggctactgaagaaggggaagatgggggtaataatgcccgttttgtagagttagttaaggtggaggtagtgacagagagaaggacagggttacattgataaggctagcagttagaaggggtagtctttttagtgaaatagatgaagggttttagatctgcacaaacctttttcgtggaagtctaactttgctcctgagtagtttaaaggacgtagtcctatttactacaaggttaccaggctgtaggagcagaaaatcagtgtcttggctgcaggtgatcacaacgatgagtgctaggggtaactgtgtcaattagagggccaggatataaatatttgtgtgaaaaggctaactgtcgttgatcttttacatttccacaaggtatgatagagcaagcattaaaggcaatggtctgaggcagacttagttacattaataacaaaggagctagtaacagaataaggaaagaaaaggaagcaatatagaatgtatatgaaaattaagctttctttaacttagtagggcttgatcttagtacagtaacctaagatgttttcttgactcgagtatggtgggtccattctttcttggctgtgcggatggcagtctcagtggttaacagcataaaatagggtccttcctaggctggcgtgaattttttttctatcttttgatgaggatgtgatttttaggctggtgctggtgcactggaaattctaggggtggcacctgtgctaaaagacttttagttctgagggaagggaaagtggaagataaattaagcatatcatttctattgcatatcttggggcttgaggcctcatggtgatgcctcccactccattccttctcagcgccgcccagggtacgtggcggccttgatccctcttaaggtcttggccatcttgtggccttcaccgcccctgcgcgttgtggccttggggatgaggggccttgtgacttacctggccaccttcaggccttaagaaagctaaacaccattttatatttgacaatgctttttgtatgattttatacgagataagttaaattttaccttcatattaatgtgctattaatgttaaacttaattttaataaaatcttgtagacattatttatccaattttaatgtctgactataaggtaagatttttatagactctttttaaccttttataatttttgttaaagagcaggttagtgctttaagaaaaatctattgtgcttttattttaacgttcagttcacagaaaaactggatgatacctctttaactttagccaatatgtttacacacagaatttcctttacaattaacattttaaaacttgcttaaacctttaaaacaagttttttaaccttttaatataggtaaaaatccatattcttatgcctccttataatcctgttattaaaagtatattttatttttcttacatactttgtacataaactgtttttaaaatagttttacattcagaaggcctaattacttttaaattatacaatatttcttgcataaattcctttttataactttccttatgactttcacagacaatcttcaacatgtcttaactttctgccttccttttacactatttcttttcttagtttcaccttctgggtctttctttgatttctgtctcttccagtttctctcttactcttttattctatttctctctctctcatttgcactcttattttcctctctctcatttgcattctatttttctttctctgtctgtcatcctctgtttcttttttcctttctgagttttcctggtcttgcagctggtggggctgggcaaaggcatgggcctcgcccccaagtatgcgctgccatctatttctcctgtttttatttttttctgatttcattttttactttttttttccctttcttcctacacttagtttctcaggctgggtgggatttgcacggctgcagtcctggccctgggccttcaccggccttgaggcttggcagatgcctgccgcaacttgcaagaattgtaccttttcacctcttctgctgtcctcctggcactggtcctcaccctctttttcacacagagctgggctggggagagggacttaactttaggttagttaagttaaggtgcctggctgtctggcaccatgcttgctgtttttgctctctttctctctgaatttcctctcctaatttctttttcctctctgctggtctttcctttgcctctgccagccacctatgctgctgttttcctccctctccttcctcttcctctaggggagccaccggggagaggagcttagcctttttctttcctcgggaagagggggaaggggagttttgaaaaaaaaaaaaaatatatatatatatatatatatatatatatttttttttttttactaccagaggtttgtgtgaggttcaaccccctctcaatggggatttctcacctctttttgaggttcaagcccccctcaatggggatttctcacctctttttgaggttcaacttctacagtggggatttctcacctcttttttgacctccaagacatcctgactaaggaatacttcactgccccctgtcgctttctttccttagtcctgcccaaggaatgctttatcgcccctgcagtttctccctccttggtatgtcctaaccaaggaatgctttaccaccctgcagctttttttttagtcttgactaccaaggaaatagtttactggctctcctggtgtttctttccttggtctgtgcacacagtttcctggtttaggtgatatatgaggatcttttactccaggtcaccggccagtgttttttctttttttgcattgctgagagtccgggtttatttgtcacagtgggtgggtctcgagtccttatccctgaggccactgcaatgaggcagaggagcatgctccttcatgagagaggactggagaccatccccagaggagaatgtatccctgtaccagccaccaaattgtttgaaatgcttgttcttcggtgccataaagaaatagcacctgaacataaatttaattttctcggcaaggccatttttatactttctgcagaaatgttacactcgccagcagttttgccacaggagtacaccgaacaaagaagacaaggtcatttataacttgatgtgtccaccttactactgtgtctagtttctattggttggaacagggcttcacattctgtatttgtcttgattggctagcaatctagaacatttttaaaagaggaaaaggcagaggagaacaaaagaaggagaaagtaacttgtggaatgctgataaaggtaaaaacaccttcaaataacgaagaacaggctgtgacctaatgcttgcttggaccagtataaacatgccagggcaaatatttaggctaaattgtaggagctaagaacataaagtacattgatttctttattatgtctagcagatatttaagaacgttagcacaggtctttgaataaattttgcttctaagagaagttactatttattcctaattagatggggtggaaagtcttcgaagaggaacttctactttacttttcacaactgtatgaaccggttacagaaaagagaaatgttctttagaaagtgacaatccttatggagaaagtggaaaaatcctgaaatttactgccacacatgcatactttcagaaatttgcataattgtagaactcttcttcccatttgatcaccccaccccatctttttgttctttatttactattatttcagagggattcaggaaaacaagagagataaatgcatgaattccactctacactgtgctatggtgccaaattaagtccacttagttggtgaatttaaatggtttaaaacaacagtaaaggggaggagatgtgctgtagaagaaactgcttcagtatcatgaagtgattgatagaaatagtagattaccattccagagactgaagataaatttcatgaacacttctaatggatgacttgggtctggacctaacagaatcattggagtccttcctagagatgacagcaatctttgtttcctacaattcttggttcttccaagatccagcaatagggtgttgatggtttaagacataaagacaatataattcttactttcatctcatttaatcttagaggcatttggccaagctattttagtttaggttctacaaaagcaatgcccccaaaacaaggacttggctacagatagattatcctgtgggtgatcctgccttatttaactggggctcaatccaacacgcatatgcccccaaattgtccaactgggacaatgtgggcagcttggacctggctcccaacccacattggtaaaggtaccccccaaatatttcctcctctctacttctaggctgaacatgcacactgggcaaatgggctctcttggatctgaagactgctctacagcagaaaagcagagagacatgttgggaggacacctaattcaagttaatagagttggctggccagtttacagactctctctctttccctcccttgtcaacttaagaatttgggcaattgattcaaaattcttgcaaaggcagatttgggtaactagggtctattgccaggctctattgataacagagtacatcctcactgagcttcctcctctgggtaccagcaagcttctggtgtcaatggtggggaggtcattatgtgctcaggtccacatctctgatggataaatatattgaatattacccatggatacccagctaaagtcagcagcatgaagagatgaagagttcaaaagaggcaacgactgagaagagctaggatgaaagagaaccagcctacaacagatgggaagtaacccttgttcctggtcattccgtcctctgtgtcccttctgtcagggacctagatacacagcaggcatgcccctgtacccctgcccactacccagtctctacgtgagttggataaggagtactttattctatagtcttggatgaacatcagctagaacaatggaataataatgagaatttaaataactaaattcttcaggatttcttgaatgcctacacatacattatctacttcaacttcataaagcctgaatgaaatgaaaataactttaagataatgaatctcagacacaatggaggaaaagctccagacactggctgaggaggacctaggacctcagcccatttgcaggacactttcctcttctatcagacacccatgctcccctccatctgcagcctcccacacccagggactaaccatcagaaaaacgcctagtatctcttccctcacttgcgaattccgcactaaatgcatctcttcttgccaccttttacttaactggctgcacttgactcagccccctctgctcctactgtctttccaagaaagtcacatctgatggatgtacatttttggggttttggaaaccgttgactgttgccacaacaaggaggtaagatgcgctggcaaaatcctttggcacctgccttgctgtggctgagtggggctgggctgtaatggcaagagatagaggggctctcgttatgggtgaaatctgcatggggctctttgcatactagggcaccagaagttttcttagtgtggcacccaccgccctgaggggtatcactgatgatcaacatccaaagaacctgaggcccaaagcagagatagtagctccaaatctctcattagatggaagactgagattcccatctgattttttttcaaaccagccagagtatttggaacagaaatgcctaacttgcctgttaaaaagtaagagagtgttgatatttaagctctggctggaatttaagactctggctttttcttgaaggctccatatatgaaaaagaaaagtgaaatcagattatgctttttcctcttcccaacaaagccagtatttccaagagtgaaaggctgtctgtccagtactcaggctgcccggtgtggatggctcagtgagagaggggagggtgagaagccattggggccaaaactagggatctcagtgactgagaggagtggacaagtcttcagtcagcagagttggatttgggatgacagaccaggatttctggggtcagtgcaaaggccggtgagagcctcctccttcccttctctgctcagcccctggggtcttcttcctccacaatgagtactggtgaatctgaactcttttctctgcctatgctccactgagggagaccaggcctttgggtcctggggacagagtgagatagaattaaggaatctgctctggaatcactgaaagcgacttgatgtcttcacatcactgccccctgcatcacagctccaaaagggacacattatagtccccaagaattggctggaatactacacaggtttgttaattctctggccatgctcagggaatatactgtctcccggtcacgctcaggtaatcagaagtccagacattctaataaacaagccctagacccttgttgaacttaaatctccctcgccccagctcagtcctaccttggagtgagaaatcagcaggagggacaagaaaagagtcagcttctggtcttttctttcccctacctcctctgctatgagcatctgatgtttgggacccttacaaggtgtctgtgtgggagtggggagggtggtaaagggtagagaagtggggagaggagaggcagtggtgaaaatcaggacaagtctcgcttgtgatatggttgcaatctggctgtaatggcctctggggggtggtgaatgttactgactatcctctagtatgagggaccatgagggaccctctctaatattccttttgggatctttgagataggcaaagccctaatccgcagatttcctctcacctcctcggtctctgcaacaggtgagcccagtatctttcaactgaggtcctgttgactgtgttctgcacactgggctcttccctctagcccttactgttggcctttggtgaaggcacatccacgtgccctttctgcctcctcaatctgacagttgtcctgttctgacctgggcaaggagttgagggggcaaagccaatctcatagctgcataagtggttttgcaacttct

SEQ ID NO: 51 - DNA, 18945 bp, Homo sapiens
acttgtcatgttaaaaaaggcacatgcataccttcaaactagaaaaattctacttattgtttctggcttagaaaaataatcatagatgtatgtaaagattcatatgtaataatgttcatcttaatatttttatacacaatgaaaagttgaatataagctaaatgtttaattgtagctactaaaaattaggttttagaagaatattcaatgatatacaaaataaacattacattaaaaagaaaaaagaattgaaagtaaagtgatggaaacattaacaattaaaaattaatcaagtgaaaacttttatagctataataatactaaattggtctttgaggaagcactactagtaatgaataaattactttaataaaattatcaattaaaagtaatggccagaaattctaattttatgtaaaattaatttcatggcttcaaatgtatatataatgggataagatgacagaagtataattaaaaaacaaaagaaatccaggtacatagttggaaatcttaacacaattctctcaacaataaatagaagatagaagagttaaaaacatttatatatttattcatgaacaacatgaataatggacttaagaaactcatatgtaatgataattgaatttaagtaacatatataacactacactctcagcctaaaaaacacatatttctttcaagtttacatgcaacagatatctgaaaagaccataaactgggccattataatgatattgggaaaaaagcttctaagtttggaaattatgcaatatactgcaaaataatgccaaagaaaattacgatgaatatttaaaaatagttcatatttaatgatgattaaaatataatatgttaaatttgtggaatgcagctaaaggtgtgctcagtagaaatgtgaagctctaaatacatttgaaaggaaaaaaaattacataaaaagtcagaaccaaatttatcagaactctggaaaatggtcaaagttgagtaacagccaagcaaatgctgaatggagcaaaagacagcataaaaggtagaaattagtaagcattcctcaaaaacattgtaatacaaccaaacaatccacattcacttggtgcaaaatatcagaactgaataaagtaataaatactcaaaagcataaaaggaaaagcagggaacagagtttctttagaaaattggggcactcaaaagcacctatgtgtactaggaatttagaaagtcaagtgcatgcccagggcaggacatacatttagaaaaacactgaggaaaaacagtacagaagtttcccaaaaaattaaaaaataaaacgattatgtaatccagcaatcccactacttggtatacatccaaaggaaatgaaatcagtatgtcaaagaaatacatgtactctcatgtttactgcagcattatttacaataattaagacatggaagcaacctaagtgtccataaaggggtgaatggatatttttaaaaatgcgtcctgtatatacaatgaaatactatccagccttaataaagaaggaaatcctgtcatttgtgacaccatggataagcctggagggcattatgttaagtgaaataagccaggcacaaaaagacacataccgcatgatcttatttatatgtagaatctaaaaaagttgatctcgtggaagaagagagcagaatggtggtttcctgggactcagtagtggggtgagagttggggagatgttggtcaaaggctataaaatttcagctgggtaagaagaataagttcaagatatctgttgtacaacatcatgactatagttaataccaatgcatttttttccttgaaaattcctaacggtagattttgtggtcttaccacatacaaaaatgataaatatgtgaggtaatatgtatgttgattacattaccattccacagtgtatacatatctaaaaacatgttgtacaaaataaatatatacaattttacttgtctatgtaaataaattaaataaagaaagaaaataaaatgtatataataaaagaaaataagaagaaagaacaaacctgagaagaccctcaactttcacctctggctaacagctgggtcagtgcaagctctaagagaaggctaaggcagaattataaacagcctgttaagcattgaaggagtgttccagaactatgctaatctgcaatgattgagagagttttgttttgttttgttttgttttgtttttttgtggtcttttatttcttcatttatttttgggaagggacttgaaatggtacactaaaaaaataaactaaagtcgtttatcagttctaggagcatttgggcagagtcttcagggttttctagtataggatcatattgtcagagaagagagataatttgatttctcccttttctatgccgtttattttgttttctcttgcctgatcgctgtgattagacttccagtactatgctgaataggaatggcgagaatgagcatctttgtcttgttccagctctcaatgggaatgctttcagttgctgctcattcagtatgacattggctgtggattcgtcataggtggccttattattttgaggtatgttccttcaatgaagtttgttgtgggtttttaatcataaaggaatgttggattttatcaaaagctttttccttatagactttagtaaaatttcaagatacaaaatcgatgtacaaaaattagtagcaatttgatacactagtaatattcaagctgagagccaaatcaagaatgcaatcctatttacaatagccacaaaaattaaaatgcctaggaatacatctaaccaagaggtgaaagatctttacaaggagaactacaaaacactgctagaagaaataatagattacacaaacaaatggagaaatattccatgctcacagattagcagaatcagtattgttataattgccagactccccaaggcaatctacagattcagtgctattcttatcaaactaccaatgtcacttttcacacaattagaaaaaactcttctaaaattcatgtggaaccaaaaaggagcccagtcagccaaagccatccctagcaaaaagaacacagtcagaggcatcacattacctgtcttcaaaccacactataagggtatagtaacaaaaacagcatagtactgatacaaaaacagacacatagaccaatgcaacagaatagaggacccagaaataaagccttatacctactgctatctgatcttcgacaaagttgacaaaaacaagcaatgagaaaaggactccctgttcaataaatggtgttgggatagctggctagccacacacaaaggaatgaaactagacccctagccaggcacggtggctcacgcctgtaatcccagcactttggaaggctgaggcgggcagatcacgaggtcaggagattgagaccatcctggctaacatggtgaaatcccgtctctactaaaaatacaaaaattagctgggtgtggtggcaggcacctgtagtcccagctactcgggaggctgaggcaggagaatggcgtgaacccaggaggtggagcttgcagtgagctgagatcacgccactgcactccagcctgggcgacaaggcaagactctgtctcaaaacaaaacaaaacaaaaaaaaactagatccctacatttcaccatatacaaaaattagctcaagaaggattaaagatataaatacaagacttcaaactataagaatcctaaaagaaaacctaggaaacaccattctggacaattggctttgggaaagaatttatgactaagtcctcaaaaacaattgcagcaaaaacaaaaattgacaagtgagacctatttaaactaaagagtttctgcacagcaaaggaaactatcaatagtgtaatgagaaaacatacagagtgggagaaaatgttcacaaacaatccatctgacaaaggtctaatattcagaacctgtaggaaacataaacaaaccaacaagcaaaaaccaaacaaccctattaaaaagtgggcaaagtcatgaacagacacttctcaaaagaagacctctaagtggccaacaagcatatggaaaaatgctcaacattactaagcattagagaaatgcacatcaaaaccacaatgagataccatctcacatcagtcagaatggctattattaaaaagtcaaaaaataacagatgctggtgaggctgcagagaaaagagaatgtttacacactgttggtgggaatgtaaattatcccagccactgtggaaagcaggttggagacttctcaaagaacttaaaatagaattacctttcgatccagtaatcccattactgggtatatagctaaaagaaaataaattattctattgaaaagacatatgcactcatatgttcatcccagtactattcacaatagcaaagacacggaatcaacctagatgtccatcaacaatggacgggataaagaaaatgtggtacatatatatcatggaatactatgcagccataaaaaatgaatcacatcctttgcagccacgtggatgttactggaggccattatcctatgcaaattaatgcaggaacaggaaaccaaatactgcatgttctcacttataagtgggagttaaaaaaatgagtatttgtgaacataaagatggcaaaagtagacactgaagaaagggcggaggaagggaggggtccaagtataacaaatgattgggtactatgctcacaacctgggtgatgggatcaattgtaccccaaacttcagcatcacacaatatacccaggtaagaaaccgcacatgtaccccctgaatctaaaataaaagatgaaataatttaaaaaattaaaaatggactaaacataaaaagaaggtagtaatggaggaaatgagaggggtaaagtataatatagaaagaaaaagtaaaatggcaaaaataagttcttccttaccaatgattactaaatgtaagtgaatttaactccccagtcaaaaagcagagactcctatagagtcatttcagatctaaagatacacataggctgagagtgaaagaatggaaaaacatatttcatacaaataataatgaaaagagatcaaggcagaaatttccccaataatagttggataattcaatattccactttcaataatggataaagcattcatacaggagatcagtaaggacccagagacattgagcaacactaaaaactaaatagacctaacaatatagaacaatacactcaaccagagcagattatatatatattttctcaagagcacacggcatattctccaggatgttaggccacaaaataggtctcagtgaatttaaaaatgttgaaatcacgcaaagcatcttttctgactacaaaaaaaaaaaccaaactaaacaaaactacaaatcaataagagacgaggaactggaagatttacaaatctgtggaattcaacagcacactgttacacatccagcaggtcaaaggagaaatcacaatggaaattataaaatacttagagaggagtgagaataaaagtacaacataccaaaactaatgtgatgtagggaaaggagtgctcaaagggaagtttacaggtgtggacacctacattaaaaagaggaaaaatctcaaattaacataactttacaccttgaagaactaggggaaaagggcaaatgaaactcaaagctagtggaaggaaacaataaagatgagagtagagttcaatgaaattgagatagataaacaatagagagaatcaataaaaacatcagttgattctttgaaaagattaacaaaattgacaaacctttagttagaccagcaaagaaaaccagagaaaacacaaataactaaatccagaaatgaaagtgaggacattacttaccaaccttacagaaataaaaaagattatcagagagaataatgaaaaattattcaccagaaaattaaataaccaaaggcaatggacaaattactacatacgcaaatgaccaaaactgacttaagcagaaaaattgaacaaacctataaatgctaaatgaattgaataaataatcatgaaactctctgtacagggtgacatcagcaagacttttccagctgctgcttgagggtctgacaccagggagttctaatttctggagggatccaaaaaacaggagtaggaatttgcattttttattctctatgcccttttggggcacctccctttatctgcttggctgggaaaccatggtttttcccttgctgaggagacccactcataaggcaaagggctgtatgggcctcttatcatgaacatataaatgaacaaattgtgtgtgtatgtgtgtatgttgtgcatgtgtttgaacaattattaaattcagcacacagtgtctgccctgaaccagcacattacaccagggagtagatactccagggactcccaaaacacccacactttggaagcagaatggtccaaagttgtaaccaaagttgatcatcccgtgtgggatgatcaacactatgtttgaaatgcttgttttttggtgctgtaaagaaatagcacttgaacataaatttaattttctcagcaaggccatttttatactttctgcagaaagggtacactcgccagcagttttgccacaagagtacactgaacaaaggagacagggtcatttataacttgatgcgtccaccttactgctgtgtctggtttctattggctggaacaggacttcacattctgtatttgtcttgattggctaggaacttagaactttttaaaaggggcaaaggcagaggagaacaaaggaaggaggtagtaacttgtggaatgctgagaaaggtaaaaacaccttcaaataaggaagaggaacaggcaatgacctaatgcttgcttggaccagtataagcatgccagggcaaatatttaggctaaattgtgggagctaagaacataaagtacattgatttctttattacggctaacagatatttaaggatgttagcacaggtctttgaataaattttccttctaagagaagttactatttattcctaattagatgaggaggaaagtctttgaagaggaacctctactttacttttcacaattccttctctttttatttcataattcctcttcaaacttgtttaatatgttttgacttaattgctttatttgtctttctaagagaagtaatttttctgaatagggtggaggagagttaggagttaactctgtaagagtggcagagacaaatttttgtataaaactttgaaagcagggaataatagcctacaagaataagcacactaataacaaaagctaacaaggtgagaattgaagttaaaatttatttttatccacttaactaatactttattattttattattattattattatttttattttgttctttatttatttatttttttgagacggggtcttgctctgtcacccaggctggagtgcagtggcacaatcttggctcactgcaagctccgcctcccaggttcacgccattctcctgcctcagcctcccgagtagctgggactacaggtgcccactaccacgccagctaatttttttgcatttttagtggaggcggggtttcaccgtgttagccaggatggtctcgatctcctgacctcgtgatccacccacctcagcctcccaaagtgctgggattacaggcgtaagccaccgctcttggctgttttaatattttagaaaaaggattatttatttttgaatttttggcaagtttattggatagggctgttaatccttgtagcgcttttgttatagttccatcagggcagtattattaggaacaaaggtacaatattgagttttaattatgacacaaacatctcctttttctgctaatattatatttaaagctattttatttttctaggccatctggcttagcttagatatctctttgatgtttagcaatctctttgatgacgtcctcagtgtaatgtatgaattgttgctgattgtagtagatatagtttatttagtctacatttttttttatttaaagttacttaccagaaatacgtggattcaaattgtgcagctgtttgattttgtgctttaaacttatttggcacttctcaaaggaccttaatagcatttatgtaaaactgaggattaaaggattcataaggagtttctcttggcctgtggtgctttgtttttacttttttagattgatgaaatgccagggtgaaggggatagccaattggattagagcacaagtactgctccaattatttggcagagtgtccagtaaaggtgcttcacagtaccaccatacatttgcttggggatggctaagcatggactgatgggcaagctcttggaaaggctcgagctcctcgcatctttgtgtgcttccaaagaacaccaaattttcctcttgccatgagatgcataaagtaaacttggcatttagaggtggaagctggattgccttcaggggcttaccagcagagtgttgaatttcaggaaatagcagagagagcttggcatgatggattatcctaagtaattggattctgaaaaagagccaccatacagtccgtatctggtcgatgaggagaccatctgagtggaaagaggataatctgggcctctggcctaccgtgcatacaagtttaataatcgcttttatttaaagtgtgaacggaatatttaatccactccagctacgcatttgcatcttgatattttgtcttgatggctaagttctgtctgtcttagatctcttatttttacaatagacactctagttttattagatgtaggagcgaccagtgtgggatctagaactgaggctactgaagaaggggaagatgggggtaataatgcccgttttgtagagttagttaaggtggaggtagtgacagagagaaggacagggttacattgataaggctagcagttagaaggggtagtctttttagtgaaatagatgaagggttttagatctgcacaaacctttttcgtggaagtctaactttgctcctgagtagtttaaaggacgtagtcctatttactacaaggttaccaggctgtaggagcagaaaatcagtgtcttggctgcaggtgatcacaacgatgagtgctaggggtaactgtgtcaattagagggccaggatataaatatttgtgtgaaaaggctaactgtcgttgatcttttacatttccacaaggtatgatagagcaagcattaaaggcaatggtctgaggcagacttagttacattaataacaaaggagctagtaacagaataaggaaagaaaaggaagcaatatagaatgtatatgaaaattaagctttctttaacttagtagggcttgatcttagtacagtaacctaagatgttttcttgactcgagtatggtgggtccattctttcttggctgtgcggatggcagtctcagtggttaacagcataaaatagggtccttcctaggctggcgtgaattttttttctatcttttgatgaggatgtgatttttaggctggtgctggtgcactggaaattctaggggtggcacctgtgctaaaagacttttagttctgagggaagggaaagtggaagataaattaagcatatcatttctattgcatatcttggggcttgaggcctcatggtgatgcctcccactccattccttctcagcgccgcccagggtacgtggcggccttgatccctcttaaggtcttggccatcttgtggccttcaccgcccctgcgcgttgtggccttggggatgaggggccttgtgacttacctggccaccttcaggccttaagaaagctaaacaccattttatatttgacaatgctttttgtatgattttatacgagataagttaaattttaccttcatattaatgtgctattaatgttaaacttaattttaataaaatcttgtagacattatttatccaattttaatgtctgactataaggtaagatttttatagactctttttaaccttttataatttttgttaaagagcaggttagtgctttaagaaaaatctattgtgcttttattttaacgttcagttcacagaaaaactggatgatacctctttaactttagccaatatgtttacacacagaatttcctttacaattaacattttaaaacttgcttaaacctttaaaacaagttttttaaccttttaatataggtaaaaatccatattcttatgcctccttataatcctgttattaaaagtatattttatttttcttacatactttgtacataaactgtttttaaaatagttttacattcagaaggcctaattacttttaaattatacaatatttcttgcataaattcctttttataactttccttatgactttcacagacaatcttcaacatgtcttaactttctgccttccttttacactatttcttttcttagtttcaccttctgggtctttctttgatttctgtctcttccagtttctctcttactcttttattctatttctctctctctcatttgcactcttattttcctctctctcatttgcattctatttttctttctctgtctgtcatcctctgtttcttttttcctttctgagttttcctggtcttgcagctggtggggctgggcaaaggcatgggcctcgcccccaagtatgcgctgccatctatttctcctgtttttatttttttctgatttcattttttactttttttttccctttcttcctacacttagtttctcaggctgggtgggatttgcacggctgcagtcctggccctgggccttcaccggccttgaggcttggcagatgcctgccgcaacttgcaagaattgtaccttttcacctcttctgctgtcctcctggcactggtcctcaccctctttttcacacagagctgggctggggagagggacttaactttaggttagttaagttaaggtgcctggctgtctggcaccatgcttgctgtttttgctctctttctctctgaatttcctctcctaatttctttttcctctctgctggtctttcctttgcctctgccagccacctatgctgctgttttcctccctctccttcctcttcctctaggggagccaccggggagaggagcttagcctttttctttcctcgggaagagggggaaggggagttttgaaaaaaaaaaaaaatatatatatatatatatatatatatatatttttttttttttactaccagaggtttgtgtgaggttcaaccccctctcaatggggatttctcacctctttttgaggttcaagcccccctcaatggggatttctcacctctttttgaggttcaacttctacagtggggatttctcacctcttttttgacctccaagacatcctgactaaggaatacttcactgccccctgtcgctttctttccttagtcctgcccaaggaatgctttatcgcccctgcagtttctccctccttggtatgtcctaaccaaggaatgctttaccaccctgcagctttttttttagtcttgactaccaaggaaatagtttactggctctcctggtgtttctttccttggtctgtgcacacagtttcctggtttaggtgatatatgaggatcttttactccaggtcaccggccagtgttttttctttttttgcattgctgagagtccgggtttatttgtcacagtgggtgggtctcgagtccttatccctgaggccactgcaatgaggcagaggagcatgctccttcatgagagaggactggagaccatccccagaggagaatgtatccctgtaccagccaccaaattgtttgaaatgcttgttcttcggtgccataaagaaatagcacctgaacataaatttaattttctcggcaaggccatttttatactttctgcagaaatgttacactcgccagcagttttgccacaggagtacaccgaacaaagaagacaaggtcatttataacttgatgtgtccaccttactactgtgtctagtttctattggttggaacagggcttcacattctgtatttgtcttgattggctagcaatctagaacatttttaaaagaggaaaaggcagaggagaacaaaagaaggagaaagtaacttgtggaatgctgataaaggtaaaaacaccttcaaataacgaagaacaggctgtgacctaatgcttgcttggaccagtataaacatgccagggcaaatatttaggctaaattgtaggagctaagaacataaagtacattgatttctttattatgtctagcagatatttaagaacgttagcacaggtctttgaataaattttgcttctaagagaagttactatttattcctaattagatggggtggaaagtcttcgaagaggaacttctactttacttttcacaactgtatgaaccggttacagaaaagagaaatgttctttagaaagtgacaatccttatggagaaagtggaaaaatcctgaaatttactgccacacatgcatactttcagaaatttgcataattgtagaactcttcttcccatttgatcaccccaccccatctttttgttctttatttactattatttcagagggattcaggaaaacaagagagataaatgcatgaattccactctacactgtgctatggtgccaaattaagtccacttagttggtgaatttaaatggtttaaaacaacagtaaaggggaggagatgtgctgtagaagaaactgcttcagtatcatgaagtgattgatagaaatagtagattaccattccagagactgaagataaatttcatgaacacttctaatggatgacttgggtctggacctaacagaatcattggagtccttcctagagatgacagcaatctttgtttcctacaattcttggttcttccaagatccagcaatagggtgttgatggtttaagacataaagacaatataattcttactttcatctcatttaatcttagaggcatttggccaagctattttagtttaggttctacaaaagcaatgcccccaaaacaaggacttggctacagatagattatcctgtgggtgatcctgccttatttaactggggctcaatccaacacgcatatgcccccaaattgtccaactgggacaatgtgggcagcttggacctggctcccaacccacattggtaaaggtaccccccaaatatttcctcctctctacttctaggctgaacatgcacactgggcaaatgggctctcttggatctgaagactgctctacagcagaaaagcagagagacatgttgggaggacacctaattcaagttaatagagttggctggccagtttacagactctctctctttccctcccttgtcaacttaagaatttgggcaattgattcaaaattcttgcaaaggcagatttgggtaactagggtctattgccaggctctattgataacagagtacatcctcactgagcttcctcctctgggtaccagcaagcttctggtgtcaatggtggggaggtcattatgtgctcaggtccacatctctgatggataaatatattgaatattacccatggatacccagctaaagtcagcagcatgaagagatgaagagttcaaaagaggcaacgactgagaagagctaggatgaaagagaaccagcctacaacagatgggaagtaacccttgttcctggtcattccgtcctctgtgtcccttctgtcagggacctagatacacagcaggcatgcccctgtacccctgcccactacccagtctctacgtgagttggataaggagtactttattctatagtcttggatgaacatcagctagaacaatggaataataatgagaatttaaataactaaattcttcaggatttcttgaatgcctacacatacattatctacttcaacttcataaagcctgaatgaaatgaaaataactttaagataatgaatctcagacacaatggaggaaaagctccagacactggctgaggaggacctaggacctcagcccatttgcaggacactttcctcttctatcagacacccatgctcccctccatctgcagcctcccacacccagggactaaccatcagaaaaacgcctagtatctcttccctcacttgcgaattccgcactaaatgcatctcttcttgccaccttttacttaactggctgcacttgactcagccccctctgctcctactgtctttccaagaaagtcacatctgatggatgtacatttttggggttttggaaaccgttgactgttgccacaacaaggaggtaagatgcgctggcaaaatcctttggcacctgccttgctgtggctgagtggggctgggctgtaatggcaagagatagaggggctctcgttatgggtgaaatctgcatggggctctttgcatactagggcaccagaagttttcttagtgtggcacccaccgccctgaggggtatcactgatgatcaacatccaaagaacctgaggcccaaagcagagatagtagctccaaatctctcattagatggaagactgagattcccatctgattttttttcaaaccagccagagtatttggaacagaaatgcctaacttgcctgttaaaaagtaagagagtgttgatatttaagctctggctggaatttaagactctggctttttcttgaaggctccatatatgaaaaagaaaagtgaaatcagattatgctttttcctcttcccaacaaagccagtatttccaagagtgaaaggctgtctgtccagtactcaggctgcccggtgtggatggctcagtgagagaggggagggtgagaagccattggggccaaaactagggatctcagtgactgagaggagtggacaagtcttcagtcagcagagttggatttgggatgacagaccaggatttctggggtcagtgcaaaggccggtgagagcctcctccttcccttctctgctcagcccctggggtcttcttcctccacaatgagtactggtgaatctgaactcttttctctgcctatgctccactgagggagaccaggcctttgggtcctggggacagagtgagatagaattaaggaatctgctctggaatcactgaaagcgacttgatgtcttcacatcactgccccctgcatcacagctccaaaagggacacattatagtccccaagaattggctggaatactacacaggtttgttaattctctggccatgctcagggaatatactgtctcccggtcacgctcaggtaatcagaagtccagacattctaataaacaagccctagacccttgttgaacttaaatctccctcgccccagctcagtcctaccttggagtgagaaatcagcaggagggacaagaaaagagtcagcttctggtcttttctttcccctacctcctctgctatgagcatctgatgtttgggacccttacaaggtgtctgtgtgggagtggggagggtggtaaagggtagagaagtggggagaggagaggcagtggtgaaaatcaggacaagtctcgcttgtgatatggttgcaatctggctgtaatggcctctggggggtggtgaatgttactgactatcctctagtatgagggaccatgagggaccctctctaatattccttttgggatctttgagataggcaaagccctaatccgcagatttcctctcacctcctcggtctctgcaacaggtgagcccagtatctttcaactgaggtcctgttgactgtgttctgcacactgggctcttccctctagcccttactgttggcctttggtgaaggcacatccacgtgccctttctgcctcctcaatctgacagttgtcctgttctgacctgggcaaggagttgagggggcaaagccaatctcatagctgcataagtggttttgcaacttcttagttctgtaaatctccagaaagcagacatactatcatcttactagcctcatagccaccttgtgctggggcatctcttctcttactttaaacaccctgggggcttatggtccccatttaaaacaaggaaatgagattctctgagaggtgaagcagataaccaaggtcactgctagtataaacatgcatgtgcaagtgtctttttcatataatcacttcttttcctctgggtagacacccagtagtgggattgctgggtcaaatggcagatctacttttagttctttgaggaatctccatactgttttgcataatggttgtactagtttacattcccaccagcagtataaaagtgttccttttcaccacctgcatgccaacatctgtcattttttaatttttaaattatggccattcttaacaggagtaaggtggtatctcattgtgtttttaatttgcatttccctgattactagggatgttgagcatgttttttcatatgtttgttgaccatttgtctatcttcttttgagaactgtctattcatgtcctctgccccactttttgatgggattatttgttttttttcttgctgatttgtatgagttccttgtcgattctggatattggtcctttgtcagatgcatagtttgcaaagattttcccccactctgtggattgtctgtttactctgctgattatttcttttgctgtgcagaagctttttagtttaattaggtcccatttatttatttttgtttttgttgcatttgctttgggatcttagtcatgaattctttgcctatgtcaatgtctagaagaatttttcgaatgttatcttctagaatttttatggtttcaagttagatttcagtctttgatctatcttgagtttattttattattattattctttttgagacggagtctcgctctgtcaccaggcgggagtgcagtggcgcgatctcggctcactgcaacctttgcctcccagattcaagcaattctcctgcctcggcctcctgagtagctaggactacaggcacgcaccaccatgcccagctaattttttgtatttttagtagagacagggtttcaccatgttggccaggatggtctcaatctcttgggctcatgacccgcccgcctcagcctcccaaagtgctgcgattacaggcatgagccaccgcacctggccgagtttatttttgtgtaagatgagagctgaggatccagtttcattattctacatgaattatcacattgatttttcccgcagccttttctgataatgatcaaacagaggaaaagcctgggatttgatccacattgttttccgggcacatggagttctctgatgcaccagcctccacatctgtgctaaggccaggtcttactttgctataagtacctttgtttggggatcaagataattggcatggaattaactatatataacctcacatgggaaatctattaatctgtgttcttcattctgcatgttttactcatgaaattaattcattggattatgaccagcattaaaaaacaaacagatgaaaaacattcatagaatggaataggagttatagggtgtatttaaggcaaattgttctgtaatacctcacattcacctgtgtgcaggtatttgtgtgcatgtgtacttggttcctatatgctcacttagtaaatttaggaatatgctccttctaggatctggttctttttttttttgtatggctgccactctgtaattgaacctggttccacgactccctttagaagggcctcctcctcctcttccaaaaggactcctctgcccctgtctggaggaaggtatctggcaatatatctgggcaagatattcaaagagctgagcttggagcaattgtaacccaggctgaattctgatgacctcttctaaacttccaggtcagtgctcctggaggctcacccacacaaacacataggcacactaacaacacctggaagacacaccaacctcatgcagaggaaaccataccctcactggcctggcagtgacacaggggcctgggcaggcatagcacagaagagtcctggtgtaactgagataaagtatctcaattgtacaaataattattttcggctcggttgtctctagcgtgcagctggtgagccttcaccatgggcccaggagaagcggatcatatgaacaaggcctggggatgggacagttgagctggggctgcaggggctaaggctgtttcccatggggctcagcactggtggacaggtaagcagacaggtttgaagatgctggctcagttcacagacatggtcacagaaaaagcctggaaaactatagggttttctgctgacctcccacactcaccatggacagtcagtaccctgcactggcccgtgtcgtacccaagcagagtgtgcttgaaaattggatgtatattagtagaccccgtgctcagcgggtacagtttagaaagggaagttaacttatctgtcaattagtaagttaacaacacacaaagtgtactatgttttattaatcaaacaaaaatatgtttaacacctgctgggcacaaggagtacaatggtaaagagtttaatggaaatgtttaatggttaatgccaagacctgtgtatgtattaatatgatgccaatcatttaatacctgatgaagcaatagtttctgggactacttgggttagaaaatgggcctgccacaggcccaagcccatcccctaccctgcatgtgctcctgctccactcccttgtgcatctatccggtataatgttgtggggaaggggagtgctcgattcctcaccttaaccagcctgccagctatccatgcagagacatgtgggcaaaactcctaaggccagacctccccactccattctcctgctaggctgctgagggactccattcgaacctggtaattaccctgcctccttccctccagattccataggttacctcttcctcttt

SEQ ID NO: 52 - DNA, 1534 bp, Homo sapiens
aacctcacatgggaaatctattaatctgtgttcttcattctgcatgttttactcatgaaattaattcattggattatgaccagcattaaaaaacaaacagatgaaaaacattcatagaatggaataggagttatagggtgtatttaaggcaaattgttctgtaatacctcacattcacctgtgtgcaggtatttgtgtgcatgtgtacttggttcctatatgctcacttagtaaatttaggaatatgctccttctaggatctggttctttttttttttgtatggctgccactctgtaattgaacctggttccacgactccctttagaagggcctcctcctcctcttccaaaaggactcctctgcccctgtctggaggaaggtatctggcaatatatctgggcaagatattcaaagagctgagcttggagcaattgtaacccaggctgaattctgatgacctcttctaaacttccaggtcagtgctcctggaggctcacccacacaaacacataggcacactaacaacacctggaagacacaccaacctcatgcagaggaaaccataccctcactggcctggcagtgacacaggggcctgggcaggcatagcacagaagagtcctggtgtaactgagataaagtatctcaattgtacaaataattattttcggctcggttgtctctagcgtgcagctggtgagccttcaccatgggcccaggagaagcggatcatatgaacaaggcctggggatgggacagttgagctggggctgcaggggctaaggctgtttcccatggggctcagcactggtggacaggtaagcagacaggtttgaagatgctggctcagttcacagacatggtcacagaaaaagcctggaaaactatagggttttctgctgacctcccacactcaccatggacagtcagtaccctgcactggcccgtgtcgtacccaagcagagtgtgcttgaaaattggatgtatattagtagaccccgtgctcagcgggtacagtttagaaagggaagttaacttatctgtcaattagtaagttaacaacacacaaagtgtactatgttttattaatcaaacaaaaatatgtttaacacctgctgggcacaaggagtacaatggtaaagagtttaatggaaatgtttaatggttaatgccaagacctgtgtatgtattaatatgatgccaatcatttaatacctgatgaagcaatagtttctgggactacttgggttagaaaatgggcctgccacaggcccaagcccatcccctaccctgcatgtgctcctgctccactcccttgtgcatctatccggtataatgttgtggggaaggggagtgctcgattcctcaccttaaccagcctgccagctatccatgcagagacatgtgggcaaaactcctaaggccagacctccccactccattctcctgctaggctgctgagggactccattcgaacctggtaattaccctgcctccttccctccagattccataggttacctcttcctcttt

SEQ ID NO: 53 - DNA, 12813 bp, Homo sapiens
ggagttctaatttctggagggatccaaaaaacaggagtaggaatttgcattttttattctctatgcccttttggggcacctccctttatctgcttggctgggaaaccatggtttttcccttgctgaggagacccactcataaggcaaagggctgtatgggcctcttatcatgaacatataaatgaacaaattgtgtgtgtatgtgtgtatgttgtgcatgtgtttgaacaattattaaattcagcacacagtgtctgccctgaaccagcacattacaccagggagtagatactccagggactcccaaaacacccacactttggaagcagaatggtccaaagttgtaaccaaagttgatcatcccgtgtgggatgatcaacactatgtttgaaatgcttgttttttggtgctgtaaagaaatagcacttgaacataaatttaattttctcagcaaggccatttttatactttctgcagaaagggtacactcgccagcagttttgccacaagagtacactgaacaaaggagacagggtcatttataacttgatgcgtccaccttactgctgtgtctggtttctattggctggaacaggacttcacattctgtatttgtcttgattggctaggaacttagaactttttaaaaggggcaaaggcagaggagaacaaaggaaggaggtagtaacttgtggaatgctgagaaaggtaaaaacaccttcaaataaggaagaggaacaggcaatgacctaatgcttgcttggaccagtataagcatgccagggcaaatatttaggctaaattgtgggagctaagaacataaagtacattgatttctttattacggctaacagatatttaaggatgttagcacaggtctttgaataaattttccttctaagagaagttactatttattcctaattagatgaggaggaaagtctttgaagaggaacctctactttacttttcacaattccttctctttttatttcataattcctcttcaaacttgtttaatatgttttgacttaattgctttatttgtctttctaagagaagtaatttttctgaatagggtggaggagagttaggagttaactctgtaagagtggcagagacaaatttttgtataaaactttgaaagcagggaataatagcctacaagaataagcacactaataacaaaagctaacaaggtgagaattgaagttaaaatttatttttatccacttaactaatactttattattttattattattattattatttttattttgttctttatttatttatttttttgagacggggtcttgctctgtcacccaggctggagtgcagtggcacaatcttggctcactgcaagctccgcctcccaggttcacgccattctcctgcctcagcctcccgagtagctgggactacaggtgcccactaccacgccagctaatttttttgcatttttagtggaggcggggtttcaccgtgttagccaggatggtctcgatctcctgacctcgtgatccacccacctcagcctcccaaagtgctgggattacaggcgtaagccaccgctcttggctgttttaatattttagaaaaaggattatttatttttgaatttttggcaagtttattggatagggctgttaatccttgtagcgcttttgttatagttccatcagggcagtattattaggaacaaaggtacaatattgagttttaattatgacacaaacatctcctttttctgctaatattatatttaaagctattttatttttctaggccatctggcttagcttagatatctctttgatgtttagcaatctctttgatgacgtcctcagtgtaatgtatgaattgttgctgattgtagtagatatagtttatttagtctacatttttttttatttaaagttacttaccagaaatacgtggattcaaattgtgcagctgtttgattttgtgctttaaacttatttggcacttctcaaaggaccttaatagcatttatgtaaaactgaggattaaaggattcataaggagtttctcttggcctgtggtgctttgtttttacttttttagattgatgaaatgccagggtgaaggggatagccaattggattagagcacaagtactgctccaattatttggcagagtgtccagtaaaggtgcttcacagtaccaccatacatttgcttggggatggctaagcatggactgatgggcaagctcttggaaaggctcgagctcctcgcatctttgtgtgcttccaaagaacaccaaattttcctcttgccatgagatgcataaagtaaacttggcatttagaggtggaagctggattgccttcaggggcttaccagcagagtgttgaatttcaggaaatagcagagagagcttggcatgatggattatcctaagtaattggattctgaaaaagagccaccatacagtccgtatctggtcgatgaggagaccatctgagtggaaagaggataatctgggcctctggcctaccgtgcatacaagtttaataatcgcttttatttaaagtgtgaacggaatatttaatccactccagctacgcatttgcatcttgatattttgtcttgatggctaagttctgtctgtcttagatctcttatttttacaatagacactctagttttattagatgtaggagcgaccagtgtgggatctagaactgaggctactgaagaaggggaagatgggggtaataatgcccgttttgtagagttagttaaggtggaggtagtgacagagagaaggacagggttacattgataaggctagcagttagaaggggtagtctttttagtgaaatagatgaagggttttagatctgcacaaacctttttcgtggaagtctaactttgctcctgagtagtttaaaggacgtagtcctatttactacaaggttaccaggctgtaggagcagaaaatcagtgtcttggctgcaggtgatcacaacgatgagtgctaggggtaactgtgtcaattagagggccaggatataaatatttgtgtgaaaaggctaactgtcgttgatcttttacatttccacaaggtatgatagagcaagcattaaaggcaatggtctgaggcagacttagttacattaataacaaaggagctagtaacagaataaggaaagaaaaggaagcaatatagaatgtatatgaaaattaagctttctttaacttagtagggcttgatcttagtacagtaacctaagatgttttcttgactcgagtatggtgggtccattctttcttggctgtgcggatggcagtctcagtggttaacagcataaaatagggtccttcctaggctggcgtgaattttttttctatcttttgatgaggatgtgatttttaggctggtgctggtgcactggaaattctaggggtggcacctgtgctaaaagacttttagttctgagggaagggaaagtggaagataaattaagcatatcatttctattgcatatcttggggcttgaggcctcatggtgatgcctcccactccattccttctcagcgccgcccagggtacgtggcggccttgatccctcttaaggtcttggccatcttgtggccttcaccgcccctgcgcgttgtggccttggggatgaggggccttgtgacttacctggccaccttcaggccttaagaaagctaaacaccattttatatttgacaatgctttttgtatgattttatacgagataagttaaattttaccttcatattaatgtgctattaatgttaaacttaattttaataaaatcttgtagacattatttatccaattttaatgtctgactataaggtaagatttttatagactctttttaaccttttataatttttgttaaagagcaggttagtgctttaagaaaaatctattgtgcttttattttaacgttcagttcacagaaaaactggatgatacctctttaactttagccaatatgtttacacacagaatttcctttacaattaacattttaaaacttgcttaaacctttaaaacaagttttttaaccttttaatataggtaaaaatccatattcttatgcctccttataatcctgttattaaaagtatattttatttttcttacatactttgtacataaactgtttttaaaatagttttacattcagaaggcctaattacttttaaattatacaatatttcttgcataaattcctttttataactttccttatgactttcacagacaatcttcaacatgtcttaactttctgccttccttttacactatttcttttcttagtttcaccttctgggtctttctttgatttctgtctcttccagtttctctcttactcttttattctatttctctctctctcatttgcactcttattttcctctctctcatttgcattctatttttctttctctgtctgtcatcctctgtttcttttttcctttctgagttttcctggtcttgcagctggtggggctgggcaaaggcatgggcctcgcccccaagtatgcgctgccatctatttctcctgtttttatttttttctgatttcattttttactttttttttccctttcttcctacacttagtttctcaggctgggtgggatttgcacggctgcagtcctggccctgggccttcaccggccttgaggcttggcagatgcctgccgcaacttgcaagaattgtaccttttcacctcttctgctgtcctcctggcactggtcctcaccctctttttcacacagagctgggctggggagagggacttaactttaggttagttaagttaaggtgcctggctgtctggcaccatgcttgctgtttttgctctctttctctctgaatttcctctcctaatttctttttcctctctgctggtctttcctttgcctctgccagccacctatgctgctgttttcctccctctccttcctcttcctctaggggagccaccggggagaggagcttagcctttttctttcctcgggaagagggggaaggggagttttgaaaaaaaaaaaaaatatatatatatatatatatatatatatatttttttttttttactaccagaggtttgtgtgaggttcaaccccctctcaatggggatttctcacctctttttgaggttcaagcccccctcaatggggatttctcacctctttttgaggttcaacttctacagtggggatttctcacctcttttttgacctccaagacatcctgactaaggaatacttcactgccccctgtcgctttctttccttagtcctgcccaaggaatgctttatcgcccctgcagtttctccctccttggtatgtcctaaccaaggaatgctttaccaccctgcagctttttttttagtcttgactaccaaggaaatagtttactggctctcctggtgtttctttccttggtctgtgcacacagtttcctggtttaggtgatatatgaggatcttttactccaggtcaccggccagtgttttttctttttttgcattgctgagagtccgggtttatttgtcacagtgggtgggtctcgagtccttatccctgaggccactgcaatgaggcagaggagcatgctccttcatgagagaggactggagaccatccccagaggagaatgtatccctgtaccagccaccaaattgtttgaaatgcttgttcttcggtgccataaagaaatagcacctgaacataaatttaattttctcggcaaggccatttttatactttctgcagaaatgttacactcgccagcagttttgccacaggagtacaccgaacaaagaagacaaggtcatttataacttgatgtgtccaccttactactgtgtctagtttctattggttggaacagggcttcacattctgtatttgtcttgattggctagcaatctagaacatttttaaaagaggaaaaggcagaggagaacaaaagaaggagaaagtaacttgtggaatgctgataaaggtaaaaacaccttcaaataacgaagaacaggctgtgacctaatgcttgcttggaccagtataaacatgccagggcaaatatttaggctaaattgtaggagctaagaacataaagtacattgatttctttattatgtctagcagatatttaagaacgttagcacaggtctttgaataaattttgcttctaagagaagttactatttattcctaattagatggggtggaaagtcttcgaagaggaacttctactttacttttcacaactgtatgaaccggttacagaaaagagaaatgttctttagaaagtgacaatccttatggagaaagtggaaaaatcctgaaatttactgccacacatgcatactttcagaaatttgcataattgtagaactcttcttcccatttgatcaccccaccccatctttttgttctttatttactattatttcagagggattcaggaaaacaagagagataaatgcatgaattccactctacactgtgctatggtgccaaattaagtccacttagttggtgaatttaaatggtttaaaacaacagtaaaggggaggagatgtgctgtagaagaaactgcttcagtatcatgaagtgattgatagaaatagtagattaccattccagagactgaagataaatttcatgaacacttctaatggatgacttgggtctggacctaacagaatcattggagtccttcctagagatgacagcaatctttgtttcctacaattcttggttcttccaagatccagcaatagggtgttgatggtttaagacataaagacaatataattcttactttcatctcatttaatcttagaggcatttggccaagctattttagtttaggttctacaaaagcaatgcccccaaaacaaggacttggctacagatagattatcctgtgggtgatcctgccttatttaactggggctcaatccaacacgcatatgcccccaaattgtccaactgggacaatgtgggcagcttggacctggctcccaacccacattggtaaaggtaccccccaaatatttcctcctctctacttctaggctgaacatgcacactgggcaaatgggctctcttggatctgaagactgctctacagcagaaaagcagagagacatgttgggaggacacctaattcaagttaatagagttggctggccagtttacagactctctctctttccctcccttgtcaacttaagaatttgggcaattgattcaaaattcttgcaaaggcagatttgggtaactagggtctattgccaggctctattgataacagagtacatcctcactgagcttcctcctctgggtaccagcaagcttctggtgtcaatggtggggaggtcattatgtgctcaggtccacatctctgatggataaatatattgaatattacccatggatacccagctaaagtcagcagcatgaagagatgaagagttcaaaagaggcaacgactgagaagagctaggatgaaagagaaccagcctacaacagatgggaagtaacccttgttcctggtcattccgtcctctgtgtcccttctgtcagggacctagatacacagcaggcatgcccctgtacccctgcccactacccagtctctacgtgagttggataaggagtactttattctatagtcttggatgaacatcagctagaacaatggaataataatgagaatttaaataactaaattcttcaggatttcttgaatgcctacacatacattatctacttcaacttcataaagcctgaatgaaatgaaaataactttaagataatgaatctcagacacaatggaggaaaagctccagacactggctgaggaggacctaggacctcagcccatttgcaggacactttcctcttctatcagacacccatgctcccctccatctgcagcctcccacacccagggactaaccatcagaaaaacgcctagtatctcttccctcacttgcgaattccgcactaaatgcatctcttcttgccaccttttacttaactggctgcacttgactcagccccctctgctcctactgtctttccaagaaagtcacatctgatggatgtacatttttggggttttggaaaccgttgactgttgccacaacaaggaggtaagatgcgctggcaaaatcctttggcacctgccttgctgtggctgagtggggctgggctgtaatggcaagagatagaggggctctcgttatgggtgaaatctgcatggggctctttgcatactagggcaccagaagttttcttagtgtggcacccaccgccctgaggggtatcactgatgatcaacatccaaagaacctgaggcccaaagcagagatagtagctccaaatctctcattagatggaagactgagattcccatctgattttttttcaaaccagccagagtatttggaacagaaatgcctaacttgcctgttaaaaagtaagagagtgttgatatttaagctctggctggaatttaagactctggctttttcttgaaggctccatatatgaaaaagaaaagtgaaatcagattatgctttttcctcttcccaacaaagccagtatttccaagagtgaaaggctgtctgtccagtactcaggctgcccggtgtggatggctcagtgagagaggggagggtgagaagccattggggccaaaactagggatctcagtgactgagaggagtggacaagtcttcagtcagcagagttggatttgggatgacagaccaggatttctggggtcagtgcaaaggccggtgagagcctcctccttcccttctctgctcagcccctggggtcttcttcctccacaatgagtactggtgaatctgaactcttttctctgcctatgctccactgagggagaccaggcctttgggtcctggggacagagtgagatagaattaaggaatctgctctggaatcactgaaagcgacttgatgtcttcacatcactgccccctgcatcacagctccaaaagggacacattatagtccccaagaattggctggaatactacacaggtttgttaattctctggccatgctcagggaatatactgtctcccggtcacgctcaggtaatcagaagtccagacattctaataaacaagccctagacccttgttgaacttaaatctccctcgccccagctcagtcctaccttggagtgagaaatcagcaggagggacaagaaaagagtcagcttctggtcttttctttcccctacctcctctgctatgagcatctgatgtttgggacccttacaaggtgtctgtgtgggagtggggagggtggtaaagggtagagaagtggggagaggagaggcagtggtgaaaatcaggacaagtctcgcttgtgatatggttgcaatctggctgtaatggcctctggggggtggtgaatgttactgactatcctctagtatgagggaccatgagggaccctctctaatattccttttgggatctttgagataggcaaagccctaatccgcagatttcctctcacctcctcggtctctgcaacaggtgagcccagtatctttcaactgaggtcctgttgactgtgttctgcacactgggctcttccctctagcccttactgttggcctttggtgaaggcacatccacgtgccctttctgcctcctcaatctgacagttgtcctgttctgacctgggcaaggagttgagggggcaaagccaatctcatagctgcataagtggttttgcaacttcttagttctgtaaatctccagaaagcagacatactatcatcttactagcctcatagccaccttgtgctggggcatctcttctcttactttaaacaccctgggggcttatggtccccatttaaaacaaggaaatgagattctctgagaggtgaagcagataaccaaggtcactgctagtataaacatgcatgtgcaagtgtctttttcatataatcacttcttttcctctgggtagacacccagtagtgggattgctgggtcaaatggcagatctacttttagttctttgaggaatctccatactgttttgcataatggttgtactagtttacattcccaccagcagtataaaagtgttccttttcaccacctgcatgccaacatctgtcattttttaatttttaaattatggccattcttaacaggagtaaggtggtatctcattgtgtttttaatttgcatttccctgattactagggatgttgagcatgttttttcatatgtttgttgaccatttgtctatcttcttttgagaactgtctattcatgtcctctgccccactttttgatgggattatttgttttttttcttgctgatttgtatgagttccttgtcgattctggatattggtcctttgtcagatgcatagtttgcaaagattttcccccactctgtggattgtctgtttactctgctgattatttcttttgctgtgcagaagctttttagtttaattaggtcccatttatttatttttgtttttgttgcatttgctttgggatcttagtcatgaattctttgcctatgtcaatgtctagaagaatttttcgaatgttatcttctagaatttttatggtttcaagttagatttcagtctttgatctatcttgagtttattttattattattattctttttgagacggagtctcgctctgtcaccaggcgggagtgcagtggcgcgatctcggctcactgcaacctttgcctcccagattcaagcaattctcctgcctcggcctcctgagtagctaggactacaggcacgcaccaccatgcccagctaattttttgtatttttagtagagacagggtttcaccatgttggccaggatggtctcaatctcttgggctcatgacccgcccgcctcagcctcccaaagtgctgcgattacaggcatgagccaccgcacctggccgagtttatttttgtgtaagatgagagctgaggatccagtttcattattctacatgaattatcacattgatttttcccgcagccttttctgataatgatcaaacagaggaaaagcctgggatttgatccacattgttttccgggcacatggagttctctgatgcaccagcctccacatctgtgctaaggccaggtcttactttgctataagtacctttgtttggggatcaagataattggcatggaattaactatatataacctcacatgggaaatctattaatctgtgttcttcattctgcatgttttactcatgaaattaattcattggattatgaccagcattaaaaaacaaacagatgaaaaacattcatagaatggaataggagttatagggtgtatttaaggcaaattgttctgtaatacctcacattcacctgtgtgcaggtatttgtgtgcatgtgtacttggttcctatatgctcacttagtaaatttaggaatatgctccttctaggatctggttctttttttttttgtatggctgccactctgtaattgaacctggttccacgactccctttagaagggcctcctcctcctcttccaaaaggactcctctgcccctgtctggaggaaggtatctggcaatatatctgggcaagatattcaaagagctgagcttggagcaattgtaacccaggctgaattctgatgacctcttctaaacttccaggtcagtgctcctggaggctcacccacacaaacacataggcacactaacaacacctggaagacacaccaacctcatgcagaggaaaccataccctcactggcctggcagtgacacaggggcctgggcaggcatagcacagaagagtcctggtgtaactgagataaagtatctcaattgtacaaataattattttcggctcggttgtctctagcgtgcagctggtgagccttcaccatgggcccaggagaagcggatcatatgaacaaggcctggggatgggacagttgagctggggctgcaggggctaaggctgtttcccatggggctcagcactggtggacaggtaagcagacaggtttgaagatgctggctcagttcacagacatggtcacagaaaaagcctggaaaactatagggttttctgctgacctcccacactcaccatggacagtcagtaccctgcactggcccgtgtcgtacccaagcagagtgtgcttgaaaattggatgtatattagtagaccccgtgctcagcgggtacagtttagaaagggaagttaacttatctgtcaattagtaagttaacaacacacaaagtgtactatgttttattaatcaaacaaaaatatgtttaacacctgctgggcacaaggagtacaatggtaaagagtttaatggaaatgtttaatggttaatgccaagacctgtgtatgtattaatatgatgccaatcatttaatacctgatgaagcaatagtttctgggactacttgggttagaaaatgggcctgccacaggcccaagcccatcccctaccctgcatgtgctcctgctccactcccttgtgcatctatccggtataatgttgtggggaaggggagtgctcgattcctcaccttaaccagcctgccagctatccatgcagagacatgtgggcaaaactcctaaggccagacctccccactccattctcctgctaggctgctgagggactccattcgaacctggtaattaccctgcctccttccctccagattccataggttacctcttcctcttt

SEQ ID NO: 54 - DNA, 35980 bp, Homo sapiens
tccactctggatgagcaaatgaagttaacttcaaagcatacttcaaaatgtgtgaatgaaattaatttcaaagcatatttataaaagttataagaaaatcacagggagattgagggaagaggagacaatatatttttggagaatgaatgtaaaatatggttttaagtgaaagattttaattcaaagctcagccagaactactcctttgcaattaggagatgtgtttaatgataactgtgtctttgtacatttccatttagttcctgagttccatgtggaggaagtgatggaaatgacccagttcactggaacaaagtccttgtcttttctttctgccatcaagtaagaatgccgaccagtgctggagctgagtgacgatgccctgtacacccaagatttgtgtacaaatgagtcagggccagcaagggtagaaaaggcagctgaaccctcctgaggctctgctcccccgagaacataaagcatctaggagctatgtctagaaaggggctttttggccgggcacagtggctcatgcctgtaatcccagcactttgagaggacgaggcaggtggatcactggagctcaggagttcgagactcacctggctaacatggtgaaaccccatctctactaaaaatacaaaaattagctaggcgtggtggtgcacgcctgtaatcccagttactcgggaggctggggcaccagaatcgcttgaacctgagaggcggaggttgcagagagctgagaccgcgccactgcactccagcctgggtgagagtgagattctgtctcaaaaaaaaaaaaaaaaaaaaaaagaaagaaagaaaagaaaggggctctttacatggtatccactggggtccagggctcctctgaaagcttggcaaaaattttgtgcttatggcatttttcttggaagaaggtcacagatgtcagcagattctcaaaagtgtttatgactaaaagagaagagtgagatttgaaagaacatgctacccacggggtcagggcagacccacggctccttcttggtgctgaggtgcccaggcaccctctttctcgggcgtaaggccccctcactattgtagggtgggggttagacaaaatgattctggatttcccttccaactctcaaacaccatgaaaggaaatggaaggagcaaacactcttgctcacagtgacccttgggcattctaactgcggaagagcatgcggtctccaggccttgaagactcagcctttgaccagctccgaagggtgagacgcgcatctctcttccatcacggttacattcagctgcaaggagatgtgactgaccactctgtcactgttgttactgattttgttaccaattttcctgattaaaacagtatcaaagaactgccttattgtcaaaggtaaccaccttatgcttaaattcacaaaagtagccacagaatcttcaagataatgcaagtagctaattatgaagttattttgaaatatgggcactctccctcctccctgaaaacccccaccccacctatgtgtattacttcagtcaataaataaaaagcatttcagtgctgtctacagtgaaagagggaagagggaataggacagagaaatggaacccagacccagaccccagtatctcaagaaacatcttccttctttcaagacctttgaaaacacaactgggccgggcgcggcggctcacgcctgtaatcccagcactttgggacgccgaggcaggcggatcacgaggtcaggagatcgagaccatcctggctaacacggtgaaaccccatctctactaaaaatacaaaaaattagccgggtgtggtggcgggcacctgtagtcccagctactccggaggctgaggcaggagaatggcgtgaacccgggaggcggagcttgcagtgagccgagatagtgccactgcactccagcctgggagacagagtgagactccgtcttaaacacacacacacacacacacacacacacacacacacagctggtactcatctctctggaatgcttctagtccttttaagcagagaaaagaaagtgagccactgagtgtccttccactcctgtggtattaagtactaaacagcctgaagtgcttcaaacacagacgtcagatgaacttggctcatcccaggcacaaagccacaagcaccatgaatgacgttaagtaacatgactaaggctgactggtgaattctcctggccacgcctcatgagaaaacaattacaccaatactctgaattggacctgcatattggtgaagtcaaaacttactgccattagttttgaaaacacagatttaggaatttgcagaatattttcaataagagaacaaacagcaatgtttctgcctctcagtgtgaaacctcttgctaatattgatcaaaagcatgacactttatcatctatctgtgttcatgttaaatctgtcatcagagatggtgatggagaaatatctaattgccatgtaaaaacacacaaaaattggacatgctatacatttatcttttaaaatgtagtctgtattattttcaccaaccaaaacacacataatatattttattataaaacattagcaatgttacttttgagatatgcaatctgaaaggtcacacttgtatttattaccaggaggaaataccagaggagtcacattagaaatcaaccagacagactcgtacgtggttatcgctacttacacagcattaaatgcgggttgaagcagcacccgctccgtgtttcagacacggacttggggtgggcaaggggccctgtaagagggcttcctcctctcagtactggggctctgcgtctcacctgctcccatctccaggcccacggctgacacggtatgcacagccagggtttccagactgctctcctgctctcacagaactctgtctgctctctggactctgcccttgaaactgagacctggacatgggggagacagtcgtttccttcttggctggaaactaagtcaacaaatgaaacaaacctagtctaaattccaggataatagtaaattacctggtttataaaaatacatgtccaaaatagttacttcctgggttgtgtacaatataaattacaaaaataaaatagaaaagatgaaacagttgagcacatttttcagttctttaaccaacatcagcatttatccatagagatcagtttgaaaccatttgcgtggcaccaagaccctggcaaatctaggctcaggagagagaaccctgaagctggggtgaggtatttctgtggagccctgtggcctgtcctaggcacgctcgcctctacctggtggaagatggcctttccaggaaaccctccacaccgtcacgggctccatctgtggcaagtggctcgctgaatgcacagaggagcgagtgagcagaagggcgtctgcgggtgcctcgtcccccgtccacgtctcccggggagggagcatcacacagtgcagggcagctcgcgcattttcaacctctcccttttgtttttccttttaaagatagatttagtgaagtcttttaaaagaaagtgtattacagagaaggccattttaagatgtttagatagatagccataaaataggtgtttccgcctcaatccaagttattattaccattttgtacttgaaagtgtccaaatgacacaatataaaagaactatttcttatttcaatattaattttgctaatcaaaggttccagtttccagtgatatgaccaaccaataagatataactggtgcagagagagccatatattttacataatatttataataaactttcttatcacagttcctcctcagaacacactctacagaatgtcgactgaaaagcttccaaaataattgaacacaagatatgaatcagcaacagaataagctcaagggaagagacatgggcacaggcaggcaaaacgtgatcaccacagctccgttcctgcagtgacacttaacatactcagcatcttcatgaattctgaataatttactgatcgtaaagtctaaaagtatcaatttcaggtgagcagttttaaatcagaaaatagtcaatagttaatcatgactcttcagggtatttccttcacgtcctctgaagagtttcccagaacattcttgtgaaaaggaatgcctcccaacaatggagagcaacaatagcaacaggcatctgaatcagcctggcctctgaaaacagaccaaagaggagtttatctgctttcttccagtgaagaaagaaaatcaagaacgtggtattggccgagggaaagtgaatgagggaaggtaaataaaggacccaggccagtctgtggcaaaggaagcacttaggaaatgactgcagtgatctctagtgagcattttgtaaaattccactccaacgttaggccatggatgcaggaacctatctgccatcatatttaattaagatggagtgttacgcacctaataaagaaggtgaagttctaggtagcattttaaattcataagaagtctagaagaccaagaagaaaagagataaggtagctaggatttcaagcagcactaagcaaaacttaaaattgtatcgtgcagtaaagctgaatgtacaatcatcccagacaagacagtttaaagaaaacaagatgtccacataagtgtcttggttttagccgtgataattctcagccccaaacatcacaaatctaagaaaagctatatatttttatttattaaatagatttaattatatgtcttctgaaatacaaaagatagaataaatcatagcataaaagggaataagatatgataacatcatgatggccaattaatacacataaatcgactttttctggacagacaccaaattacttaagaggattaagagataacttcagaagcagcactacctggaagattatttggcatttaaatactgatttccaaagtgctagatgggcaagtccaagcaagcatttgtggtcacatgcacatacatctcaacagttacagatgatgagaaactgtcactagtacaatttgaaacaaattcacctactctaactgctcacctgaaatgatcttgaacaaaatctctagaagtgtggcttgcaatttttttcttcagacatattctgcctcattttatcatctaagcaggcaatcctatcaggtctgagtagggcaaggcattgtgtttcttacatgcagaacatggagtttttctatttggttccatcaactcccaagcatttcaggcccacggaggtgagagttccttcaatgctgacaggtttgctatttctaacctatcatcgacagccttcaaggggtcccgtcgaggcatcaagactgctgtctgtgtctgaggccagcgtctgctcagtggacatggatgaaatgtcattgatcgatgaagactgagaaggagtggcgttgctacttactgctgcatctgtgctaagaaaaccaaatataataaaatctgaggcacgacattgctgcaaatccaggcagcgagactgcaggccatttctcggctctgtccttttgcagtttcccaatcctaactatgagtatagacaagaagtcagtcagctggactttctgaacttttccttgagtctttctttgggccaagagtcccatattcctatgtctttccttgcaagattcttctttttttctcagtagctaaacatatatgtggccatgtataatcatgttagctacttaaaaaatacctgctgctttcaagcagacatcaaaaggacacagctatatttatctgaaaatgcagtatcacaaaagcttaagcctgactaggattccagtgtcaccagacacttgaattgtaacaatttataacataaacactaaatctacaggaaaaaaagcatcaactttcaaagaaatcttttgcaataaataaagactatataccagaaaaaggaaaaaaattagtggccttgtatattttatggttttataactccagaaaactgacattttaatcttttaaagcaaatgaaactatcctacttcctactatccatattttagtctggtttgaataaaaacacaacatgcactctctgagatcgacgtctgcagtcatacgtgtgtgctcagttaacaagcacctaagttcttgctgaagttatataatctctagatgcttgacacatacgtcatgttgaacataaaattcaagaataaaaagtaagctgtgctctctgcacatccgcacacatgtgtgtgcatgcttcccagtgggagtgggagagagacaatgatataacgtgagcgtttcatttagtaaacaggaagaatccttcagacgtaagtgaacacgactcatatcagagtctcatgatcatacaactacctggtcattagaggcttccaccactatgaagatcagtagatcaagcagaaaaatgggaaaatgatatcaacaattttctcaaaaagaataccatactccattttacttagattggcattttgggtgggaccagtacaaagggttatcaacattgaaaaggctttaaattcaatttcttcatctgtaaatggaggtgacagcagttattgcaaagatgaaagagaaatgcttataacaaagttcagtgcctggcacatcagtaaaatgtcatccaccaccaccaccactatgacaagccaaaaaggctggctattcatacagcggtttttaaatctgatgctagccaggctggcatttcacatgttgctgccatttataaaagttgaatcgggaaagacgccaggtgcggtggctcacgcctgtaaccccaccactttgggaggctgaggcgggtggatcacgaggtcaggagatcgagaccagcttggccaatatgctgaaaccccgtctctactaaaaatacaaaaattagccaggcatggtggtgcgtgcctgtaatcccaccactttgggaggctgaggcgggcagatcacaaggtcaggagatcgagaccagcttggccaatatggtgaaaccccgtctctactaaaaatacaaaaattagcagggcatggtggcgcgtgcctgtagtcccagctactcgggaggctgaggcaggagaattgcttgaacccaggaggcggaggttgcagtgagcagagatcgcgccgctgctctccagcctgggcgacagaacgaaactctgtctcaaaaaaaaaaagttgaatagggaaagaaaaatatcatacaatcaattaaagcaatcactaacctgaaggctgatcttttacaacaccattcttgcttctttcttcccaatccatgacttctttgtaaattagctctttaataaaaatacaagttaaaatgcttaatcagtttctaaacagtttcactgtatctctaaactctgcttccaaatcaactggaacaaaggcattgcgatttgttatttttaattgtaagacagagtcaattcagtaatatagtctacctggaccaaaatattcatattttgatacattatatcttttcttttcttcttcttcttttttttttttttttttttgagacagtctcatgctgtcatccaggctggagtacagtggcatggtcttgactcactgaaacctccacctcctggattcaagtgattctcatgcctcagccatccaaattgctgggattacaggtgttcaccaccatgcctggctaacttttgtagtttttgtagagacagggtttcgctatgttggctaggcttgtcttgaattcctggcctcaagccatctgccccacttggcctcccaaagtcctgggattacaggtgtgagccactgcgcctggactacattacatctttttcaatgcaactagtaaggcagcaaaacatgtagggtggttctggatccataagggggctttatgaagtggagtggctcccacagaacactgtaggggattggatattctcacacccatttgaatatgtttctctatgtggttacttggggttctccaaaggtaaccagcacccacatgtgggctaggagccccccacactggccagaaatgaatccacaggcctaagtcttttcttaatttcaacttcggttttcctcaactttcatctgtaagaaaaactaattacctacgaagtaagtgatgagggattcctaaaatgtcagtattcataaaccaacattagcacgttgcaagcattcgctgaggccagtgagcattgactgaggccagtgagcacgctgtgtgcatgcactgctgagcacgggcacacacaggtaaccggcactcccacaccccaggatggccctggggcatgaccctcatcagtgttgactgactctgactgtggttctcagttactactgatcctgcttcttaatgaaaaattgttagttcaacctcttcattacaggtatagtttgttgtgggttgtttggttaatcttatagtggtaataatacctatttgcatattttcaatctgcaatttcccccaaactagattttaaaacatatgtacaactacatggcttaaaaacatatcaatcaatataagtatgatacaattactaagctcagtttataaatcaatatgtgaaaagccatgaaaaaaatattatttttccctcttgaagcaaatgataagaaattcataaatgttcctctctaactctgttctcttcaagttcattttctactggaaactggggagaaagaggctaagtgggtcgcagggtttcttgccccttcctgaagggaaatgtcacaaaatgaaaagcctctgctctacaggattggaagaaatgtcaaaaggaaggatcaaaataagctccatctttacctttccattcttcaattgcatgttctctttcttccaactgggcatcataaatttgaggtggtggctaaaaattaaatcatatgtaaagtcaacagtaatgcctcaaaaaaaaatgaggcactaaaaaaggtaaaattgcttggaagacttctagtctatttatgatatggatttagtttaattcaacacgtggtttaataaagatttgtcatgtgatattatatcaactttagaatcaaaataattatgaaaaagttaaccaaagaagagttattatgttcctcttaataatcacctgacctcaaaacgcagacatctgcccagatgtcattagaaactcatcatcacaggctgtttcccagagacccattatggacaaggcactgtgctggcagctatggaaggtactgttgtttcttagaacaaattttacattttcttcatgggagaactcccaaatccaatgtccaactcataaatggactgttataaaagtctgcttataaattggattctttttatataaaacaatgtttaaactgatggcaaaaccacaggccatgacataaacatgtatttcactcatggcatgaaggaagcctgccactacgcagtgatttccctcacagctaaagctcactcacaccagtgctgacacagaaacacgcacgtgagcaccaaactcagagtggagctcctccagcgggggaaccaggagctacaatgcctttagggaaggataaacagacgtgtgatttttcagcaagttgctcagcctctctggttaagtggcctaaacaagaggatgtaaccaaagccaatggcacagaatagatgcttaataaactatgagctcacagcagcatttgcaaaatggagactggtagcaccaaagcggaagttcattcccgaggtactctgagctggggctccagcagcaaaagagcaagcgacccaggtctcagacaacacttggcctttctgtaactgggagcccccaaatggagaacttgctacccatatgtagccactctggacggacagacaagatccaaggaaatataagcctggcctctctatataaatcttttcaaaacagatactcacggcttctgcttcggcggggtcataccaaacagtgatgtatgggtgacgcagagcttcgtctacagagatccgcttgtcaggatcaatcactaacatttttgataacagatctctggcttgacttgctagggtgacaacaaatattaaattaatgctgttaatatgaaacaaacagaatcatacaataaagaactaaatatgacaacacagatagaacaaagatatattaattttgagaaatgtttgataggttcaagatgaatataacccaaaattttttttttttttttcggagacggagtctcgctctgtcgcccaatgcagtggcgcaatcttggctcactgcaagttccacctcccgggttcacgccattctcctacctcagcctcccaagcagctgggactacaggcgtctgccaccatgcccggataattttttgtatttttttagtagagacagggtttcactgtgttaggcaggatggtctcgatctcttgacctcgtgatccgcctgcctcagcctcccaaagtgctgggattacaggcgtgagccgccgcacccagccataacccaaacatttttaagaaaaagtcaaatgtccactttcatgacaaaccaggtttccaaatgtagttttacgcctctggatctgcaaggggaagagaaacctgggctcccagggtggtggggaagagcaccaggcagcctcagaccaatgtctgggcagggcccaaggctgggaaaccacagcaaggaaggtggcaattgccgagctgcgggtggcactgcccagagtgtgggcatgaggcacgggggagtatttttctctaagtcacatcgaaatgaaattagaacagacttttcaaaccacacaacaatctcacattcccacaggataaaacactcacagatgcttctggctggcctagctgtatacagtgctggcaacttacacttttttttttaatctacagattggtatttaggaaaaagaaaaacaagttcaataacttagttaaatataaggctcacctaggttttgtcaattaaagttcacaacctgaataagcaaagactggggcttttctgattaaggcacagtttaccttcatgcggacagaatcaaatcttttctttttccttaaacaatcacactgtagtaaagggtgcaggagaaggtggggaggaaggacctttttcatcgaacaactgtcacatcgcttctgactctagaatctgcattaagtgttcttcttacctgaaaactttttgaattccagttgctgtaactgtaacataagattctttcagactgatttgattatttttattttggccaaaggcttcaattaagccgtcttatagaggataaagcttctagacctttaagctttctctcctcagtgccttcgtacctcagacttcaggcctaaaatgactttctctcccaaaacacaggtttttagaatacaaacatgaaagagtgaaagcaccacctgaattacaaaacacaagtataagaaaaaaaggatatcttactttttattttgtctcgctcagattctgatgggaatatccaatctggaaagagttcttcaaatttgattccaggatactttggtctgttttcgacataattcctcacagttggctgaagtttcttcatgaactctgctgatggtgttcccagctgctcaataactttattccactgatcaatatctaaggagtttcttgaggaaaatacaactgaagtaccttgtattcacagtacatgcggcagcatcacttgaataatatttaaacctatcgactaggccaccccactggatcagcagcggaattttgaaataatattcaaataaggtttgggtttccaagttacactattttttaaaactctcacactctgcatcttcataaactatgatcacagtttattaaatcaacacaatgaagtctacacaccttcccactctagttcaaaataaagtttatcttataactaagaatacctatagcaaaaatgattaaacacgaaattagataaacattacataagcaaattgaaatcagttttcatactaatgctaccttagattcattcacagctctctaaagaacagaggatctcaagggacctgtggagagacctatctgacctcctcagtttacagctgggaaccaagcaactgggcttagactgagcccagcgacagctttcaaatgatgctctattttacttggaactgactcttcccaaccatcactgcgatccctaggtaatgcattttatttcctttcaaagtgcgtgacctgggtttcagactcaactctgcattaaacactcagtgtgtcaggaaagtcaggcttccttggggtctgtttccttatttgttcaatgcagacattaccagctttgcctattccacagggtgcttgttaggcttgggataattaggattacatgtgggaaagtgacactgaaactgtactcgctatacaagagaatgcaagtgagaaaaaaatagcatcaacagcagcttaaaaaagtgctcactgaggcatgtcttagaaaaatgaacttacatcaccatgaaataacctagggaactggtacatgaactcagttcttccaaaatgttatacttccaaaagacccgctcaggaaatgtgtttctggcattcaattcactagcaaattctccttcctactcctggttcatacatattgtcaaatcagaattatgcccacattttatttacctatttagccaaaatgtgaaaactgtctcacaccttttccttctgccatatatacatatataaataaagacagagtctcgctctgtcgcccaggctggagtgcagtggcatgatctcggctgactgcaacctccacctcccgggctcaagtaattctcgtgcctcagcctcccaagtagctgggactacaggcacctgccataacggtcggctaatttttgttatttttagtagagatggggtttcgccatgttggccaggctggtctggaattcctggcctcaagtgatctgcctgcctcggcctcccaaagtgctgggattataggtgtgagccactgcgcccagcccaccttatacttttgatacctcttctgcctgctcactcccacagacttcccaggatgcacccacccagcatctgtgtgccatttgccacacagcaaccatctgggctcccggctacactaagcctgctcagctctagaccctaacccccctgactcaaggacaagctccctcaactcttccttctccaacatcatcgacattttgcactctaccaatacattccaccacgttggtaaatgatggtgttttctcctatgttaacacagtagctgctttcctttggccctacctatcgctttatttcttattcctatttgcagcaaaaacttccataaagagctgtcggtcgggctcagtggctcacacctgtaatcccggcactttgggaggccgaggcaggtggatcacaaggtcaggtgttcaagaccagcctggccaagacggtgaaaccctggccctactaaaaatacaaaaattagccaggcgtggtggcgggcgcctgtaatcccagctactcgggaggctgaggcagaagaatcgcttgaacccaggaggtagaggttgcagtgagctgagatcgcatcgctgccctccagcctgggcaatggagtgagactctgtctcaaaggaaaaaaaaaaaaaaaaaaggaaagaaaaaagagctgtctacacttgtgtctctaattcccagcctctcattttctctcaaacatactcccatcaggctttcttccctccactccataaatgctgtgcccatcatggctgccagcagccatcacaaggcccaggggccaatcccccgtcctcatctcctcatgtgaatgagcctccctcagtcaccacactctaggaggaggggtcacgtgagtgccttctccatttccttccctattccctttgtccctccacctcaagggggctaagtcccgggtcctggtctcttcctcccctgcaagtgctcgctaccagtcctaggcttcaaggctaccgacagacggatgacacccactttgatctctctatcccagaccttgcccctaaattccactgtctaacagacatctccaaaccctagcaaggctccttgaagggtccagcttcaaagcagagtacaagcccatctccccggccacacccctacccgcctgctgggggcctccacctctcctctggatgatggcagcctctgctctgttctcctgctctgccctgcccttgacgatccaccctcaattcagcagctgggaggagcctctttgcatctcagtcagactaggcacccagaaatgggcaggtgagagaaatatctgctgggttaatgataaaggactagaaattaaaccagttgtgagaggagacccacagattccccgagaggactccaccccagcatcctacaggtgggagggatgggggacagatgagagggacgggggaaggggaacaataattccgacaagcccagtggaccctgttgtctaactctcgtgaagctgcaggcagaccacaggtctattttacagaaggggaaaccaaggctcagagaggccctaaatttctcaaggatgcatggctgccaaggggaggagtctgagctggggcccgaggtggccgggctaaagctttctctttctcatagaccaccgcagggacaggagttccttttctaccctgggtcgcaaattaaagcaaatctctgagaccctcagtctgatttctgcaacttttttctatctcccaaatttcaatctaatatttgaaagagttggcaaaattttctttagaaaatgatgttaaactctgtgtggcttttgggaataacattaggtaaccttatatataacactattaattactgacattaatgttcatatgtatagcaggaattttaattttacttactaaaatgcaccaaaaagtactcacatttttcatttttgtactttttgaagaaaacattttgtaataaaacaaggaatggcacaaaatgagtaagaattgagacaaactgaacattaagtagatatttctaaattattagtcttttaatttttcaacttttccctttttaattaagtttacttgcaaaataaagacgtccttatttataggttgcaacaagtgaatctgagatgaggctatggaaactgctagaaaatttagtagaacaaataaaataacttgacatattatataatctatgatatagaaaatgtaaagaaaggtaaataaaatgagagaaataaaaatattttcactttaagtttgcactgtgaagaatttataaggagaccactttgataaaattattaaaatctgaaattattttcctaagatacatacaaaacactgactatggagcttgatttccttaaaagcaaccatcaatctgcccaaggatggagaccaatttaaactttcataacgaaaacaaagtcaaagactaatgaaaaactaagtggttaaaacacaaatgaaaaagggaagatgtgaagaaccatgttagggtaaaaaatactgaggatggaagaatggcaaatgaggaaagaaggctattgtaacaattagagtagttattctcctttctgctgtatctctaacatgacttgctgactacagtatgagtttatctctttcattttacatttattttgacttccccagtgtgtcacaaaataacccactagacagatttttaaaaaaaattctacaaaatgtcagcacagtaacaaacaagaaagtttaacatattgttcctcacaaaattttcattttaatctctttcacttaggtcctttgtaatgtgcttcagttcttactttgggggaaaatatttcaatgcataccagtaactaacaaaatagtacttaattaaagcacacaagcacactagcctattaaatttagatagcatctttcctagttaaattaacggaataaactaaataatacagtattttcatttaaatatcagaatatacttatcaaagagtaaataatttcttctatgtgtccagctatttttggcaaaattaagagctaatataatcggtttaactgaactctaagtctcaaagtcatcacaggtagtcaagttaaaaataaagaatgaaattgaaccacttggcttgtgacactaattaacaaatacagtaaagccccccttagaacacagtctggagtggattttacgactttgtcctcgtgagcgctcgtgtaagcaggtggtcatgctgcctgaggcattaagaaagcatggcggggccaaggtcgcggggaaggatacggtcagtgccttggaatatcacacaacctttcaccagctctcccatgatgcaacccactgaccagatatcaactgaaaataaaatgaaatgataaaattatgaagtgccatgaacaaaacaaaagtgaggaaaaggaattctaacagtgcactaaacacacaaatatggaaaaataaattgctagctaagggtgacattttacacaatatgaatgattgctgacctctattttagccttcggtttgtagcaatctggggttttagtgccaaagagtccaatactttatagcttaaaacaaacaaacaaacaaacaaaaaaccagaaacaagaagtgcctgtgaacacaaagcttttcagggccacacgcccaccccagcctccatggccaagtaccgggtcccctgtgaaggatacagtctcttcccgggaacaggactttatggaggaccatttctgccatgatgcacccgacagaccagatgtccactaccaaacaccaggggattaaaaaccagctagagtcccccatcttttttcttcaaaccccctcccaggacaaacccggtacacgtcactagcttgccggcgggagcctctgtgcgttgttgataccacacctcctgagcgatcattttctagactgccccgtcagaaaggcagcagcactcactggcggcacaggctggctggcttgcaggactgcaggtgaggccctgctagaggggcccagacttccacggtgcccaccctcatctgtggggcctcagacagacagcagaggcctctaagtgccctgctggcgggccgaggggagaagtgaacaggggatcaagttttctctcccctccacaggaagcacatgaagctgtgcccctcagggtgggaacacaagctacaacgcagcaagatgaacctgtagcaaaactcatttcagatgacccgggcaaactttcagtctttttaaaaataagtaagcgtgatttcgttattttcaacaaatttgctaaaagccaagtttcaaagagctctgatattgctagaataagctaagttttgatgtaaaaagacaccaattttacatgaaaacatgtgttattctatttacatcaaattcaaaaaaacaatatgcagaccaacaaataaagctgatccatggtactggagatcaggagattggccagcctcgtgggctgcgaggaggggccatggggaggccagagctgctgctgctgtgggtgtgctcacctcagctgagctgcacactcaggatttgcacacttggctatagacagcttaactctgattaaaaagttcaaaaataacaattttaaaagtgaatttttaaaagagaatgattttaaccaatggaaaaacacaattaattatttcttatctctggatcatgctatattctgggtgtaacagtccccacagtatatatcatatggttcaaaggaaagagaaaaaactcgagaccaccgctagagcaatttctaaacatcccagcctcttccagccccggctatactcaccgttctctttgtagcccatacccaggatgacttcgggcgcccggtagtaccgtgtcaccacgtaaggggtcatcatgaagttagtgcacgctgtccgggccaggccaaagtcaaggatcttcagggtgcagtctgatttcacaacaatgttgctaggcttcaaatcctaggaaagaaatggcttaaattagtaaaatgaatgaagcatgctaaataaactacttcacatccgtgagggtcgtgaagccagtgtgagagtgtagggagtgaactgaactctgagatttgggaacaactttggaaaatcttactctcaaattgaaactaaaacaaatcagcctaaagccgtcagatggtgccccttacccccagtggaaaccttcatggcccccatttgccctttctgtggtctcgcaggccctcaggctgtcctatctaccctccatccatgcatctacacgtccagcacacatgcccccctcccgctctccacgcctggacttgagttccccaatactctgactctctcttgctaaggtcctcatgctgtcagtccagcacacacggccccctcctgctctccacgcctggacttgagttccccaatactctgactctctcttgctaaggtcctcatgctgtctgtcagtccagggcagtgctgtcccacagacaatgtcatataatgcgaacgatgtgtataatttacattttctactagccatgctcaacagcatgcagaaataggtgaaattaattttaatcatacagtatatttttttaacccaatatatccataatattatcatttcaaaatgtaatcaacataagaaaaatactgagatattttacattctctttttagtactgagcctttgaagtccagtatgtattttacaactgcagcacggccacatcctgagtgctccacagcctcctgtggttagtggctgccatactggacagcacaggtctagaatcgtctgatcctggaatcttcccatggctctttctctccttggaagagcaattccatgatcatccacctccaatcttctcaccttcgccacaaagacacgccagcactggtgctgctgtctccatctgtacgtggcacaaaaactcacctgctcatgttctggttgccacctctcttccctccccagtgctgactctgtgtgagctctcagcactcagaagcacgcctggcgcgagcagacacttgggaagtgtctgcagaatgaagacatgcatcatattccacctgacttgcaaagccttaacacaacttctgcaaccttttccctcataactaagggattttcttcctgctgatcctccaccctagccccttcctcaggccttaggaatttgacttttgcctggggacttcggcctgcaaactcacttgagaaactgtgacttgtaaacaacccacacccattcttttcacaagagtagtgcacctgcaatgtcaaactgccaagccactgacatggcgtaaggcatgaggatactttacccaggaagttgcaggttcagtagcactgcctagcacctgcctgtaagacaccccaactgatgggccacaaggggggttgcaggcggcatgcctcagtgaaggctgtggggctgtcatcagggcaagcaggaagccatttcgacattgacaacaggtacaattacactgccatgctgctaagtgacctgtttctaggcttcctagattctgtaagatttaaatgataaacatataatgtttaaaaatgcagtcacaatctctacctggccccaaaaagaggcccccagcccctccattccaccttagagtactgtgcagacacccccggttcccagaaaggcctgagaggaagaaaccgggctgcctccctgcatgaaggaaagccagggagaagcagcccacattcaaccagggacgctccgctgtgaggaccaagtcagggagctaagaccaaatgaacgaattcgcttcttgtttccttttttaaaatcaaagagtatgacaagaacaggcattttagaacataaattactaacagataaaataatgctcaatctcacaaaaatcttctttaaaaacccaaaatgaatgcccatttttagtctatcacttggcagcgatggaaagcaagcagactcggtgctggcgggagaagcagaaacaggcgcttcctcaggccacagagggtgtgcagtgggcactttctctccaggaggctgatttctgaggtgtgaaatgcacacacttccccagccagcaggccctgaagcccagcccacccagaactaacagcacggccgcaggagcaaggaagacaaggacagcctggttctaccaaggacagacgcagcagtggaaccatctccacgggctgcctgccagctctgtgaaccccagtgcgccagaaacacgctcatctgaagacactgccatctgtcaaaaaactgtcatcacatactaatttaacaggaaaagcacactttactgccgtctgctggaagactgtggtgataaagtcccaagcttgtgtgggtgctctgtgtggccaatggggaggtggctaaggaggtgctctccccgcaccctgggaccctctctagtcacccccgaaatacaacctgaggcagcttcccaacacctcacttcaatttcaagacagcagaggaaagacagttctgccccttcaagtcttgaaaatcactcagaacaaagaagacaaatgccaagtacagatccaagtgacgcctggatcggggcttggctcccaaaatgcctggaacccaacgctaccctgtgggcagcagtgagggtacccacagcacccgcagcatgagtggggcaggtgctgacctcccccactgcccgctcaactctgggatccagacccactgcttgagaggtatcccaggaaggagcacatcatgacaggtgtccactgtctggccttgccggtccttccccacaggtacctgtggccacccaccgggtaagaacagccaggcactcttgaggatgaatggacacagctctaagtagacactgaaacccgaagaccccaaacactctcagggctcctccacttgcagggttcgtggggtcaggggtcaggggtcagggcataagtgaagtctgggccaggtctcttgcggccatgttatgggagggtgggaacgttagcaaaggcttagagcaaggctgtgagagaacattgctgtccagcctgcagcagtgtgggcgctgtctgggcctctcttctaatcagtgtggaggatgcatttgccccatcaacatgccagacctgaggccttattaatctgctccagcaacaactgcaccttgacatgcacagcagctgcggccaggactgccagtgccgtaagcctgtggccgtctggggtcattctccagaatccatgcagcttcttcaagggctggactaacgagttagactgggatgcaagataccactgtctctgctcccctgaggcttccatggtggccctagtctcctccacccaccccgggccctgcagggtgtgatcttgtttttgatttactatcttgggggcagtttcaggtttccatttggccttcccactgtgacgactcttactcacaggccaaggaactcgtgtgggcgttactccacctgccaagcgcctccgctccggctacacactgaggactggggagacggccactgggtggcctgggaccctgtggcccactgagagccaccagacacagacggctcaggaatgaaggcctgggacacaggccaggcaagccacagaggcctgccaatgtgagagctgagggtatgaataacaggaaagggtagggaaagagccagcagagagaccacagtgacagggactacagggtgtcccactaacctctgtcttccagatttcccctgaggaagagagaaccatgggcgccacaggaaagccattcccaacttatgtggagaagtagagctgagggggccagggtggactgtggggtccacggaaatgcactccttggtctcccgccacaggagtgagagtgacagatggcccagtgtggtgtctgcacctaccctctgtccctgccagggcacacctcccacagagccgtcagccaggggccgaccgggcagggatgctgaggcaggcccgttcctgtgtgacaccggaggccctcagagctgcaccgcagtctggaccaggcctctgaggggccaggactgcactacgttcagctagcatttgctgcctcctctggctgctcccccttccttctcgcacaggcctcctcccggccagtccctcgcctgtctaacccaccgtggcatgcggaagccgcccacgaaaagccccacgctacagggacaggaagctgcagggccgcccaaatgccctagctgagcgaaggaaatgccaacctctataaatggccacgacacccaggaaaggctcagcaagtgaaatgcaggtgctatggaggcagaagaggcaagggtagcacttggagaagttttcattttattgaaagtccaagtacgtagtagatgtcccagatccccatctccatcccagaagtgaggctccactccttcctcactcctgctggcccttcacgcagagaaactgatgcccagcttccaggtgcagggccacaggcgccgcatgcacagtcctgtgggtaccaacagggaaggcacggtgaggcctgcctgcaacagggctgcctggtgagtttgcgctctgccacatgagaagcacagccctgtaccccagcagccaggcttacatccctccaccaagggactgaaggggccttttccagagaaattaaatggtgcccagagaaaaaacctacagaaggtgacacctgtggctgcctgtggtccaagagacacccattctttaacaatttacccattcactcagtacttccagtcagcctttaatgcttcaatctcttttttttttttttttttttgagacgaagtctcgatcttgttgctcaggctggagtgcaatggcactatctcagctcactgcaacctccgcttcctgggttcaagaaattctcctgcctcagtctcctgactagctgggattataggcacctgccaccacgcccagctaatttttatatttttagtagagacagagtttcaccatgttgaccaggctggtgtcgaactcttgacctcaggtgatctgcccgcctcagtctcccaaagtgctgggattactggcatgagccaccgtgcttggcctaatgtttcaatcttaaacatgatccaaccagacatttggggaaagccttgcgtgtgacagggagggacctaacacactaaaaagggaactctcagtagagaaagacaatgcagggagtgataaaacccttcaacaaaagcttatcctcagagatgatagtatatacatgcaacaagaacagaatgctgtaaaaaggaacttttaagagcaaatgagtgtcaattaactcgtgcttcagagaaaaagaataaagaatggagttaagaggacattctgaaagaaatgatataaatttctcagacctctataatatgtgcttccagactgaaggccaagtgcccagcaaaactaaagaaaaaatgcccacatcaaggcatacatcaaaacatctcagaatacaaggaataaataactgagtttaaaagtttccagagataaaaccaaaccaaaacccaaaaccacagcacttaaaaaaggttagtcatcagccaggcacagtggctcatgcctgtaatccagcactttgggaggccgaggcgggcggatcacgaggtcaggagatcgagaccatcctgggtaacaaggtgaaaccctgtctctactaaaaatacaaaaaattagctgggcgtggtggcggacgcctgcagtcctagccactagggaggctgaggcaggagaatggcgtgaacccgagaggcagagtttgcactgagccaagaccatgccactgcactccagcctgggcgacagagcgagactccatctaaaaaaacatcagatggcactaagaaactccggagccatgctagatgccttgctaccacaggcactgcctccgccattctgagcgcaactgatctgtaactaagaattctacacacatctacacacaaccacactactcatcatgtgagagggcagaataaagagtttcagacatttgaggcctcaaaaaatttctctcccctgtggcaatttaggaagcttttggaggatgcgtcccaccaaaacaagggggtaatctgagagacaaggacagcaagcaaggaatccaacatgggaggcagatgaaggaaacccccacaaaatcaccaagggagatccaggacagccccttcgagcaggtgcagtggcagccagtgcaaaggggaacagggctgaggcttgggagaggttcctgagaagatgaaactgatgaaatacccaagacatctacatgtgctgagagaaaattcagatgcctgatggaagagttagggttgaattaccaccaagaacacagaaactaccccccaaaacaaacaaaaacctcacacaaatagagtataagtgtttgttaactccagggaacaaaaggtgaaaggggaaggtctgctgtgcaaagcatttacacgctcacgatgacgcaacgagccaaacaccatcacatccaccagcctgggaggagggcgaggaaggccgagggtgagggctgggttggtaagaagctaaatcagcatcttatgccccaaactgagaaaggatcaatgaagaaagagctaagcatattatttcaatatggaaatagagaccaaaataatcagctaaatgaactgaaggagtttgcttctagggagagagaaataaagggagaggtggaggtatctgtttttcataaatatttatagaaatatttgatccttgatttaaaaaaacaaaccaagctacctgtttaggaagttgctacgcagttatatgcaaggtgatcctgtctttgaaggatgtaagttcaaaaggacataagtacagatatgctggtgttaacatcagtcaacagagaggtgccatgcagagtgaggcaggacatgcaccagcgtgctctcactggccatctccaggtgctaacagagggctgggttacttgcatttcattttttgaattatataaagtatatacttcggtgggatatcatgggcaaaactttatctttcaaatacttaaaatttatgttttgtattaaaccattttaataggcaaaattaaaagtgtgtctatctctgtgcatggtactgtagatggaacaaaggatggtgcagtccacacagaacagttaacttagggctcctcccttcctgggatgtgggcaggggtggggcaggggggcagggggcaagagggagtttccccctttgctttatacacctgtgcaatgtttggaacttccccacagtgagcatgcatcactctcccacatggacacagatgtggggagagcctggcaaggccatggatgtgggaagcagcagggaacaaggtgacagggaggagaggacacagcaagatgccaggtgggtggggatggtgagcaggaggcagggatggcaacagggccattttctgaaggcttcttaggtttctatacctcgtgctgggcaaaccaaacactcctttgggccccatctgactcaggctgcaggcaccggctattccataaaaaaggcctgccgacgctgcagctctcacaaagcccccagtgacaggaggccattgtttcccacttaccttggggcccaagggggaacaagtcagacaaaccatttccccttataaaatgaataaggcctaatgtagtaagactaataatctgggaaattattctaaagcataaataaaatgtatttaagagatatcaagagtaccttaaattatatgaaggtctgtggaaacttcaggaacagaaatagaatggtacatcaggagatctttaattcagaagcctagtgttactatttttaaagcaaagtcaccaatatattattttaactgaccatctgatggcagcaaaggttctattttaaaaaacagtacactagatggcagatgggaggctgtcagctagccctgggaggacaagagctatccctgacgctgcccttgggccacagacctgaggcttgagacgagacaaccctgccctctgtgggtcggtgggctctacccccaagggaggccttcaatggctgtgatggaaccaatctttcctggcaaaagagatctgaaaaaattattaccactccaccatctaaaacccatctgcttatttctgtagtaacaggctctgctgttcttgtctctcactagcttcttccccacagatttcagttcagcaaaaagatgacctcttgctgttggaacataaaatctaatggcaatctgttgataaaattagtatagtaataatccagggaatgctaagaatatctatttccgataaaattatattatctctgcctctagtctcactcagtattttaattgttttttagaaaaaattcgggccaggaggccctaggtggctctgccacagactgtcaccctgtgaccttggagatccctaagcaggatgccatagaatcctggaagccaggaaatggaaacaaatgggaagaccagaacagtgaaagtcatttcaataattctggaaaaaatttatgaagtcctatgggagaaagactctgtgaatgtaaagaaggtagtcattgtggagaaatattcggccagattccaaatctgaacctgaagaagaaaatttctgctgatgtaaattcatgtgaatgcagagtgtgtggacaagtcttcacatgtccttcatcccttaataggcacatcttatctcattctggacacaaactacatgcatgggagaaacgtggggtgaagccatacaaatgtaaacaatgtgagaaaaccttcatttctctcacaaatgtccaaagacacatggtaacacacactggtaacaggcctcataaatgtaagaaatgtgggaagacatttaagtttctctatttacttcaaagacacaaagtaatttacaacggagaaaaaccctgtgaatggaagaaaggtggtaaagccttgagattttgcagttattttcaaaaacataaaagaactcacagtggggaaaaaccttataaatgtcagaaatgtgagaaagcctttggacattctggttaccttcataaccataaaggtgctcatgctgaagagaaaccccgtgaatgtaggaaatgtgggaaacgattcagtttttgtagttactttcaaagacataaagagctcacaatgtgaaaaatcttccatgtgtttaagaaatatggtaaaagactcactctttccagttccattcagaaacataaaagaaataatactggagagaaaccctataaatgtaagaaatgtagcaaagccttcagtcatccccgctccatgtgaagacatcaaagaacacatattggagagaaatcctataactgtaaaaaatgtggcaaagccttcagtcaacacagttcccttagaagacatgaaagaactcatactggagagaaacccaatgaatgtcaaaaatgggataaaggcttcagtcggttcagttacctccaaacacatgagagaactcatactggagagaaaccttatgaatataaaaaatgtggctgggcgcagtggctcacacctgtaatcccagcactttgggaggctgaggcaggcagatcatgaggtcagcagttcgagaccagcctggccaacatggtgaaatcctgtctctactaaaaaaaaaaaaaaaaaaaaaaatagccaaatttggtggcaggtgcctgtaatcccagctacttgggaggctgagacaggagaactgcttgaacctgggaggtggaggttgcagtgagccaagatcacaccactgcactccagcctgggcaacagagcaagactctgtttcaaaaaaaaaaaaaaaatgtggtaacaccttcaggcattccagctccctttgaacacatgaaaaatctcataccagagagaaaccctttgactgtaaggaatgtggtcaagtctttagacatttcagttctctaagtaaacatgaaagaactcacactggagaggcaccctttgactgtaaggaatgtggtcaagtctttagacattccagttctctatgtaaacatgaaagaactcacactggagaggaaccctttgactgtaaggaatgtggtcaagtcttcagacattccagttctctacgtaaacatgaaagaactcacactggagagaaaccctttgaccgtaagggatgtggtcaagtcttcagacattccaattctctatgtaaacatgaaaaatctcacactggagagaaaccctttgactgtaaggaatgtggtcaagtcttcagacattccagttctctatgtaaacacggaagaactcacactggagagaaaccctttgactgtaagggatgtggtcaagtcttcagacattccagttctctatgtaaacatgaaaaatttcacactggagagaaaccctttgactgtaaggaatgtggtcaagtctccagacattccagttctctaggtaaacatgaaaaatctcatactggagagaaaccctttgactataaggaatgtggtcaagtcttcagacttgcaatgtggtgaagtcttcagatattccagttctctatgtaaacatgaaagaactcaaactggagagaaaccctatgactgtaaggcatgtggcaaagcctttagatattccagtcctgtatgtaaacatgaaaaaactcatactctgtagaaatcctgagaatgtaaggatttggggaaaacattcagttaattcagttatctttgaaaacatgaaagaaattatactggaggaaaaccgtataatttacataacatgcatatgaggaatgtgatgatgcctttatatgttccagttacctctgagcacattaaaaagcacatggaactcttccatttccctttgaaaatacgaaacaaaactactactgaggaaaaattctatgcatgtaaacaatgtggtagtgtcttcagtctttccagttctacttgaagacataaaagaactcatttctaaaaaaccctataaatgtaaagaacgtggggatgcctttgtttctctccggcacattgaaagacatgatgtatgcaaactggagatggatctttaaatacaagaaggtattctgtatctaaaccctagtagtttgcaaataaattttcattttaataattatttcaaaagtcatctgagaactcccactgagaacaaatcttataaatttaaggaatttggaaagcctgatgcaaattaaatattccacaatgctcaaaacatgcacatgaatgaaatgttatacaagttataaatatattgtgtttgtcagtggctcatttctaatgaccatctctggactgttgatttccaccttatttaacacgaaaatattgaggtgagaattctgtagataccctttaagcaacatgaatccaataggtagtgtgggtttttttgtcagttaatacaaaattttgtctgtatgtctaaatgtttttggatctacaggtgaattaaaatgtatttctaataagtaggtaacactgatttttatgtagctttttaattgttctgtaatatgtcattgaaaacagattttgttaactgttggggttttcttactggccttatttgacaagttttaattgttcttcacctattacatcaattccatctttcttttttatgaaaaatgtactgttttttggcaggaagaagtttatttcattttctttgctactgaagtattggtatcaaattgtgaaaaaaaaaaatctatcatgatagtctgcttacacagccgtacaagtaataataacaaaaaattgtaaaatcagcttagagagaattatattaattatattatcgctccctagcttattaaatgtttttcctgacagtacagtcacactgttattcaaatcccggcctctgctgagcccacaggcctgctctgaacccttgcggtgcagggtctggccactcccaccagtgatgcagggaagctggcacggcagaattttaggataagagaaatggatatgtgggtcattatttaagaaagagagttctcaagcagctgtctcactgactacttggcctttaagttccttgctcattaaaaatgggatttcacatatggcaaatatattaaaaacaggtgaatgtagataaatggtagttggaagttctctgtcctattcttgaaatttttctctaagttttaagttactttaaaatgaaaagtttaaaacaatgtattcttgcgcagtatctgactgagagcgcagtacctggctgtgtccacagcagctggtctagcctggcaggccaggcggctccacagatgcctcctagaatgactctcttaaaacaccatatgattccatcatctatttggattttcaagcctaacaattttttttaaatgttattttgtatgtaaaggattatgacaaccaaatgattgtttttaaaaataaaattaatacatcaccacttactctatgaattataccagctgaatgcagatgtttaataccacaaagcatctggtaaagaaggtaggacattctttcatgatccagctccatgtgaataacctgacataagttagcatccattaattccataaccaaatacctgagggagaaaaggtcagttatttatttgaaaattatccaaagttcctttatgactaaatttcatgaaactgtaacttacttccaatcactgcactggctaaagtaaaaagataacttggtataatggaactttctaaaaattttccaaagaatatataaataacaaacttaacgtcttacaagttaaaaattaaaaaaaaaaacaacaaccttttatagcatggtaaatagaatctcaaacacaaattttcctacttcttacatttttggctgaaattctccgtaccagcctaaagaccatgctgttacaggctcatcaatcacaacacatgtaccctctggtgggagatgctgagaacgggggaggctctgcacgtaaggggctggagacagacaggaactcagtacctcccgctcaattttgctgtggctctaaattgctctacaatatatacgtttttaaaagtgattatacaacaacaacaaaaaggacacttgaccccactccccgcttagcaacgccccgattctttgctccctttgcaagcaaaactccccaaagaggtgtctcatgtgctatctccaattcttctcccttctttttattttttaaatttttttgagacagggtctcactctgtcacccagactggagtgcagtggcgtgatctcgcctcactgcaacctccacctcccgggttcaagccattctcatgcctcggactcccagaactgaaaattaaattaaaaaaaaaaaacagccatcatgcctggatagtttttgtatttttagtagagacggggttttgccatgttgcccaggctggtctcgaactcctgacctcaagtgatccgcccacctcgggccttccaaagtgttgggattacaggcatgagccactgcactcagccttctcccatttttttcttaatcccacttggatcaggtttgtgcagccaccattctgctgaaactgtcctcctcgaggccactgatgtcttccatgctgctaaatccactggccagtcctataatcccagcgggccctgccctgtcctgtctctaacttctcgctgtcaaaatacccagcaactggtccttgaccctcttctcttctgtaaccacactcactttcttagtgatctcagttacaggccatcagctcccaaattcctacgttcaattcagacatatctcctgaactccaggctcattcctctgcctccctattcccagttccaccttgatgtctaacaggcatcttaaagccatctccagaactgaactcctgattccatccctagcccagtctgctcttctcacagccttcatcatctcagttgagagctccctcatccttcaggtgctcaggccaaaaatctaggtgtcattctcaattcctctctctcataccacacatctcatctatcagctaataccatggctctatctttagaaccatttcagcatccagtctcttcccctctcacccttcctattacccctctgggccaaatggaccctccgtcatcccttaacagaactgctgcaacagcagtaactgatgttccatgcccccaccccttatagtgggttaccaacccagatgccagagttacgcttttcaaacagaaggcaggtgagctcactgctctgctaagactcttactctgacttgccttagagcaaaagacatccttacaacggcctagaggcttgtggtgttcaccctcttctcttcccctgctccctcatctctagccacgccacctcttgatggtcttggaaaacaccaggcgggcatccactgctgtcctgagcgctgtctgttccttctatctccattctacttgcccccaaagtatctgcggcaccaaattctttttttttttttttttgagacagagtcttgctctgtcgccctggctggagtgcagtggtgcgatcttggctcactgcaagctccacctcccgggttcacaccattctcctgcctcagcctcctgagtagctgggactacaggcccccgccaccacgcccggctgattttttgtatttttagtagagacggggtttcaccgtgttagccaggatggtctcgatctcctgacctcgtgatccgcccgcctcggcctcccaaagtgctgggattataggcgtgagccaccgcacccggccagaccaacttctttatccccttcaaggctttcttcgaatgtcaccaactcatggaggtctttccccagccaccttatttaaaactgcagcctcaagtccaaccctcagcacttttgatcccctgacccagctccaccctttgtccacagcacctagcacattctaatggactacatgctttcctcatttatcatgtggcttgtctatcttccctgacaggctccagggaagccaggtaggccaagtcccagagagtgcccagcacacagagggcaatcagatatttgttaatgactgaacacaccaataaattcaggatgaagttgggcattatgcctctcaatagattaatacttcatttcactgttagtaagatgattctacttaagattctggaaatacagaatcttaaatagaattagtgacttaatcattttaagtaatactcataaactcctgaaccctaaaatcctggctatcagggatttgagaaaaacattttatagttcagcaaaacacattagtgatcctggtctgctctgaagaattctttccagtcatcctttatctgttatgaagatgaaaacccatgtggtacaaataattaaatataactatcaaattttctaaatatttctctgcaacagagaaagttatctgtgatgtcacaaaatgtattgccacctacatttcctaagtataaaaagcagttgctgtcttttctagatgttcattctttgatgtacagtgcattactgaataaaaatgatacttacacatcttgaaattcttctagagttttttgtggtgtaaacacatttaacaaactaattatctgaaaagagaaaattaattatacttcaatatgtcagattacttgattacaaaaattaagtttaatattgaaatgcattaagacgggaaaaaaatcacagcagaattcagtacttcttattattactgcttttaccaattacatggcatttgagaaaagttaaacatcaattaaaggaaagatgcacttttaatcaaatcacttttatgtgtccctagtaacttaattattacagaatttaaacacataatgtctttttgaacataaaaaagtagaatttacaggtaaaaagacattaaagcagtatgttaactctgaaaacttaaatactacgcacaaatttctaaaaaggtttgaaatatgaaggctaagctcttgtttttggtgtgataaagtgaaaggcctcgtagcatcatatttttacctaaagagggttaaagagctgatcctgcggcaggcctccatcctggcaccctgacatgatttggctgtgtccccacccaaatctcatcttgaattgtaatccccataatccccacgtgtctagggagagacctggtgggaggtgactggatcatgggggcggtttcccccgtgctgttcttgtgacagtgagtgagttctcaggagacctgatggttttctaaggagcactgcccactttgctctttacttttctctctcctgccgccttgtgaagaaggtgcctgcctccctttcgtcttccgccatgattgcaagtttcctgaggtctcccacatcatgcgcaactatgagttatttaaaccgctttcctttataagttacactgtcttgggtatctctttatggcagtgcgggaacgaaccagtacacagcccatggtgtaaacagcgagtcccacggcttaggcaccaaacacataacctcagtcattccagatgactgagggaaagatgaattatccattatacaggattggggtgattggttagctaaggacaaaaataaaactgcatccatatttcaatctttataccaagaaaaactctaaatggaacaaagacttaaatctaaaacatgaaataaaacctcagaatatagataaacatttatataatcctagcgtagaaaatcttttctaaacatgacaggaaacctaagagatctgattacattaaaatgaaacaaaaaatgggtgataaaaaatcagtatgtcaacaacataaataatgtcaaatggaaaaaaaaaagtaaagggcaatagttttaatatttaaaaaaaaaaccctcctacaaatgcagaagagaccagcagtccaaaagaaaaatggataaaggccataaaaattaaattaccaaaacacataaaaataagtaacaacctcaccaataaaaataaaatatcatttatttatcaaattggcaaaagcaaaacaaaaaaaatcaacagtatgtagtgctgggggattctgaagtaacagacgttctcagacactttttttttttttttgagatggagtttcattcttgtcccccaggctggagtgcaatggcgcaatcttggcttactgcaacctatgcttcctgggttcaagtgattctcctgcctcagcctcccaatgagctgggattacaggcgcccaccactacgcccagctaatttttgtatttttagtagagacggggtttcaccacgctggccaaccaacgtggtcttaaactcatgactcaggtgatccacctgccttggcctcccaaagtgttgggattacaggtgtgagccacagcgcccggctgatacttttttttttttaggagatggggtcttgttttgttgcccaggtgtgccttaaactcctggcttcaagcgaccctcctgcctcagcccaagtagctgggattacaggtgaagtgaccgtgcccagcttctcaaatactcttaatgaaaatatcaaactaatagtcttccttgaggtcaatttgtcagtatattttaaactagaagtgtgtgtactctgacctgacaatgttggccaagaaattcacctggacgagtatgcaaaaattcaggcgttagaatgttcattgcagcactgcttataacagtgagaaacaaaacaatctatccaacaacaggcggctggcagtctcttaaataaattactgtgcatctgtgctatgcaaccatttaaaaactggctcatatctatgttcattaaagtatatgaggtct

SEQ ID NO: 55 - DNA, 64827 bp, Homo sapiens
gcacagtgtttttggtgatggttgtttttagcaaccttaactgtaaaaatttctcgtttaaaatcatgaattacgtgttaaggtttcaacgtatgaatttgtggagggggctgggcacaattcactgcatagcaaataactgtactttgagaataacgtatatttaaagtttaaattgtgaattttaaaaattcaatttgatcttttccaaacatttttaaagaacgatttgacagtcttaggtcctctaataaaaatcacttgcagtgaatttttaaaaaatggacaagtaatagttgtgtagacttttgcaatgttatgttttgatacatgcttacatggtagtgaaactgggcaagttcccttgttcctctcgggatgtgtgatggggctgatggctcactttagtgccctgctgctccaacttttaggagagaatacagacaggtaggctgtggggctccaacccttttgcagtgtctagggctgaatgtttacaactcctgaagctccactgggcatgtgttagagtgcttttttagtttagctatccataggtggcttgtgttaaccagttcaatcagacccctaccttatcgcaaggacagagggctttctgtatcctggggttcctgccttggtgtaccagaagaatcggatcacatgtgggcttggagaatgagtgcaaggtaagtctggcaacctgggctctccttcaactgcccccgtcaaactgcgttgttctgccggtggatggcctgcctgcatgccggtgcctgctggtgcatcccattcctctcaacttccagccgctcgtgtgttcctccactgatgtactcctctcgatatgcagccacctgtgtgtctgcctgctagcgtctcagggttttacaggcacagggtaggggcgtggcaggccagggtggtcttgagaagtgcaacattggggcaggaaaacaaaaatgcctgtcctcaactaggtccgtgggcacaggcccagggttggagccctagccagggaccacgcccttcccccccccgccatgttatttaaagagagcacacccttccatatcagtggaatggctaaaacaagctaattcccatacgcattacctcatctattttttttgtgatgagaatgtcagagtaggcggttagacgtgagcagggcatgcacgggcccccaagaatgttggacatttgtcaagccacagtcacaattataaatctgtccctctgaaataatgagcaagacaaggaagggaccccagagctgtctggttctcattgggaccgggattgaagggcataaaactatccctctagggtaataagtggccatggctggcgctgggaataacaggagtcttgcaacagacagaagacacctggagttagcaaggcagtcccagacaaggttttgagcatgtgcagtaatagaaaggtgtgaaatttacccggtgtatgactttcctctaggggcgctcgaccagtaagggagaattgcatctaatgggcatgcgcacaacttcagtaaccatccagcgcctactgggagggctactgggcatgcaatacttgagggccagcccgggaggtgaagaacaaagagtggagacagcctggaaaagagtaaggggtataaaaactgtaagcaggcctggggtggtggctcacgcctgtagttccagcactttgggaggctgaggcaggtggatcatgaagtcaggagatcaagaccatcctggtttacatggtgaaaccctgtctctactaaaaatacaaaaaatcagccaggcgtggtggcaagcacctgtagtcccagctactcgggaggctgaggcaggagaatcgcttgaaccctggagacaaaggttgcagtcagctgagattgtaccactgcactccagcctgggcaatagagcgagactccgtccaaaaaaaaaaaaaaatcaaagcggaagcagcacttgatttttgaagtctcctgcttgaccctcttccaagcctactttctccaatgaactttcacattgcttaaaataaatgttcccttgcctgtctctcatttgaattctttccttttaaaagtacaaagtgagaagtgacagcatgctggcagtcctcacagccctcggtcgctctgggtgcctcctctgcctgggctcccactttggcggcacttgaggagcccttcagcccgccgctgcactgttggagtccgtttctgggctggccacgcaaggccggagccggcttcctcagcttgcagggaggtgtgcagagagaggcgccagcgggaactggggctgtgcgcggcgcttgcgggccagctggagttccgggtgggcgtgggcttggcgggccccgcactcggagcagccggccggccatgccggcctcgggcaatgaggggtttagcacccgggccagtggctgcagagggtgtactgggttcccccatagtgccagcccaccagcgctgcgccctatttctcactgggccttagctgccttcccgcggggcaggacttgggacctgcagcccgccatgcccgagcctccctgatgaacaccaccccctactccatggctcccagtcccatcgaccacccaagggctgaagagtgtgggcgcatggcgtgggagtggcaggcagctccacctgcagccccagtacaggatccactgggtgaagccagctgggctcctgagtctggtggggaccatggagaacatttgtgtctggcccagcgattgtaaatacaccaatcggcactctgtatctagctcaaggtttgtaaacacaccaatcagcatcctgcatctagctcaaggtttagtgaatgcaccaattgacactctatatctagctactctggtggggccttggagaacctttatgtctagctcagggattgtaaacgcaccaatcagcgccctgtcaaaacagaccacttggttctaccaatcagcaggatgtgggtggggccagataaaagaataaaagcaggctgccggagcttgtagtggtaacccgttggggttttctgtgctgtgataaggtttgttcgtttgcatttggcgtctgcgttgcctttatgagctgtagcgctcactgcgaaaattgtcactttatttctgaagtgggtgagatgacgagcccggcaggaggaacgaaacactcatctgtgaaagttgcaacttcatttctgaagtaggtgagacgactctgtgaaagttgcaacttcatttctgaagtgggtgagacgacgagcccattaggaggaacggaacactcactgcgaaagttgcaatttcatttctatagtgggtgagacgacgagcccagtgagagtgaacgaacaactccaggcgcgccgccttaagagctatagtattcactgagggtttgcggttttattcttgaagtcagtgaaaccaaaaaccaatttctgggtgtaaaaagaccaaggttcttgcaaggttgctcctcccaaattccttcagataggggaagacacacagtttacaagaacattttgaatcttactcattttcaagtatataatatatatttttaattgtagccaacatgacttacaataagtaaacttaaaaagatataagccacccatgttgggtgtgggggtacatgccagtaatcccagctgcgtgggaggctgaggtggggtagattgctggagtccaggaatttgaggccagcctgggcaacataacaccccatttctgaaagtaaacaaagccctaattatgttcattttcccccttcattttcagatttcccattttggccacgcttcacatgcgacacatatagaagtacacagcagcttccccccttacctgcaagggatatgttcagagatctccagtggatgcctgaaactatggatagtactgaatcctatatatactgtttttttctatacatataataaagtttataaattaggtacagtaagagattaaaaactcaaaatatgagttaaactcatatgcaatataatatatgcaataaaattgaaatactgtcaaactctgtaaagtatttgaagagatttgttctgagccaaatgtgagtgaccgtggcctctgacacagcccctggagatcctgagaacacgtgcccaaggtggtggtggtcaggggggagcttctgggtcgcaggtggattccaagattttctggttgaaagttcatctaaagacctgaaatcaatagaagggagtgtgtgggttaagataaggtgttgtggagaccaagggtcttattctgcagatgaagcgagcaggcttcagagagcatctattgtaaatgtctcttttcagactctcctggatcaggagaaagacccggaaagggaaggagattatctacaaaaatgtagattttccccacaagaggcagctttgcagggccatttcaaaatatgtcaaagaaatatgttttggggtaaaatacttcaatttctttcagggcccgttgtctgtcatgttggtagctaattgctagatagagtctgttttgtcagcgttaaggtctgttttaatgtaatgctggtcagctgtgcctgaattccaacgggaggaaggtagaatgaggcatgtctgagcccctcctccctatttcacatcgtggcctgaactagtgtttcaggtttactttcgaatgcctttggctgagaggaggggtccatttggttggggggcttagaattttatttttgggccaggcttggtggttcatgcctataatcccagcgctttgggacgctgaggcgggcggatcacctgaggtcgggagttcgagaccagcctgaccaacacagagaaaccctgtctctactaaaaatacaaaattatctgggcgtggtggcgcatgcctgtaatcccagctactcggaaggctgaggcaggagaatcgcttgaacccaggaggcggagattgcggtgagccgagatcgcgccgttgcactgcagcctgggcaataagagttaagctccatctcaaaaaaaaaaaaaaaaagtattttatttttggtttacaataacatactgtaataaaagttacgtaaatataggccaggcgcggtggctcacgcctgtaatcctagcactttgggaggctgaggccggcagatcacttgaggtcaggagtttgagaccagcctggtcaacatggtaaaaccccatctctactaaaaatacaaaaattagccgggcgtggtggtgcacccctgtaatcctaactactcaggaggctgaggcaggagaatctcttgaaccagggaggtggaagttgcagtgagccaagatcacgctgcactgcagcctgggggacaagagcgaaactccgtctcaaaaaaagttatgtaaatatgatctctctctctccctctctctctctcacacccacagtgctgtactcacctatttttggaccatgggtaactgaaacactggaaaatgaaaccttcaataactggtaactactgtgtaggtgccatgtagggtttgtggactcctaatgaggaaaaaggagtgaggctggcaggaccaggggaaagcaaagagagaaagcagataagctataggttcgcttttctttatggcccaagacatatggcccacctgtgcaaataatgtacgtaactcacaaacttcctgcttatcatcaaacacttcaacttatcatcaaacacctctgctgacagaagaatgcaagcgagctccctactgccttggcgttctcaatcagccgagaaccatcctctgaaaccctcagcaagcctttgttcccttgcactgaactcctctcttgctgattctgcccatttcgaccttaacgaggtacatcatactttctctaataaatctgcctttctttacctacagctatcttgggaaattcttttaccccagcaccaatggccctggtaggtgctgctcacccgtgacagggttcgcatactgaaaaaaacacaagttctgactatgttttcagaaaaaaaatgcagttgttctgtaatcagatttccgctgagcgcttgtctgtttcctctaagaataagggggaaaggaagtgttatttctaaaaagggtattttaaatgacctccaagtttactgagaagccatagcacttactttcaactttaatttccctttgccgcccatcaccttttagcaaagccacatgagcgtgcatctggctgccctgtgcagacagacaggggctggggagcaagcataggagggcctgaggagctaaatccccagctgcccttgaccatcaagagggtgtattttaaaagctaaattaggaggttctgggttttaagtaagaaaggggaaattggccaggcgcagtggctcactcctgtaatcccagcaccttggtagtccaaggcgggtggatcacttgaggcaaggagtttgagactagcctggccaacatggcgaaaccctgtctctacaaaaacaatacaaaaattagccaggtgtggtggcccaggcctgtaatcccagctacgtaggaggctgaggcacaagcatcacttgaacctgggaggtggaggttgcagtgagctgaggttgcaccactgcattccagcctgggtgacagagtgagagtccatctcaaaaaaaaaaaaaaaaaaaaaaaaaaaaagagggtattttactagaaacatacataaagttactgtgttttcaagcttgccaaaaactgaacttgaacttgtgtgcctcgccagatgaaatggtcagaatagacacgcttactggcctaatggctggcctgtccttccagaaagtctccaaaaatgacacagaaaagtgaaatcaaatttcgctgtttcatttattcttctctttaaggtatagttttctgtcccaagtgtataattttatagttgtgaaattcaagaataatggtaacataattactcttgattctgtaaaagtatctaaatgactaagagaataggttaattagttagactgggaacacttttgtaaggataaaaaaaattcatccaaacttttgtctacagattaaaaacaacaataatagagctgatatccacctcaaaaggttgctttggaaatgtaattttattcagtgtatgtaaagcctttgcatttggcagggctgactgaaaaaacaaccctatcaattaatgggactgtggcttgtgtctatcagctgccgtgttctcctttagaatgagacagctatttctgcatcaagggatatgaccctacgatcttgctgctttattctataatggaacagatggcatgcattttatcatgctgcatccacctcatattcctgggttaagcttacttcccatacataattcccttcccatacataattcccttcccataacataattcccttcccatacataattcccttcccatacttaattcccttcccatacataattcccttcccatacataattcccttcccatacataattcccttcccatacttaattcccttcccatacataattcccttcccatacataatttccaaacacaaccttaccaaggttgtgctcgtcaatatgcagtgaactaaagagtgtttcctcccttttatttcttgcatctgttaagattggaatgatttgtgccctgagagccacatgcagtatccatgtgggaactggatgtgtgccctgttcacccagatgcaaacggtttcagtgcaggagtgaatagaaccaaggcccagtgcgtgcgcaatctaggcgggcctgagccagtgattccattctccttccccgagactatccaccgcagcttcaggaggaacactaggaggtccaaggcccttattgaagatgagtgcacccaaggatcctgccaccatctgcatgaccacggtcagccgcctggccgagctcagagggccatccagcccagaaccatgcctgcacagactggcgaaggctgagtcctttcagggagagtgaatcgaaatgagaagaacagcatgaacccaggggagagacgggtaagggtgggagccatatgaggaagagcaggtgaggatacagtgagttgcagagaaagaacagatctcccctggcacaaacaatcccacaggatttgcatataatagaaacccttacttccctgtacacagtttaaaaatatttttctggccggcacggtggctcatgcctgtaatcccagaactttgggaggccgacatgggaggatcatttgaggtcaggagttttagaccagcctggccaacagggcaaaaccccatcgctactaaaaaaaatacaaaaattagccgggcgtcgtggtgcatgcctgtaaccccagctactggggaggttgaggcatgagaatcgcttgaacccaggaggcagaggctgcagtgagccgagattgaatcacggcactccagcccacatgatgaagcgagactctgtctctaaataaataaataaataaaatatttttctgattacacaagaatacatgttcacaatggaaaatttaaaaatcaaacaaaaatccccccaatgtcttcttgtgccatttcctaaaagatgtagaggcattactcagatggttgtgccttttactgtattgcaatcaaattaagagtgacagataacccttcaaaggtgatgtcacagacagctaaggggcggtaactcagtggggaccagggagccttccagagcgggatgtgtggtgttggttgttctcttcccctgtcagaggtaacacataggaccctgaatgttcatcttaactcactagtgataccatccttatcctggggaaagggaatgataccatgatacctggatggttagagactattccacgtaccccactccctgcccccatccctgcccctaagcaaggatgtggaccccgtgcctctgcccaagaactggacacagggcagcagctgccagctgcagtgcagaggccctctccgtgatgctggaagcatcacataaacggatcctgccccaccctcggagcccttgttccaagtctccttgtccccgttctttaaaaaataccaggaatgggccgggcacagtggctcacgcctgtaatcccagcactttgggaggccgaggcgggtggatgacgaggtcatgagattgaaaccatcctggctaacacggtgaaaccccgactctactaaaaatacaaaaaattagccaagcgtggtggcaggcgcctgtattcacagctactggagaggctgaggcaggagaatggtgtgaacctgggaggtggagcttgcagtgagctgagatcgcaccactgcactccagcctgggcgacagagcaagactccatctcaaaaacaacaacaacaaaccaggaatgggctgggcatggtggctcatgcttataatcccagcactttgggaggccaaggtgggcagatcacgaggtcaggagttcaagaccagcctggccaacatagcgaaaccgtctctactaaaaatacaaaagattagctgaggccggacgcagtggctcacacctgtaatcccagcactttgggaggccgaggcaggccggatcagctgaggtcaggaatttgagaccagcctggccaacattgggaaaccttgtctctactaaaaatgcaaaaattatctgggcatggtggtgcatgcctgtagtcccagctactctactcgggaggctgaggcaggagaatggcttgaacctgggaggtggagcttgcagtgagccgagatcgtgccactgcactccagcctgggtgacagagtgagactccatctcaaaaacaaacaaacaaacaagaatgctgtgcagagcagggagtatgagggacaaaaccagcactatctggcccttctttccccagctctcccactcatccttgccacatctcctgctgctcctgagtcccatctgtcaccccagcctggacactaaggggaaagagaaccaggaagagtgagagcatatgagagcacagttgcaccaggtaaaggaggagaggccaggttcccactgcctgcaaaagaagtcctttctgcctccctggaacattgtgtggctccatctgagcctgacctgtccttctgctcctggatggctgggtgcagggatcacatttccagcaagtaacacaaatggccccagaaaccttagctgtcttttctgtctgcaatacttcagtgaaacagaaaggcacctggtgctgactcgtgaagtcgccgtaaactccgttactataaagggaacactaccatcatttgacatttttggaagtgggcagtgtgtgtgtgaacaagcatgtgatccaccagtcctcagggaagcagaaacacccacagggcaggggactgctgtcaccctcatctggttcacctgctccccccacctccatgcaggcttccggagagcttgcggtagttttagaattgagcttcccgcacctccctgtagcaccccatttcaccccattctctccctagaagtgggatgagactccactactgagtagaggagacagagaagcaccatgtatcttcctgtgccaaggaagagtcacaccaccgacctcaagggcagctgtctgcccacaatgaagtcgtggggtccccatggctgtggggggtgggcaacacctcccccaagcaagggtgagctaggtggtcattgccgcccctactaacataacccagacccagagcagcaatttcagatcctaggaaacatctcccgtgcagacacacaaacacacggagtgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacccagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattctacaaagaaaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgagaatataacaaaatctgacctgttccttctgcctctgctgctaccagcctagccctggaatattgtgataatatgattgtgattgttcccagcacagtggccagaggggcccggtagaacctaaggcagatcacattgttctttggctggacacccttccctggctccccatttactcggagcaggagctgaaagtccctaaaaagcctggaattgtgataagagctcgtccccagttccctctccctttgcttatctgctacagtcacagaggcctcctcactgcactgccagcaaacccagttcatctcatctctacgcagtaagcttgtcctccagaacctggagagtgaacttctgcctctttacggtctttgttcaaaaaccaccttggcagagaagctgtccttgatagatcttacctgaccctacactcccaccccaaacacagattcctatcccctcccttggtatgtctctgtaccatttaccactgtctaatatgctcctattttcttatttatgcttgctgtctctcccccaagaaaacataagcttcaccagggcaagcatgctttgcttgttttgtgcatggctgaaaaatacctagcaccatgcctgatacatagaagacactcagtcaggttaggcatggtggctcatgcctgtaatcccaccattttgggaggctgaggcagacggatcacctgaggtcaggaaatcgagaccagcctggccaacatggtgaaaccccacctctactaaaaatagaaaaattagctgggcatggtggtgcgctcctgtaatcccagctactcgggaggctgaggtaggagaatcacttgaacccgggaggcagaggttgcagtgacccaagattgcaccgctgcactccagcctgggagacagaccgagactccatctcaaaaaaaaaaaaaaaaaggcactcagtcaatctctgctgaataaatgataaatgcataaacgaattaatgagctgggatgctaaaaaggccaggcaacatttacacatctcaccagaaaaaactgcactggtcaccaaccccagccagccaatgagaaagactggaggccaggaaccacaccccatccaacaatccccctcagttcctgactcggagctgctcctgtgagttgagtaaataccctgcaataggcacagtcaaagacgccgtatggtccccagtctctggtgtagcacattcttctgtgttaaatggaataaataaaatacactgcggcggcagctttctgctttcacgtggtagaggctcgcctgggctggcccttagcctttggctagagcagtctcctgggcctcggctgccccactcatttccttggccagcagtaggcatgtttcttccataactgaccagacaggaactattttccggtttgtggctacatgtaccatctccgtcacaacgactcagctgttgttacaggatgaaataagtaagtaaataagcatgggccaggcgtggtggctcacgcctgtaatcccagcactgtgggaggcccgggcaggtggatcacctgaggtcaggagttcgagaccaacctgaccaacatggtgaaaccccgtctctactaaaaatgcaaaaattagccgggcatagtggcacacacctgtaatcccagctactcaagaggccacggcaggagaatcacctgaacccgggaggcggaggctgcagtgttccgagatggcaccactgcactccagcctgggcaacaagagagaaactctgtcttggaaaaaataaaaaataaaaaaaaaaaataagcatggctgtgtttcagtaaacctttaaaaaaaattaggtggtgggctggctttgctgtaggctgaagtttgctgacccctgccttcagtaattcctccctgcaccccttcagggtccaaagcctccaatcttgcaatataaaaagatctaaccttagtgactgaatgattcactaaatacacaattatatagacaagttccagtttatatagaaggtaatgaaattaaaataagaatctgtatcaactcaaaatctgtgcccttggaggtacacctctggcctcaggctggtacgctcaatactgcagccccttccttcacccttcttcactgcagaactcagaaagcatgacgggattccacatctccccaaacccacaagacctatagttctggcctacaccatatagaaagcagctttccctttctgaaacgcagaaccactaaggggaaggtttaggctcccctcccctcccttgttcctccccctccctgccaccgggactgctgaagccagctcagccatcttgtgaccatgaggaagaaggcgacgtgctgagaatggtggagccgcctccctgggatcatcgccccagtgccagaccagcccaggtctcacctgcctccagacctcctagcaggggagatgagctcctaggagataaaccatggtgaaccggggtttctgttatctgtagtcaaagcccttgtacatcttgttaatcattaaattttaaagagagaaattattttgccaggggaaaatagcacagttcatttcagaataaagcttcaaagaaaataattctttctgaattgcgaggagaacagacaatgaaaataaatttcttgaaaaactgaaggctcaagttcaagttagcctggaagatctaactatggtcaatgatcaagaatacactgtaattaatctattctgtttactttgtctatgttcaaaaatttctatagttaaagaaaaacaaaacaagagacaataaagaagattcagtgagaggaagataaagggccatcagcaaatgacatcttccacgctggaggtggttaatctcagtgtctatctacatgtttggtttggttgttttaaaacaaaaatctgtacttatccttactatcaagagaggactgaatatcactcatcggttcagcatttactaagcaccagctacgtgtctggcacttgtcagagagtcctccctgctcagcctcaattcagcaggctgagttgttccgctcctgcagtgtggcacggaggccagcaggaggcgcggtagcggggcttcccgggacgccgccagaaagaaaggagtgggtaggtcctgatgggaatgaagctagagaaaaggaggaaatgtccgctagaagatggcacgccatatctggagtctgagctttaagaccttgatcgagcctgagggctgcagcttcagacttgccctgtaggtggcagggcggatgccaggcgcccagggacacgaggccacccaatggatgtcaagcaggaggggcagggacagaaaggccccacggctgcagacgcgggaggccccgagccggagacgctcgtgtgaacacaggcgctgctcctgtcacggccccttactcgccttgctgactttaaacagtctctcctcggtgttctccttgtcaaactgttcatcccagtttcctctgaaatagacagcattcaccagaaccagccttgtcaatggatccactgagcccggagagagcaactccgcaattttacctgagcggaagaattcaagaccgcattagataggggcggctgcggatccccgacacatcaggaatcggctggggccttctccttcagcagtcaagtgcacggatagagagttccactgtcccccaaatataaagggatacgtgtccttaaagcaaaacaacaaaatcttctggtacgaaaaacatcatcaattgaataaaacacacaaagtgaacaaatatgcgttaattatgcaggatgagttcctaacacatgagataagaagcaatcatgggtgcctatgacttaaagacaagaacttaaaggattatcaaaaaggtgggcagtcagaagatgttctttacaagcttaaagaacagttaggccagacacagtggctcacacctataattccagcagtttgggaggctgaggtgtgaggatcacttgaggccaggagtttgagaccaacctggacaacatagtgaggccttgtctcttaaaaaaaaaatttattaaaattagctgggcatggtggtgctacctgtagtcccaattacttgggagactgaagcaggaggaccgcttgagcacaagaattgatgctgtaatcccagcactttgggaggccaaggcgggtggatcacgaggtcaagagattgagatcatcctggccaacatggtgaaaacctgtctctactaaaaaatacaaaaattagcagggcatggtggcacgtgcctgtgatcccaactacttgggaggttgagataggagaatcacttgaacctgggaggcagaggttgcaatgagccaagattgcaccattgcactccagcctgggcaataagagcaaaactccatctcaaagaaaaaaaaagaaaattgaggctgcagtgaattgtgattgtgtcactgcattccagcctaggtgacagagggagaccttgtctcaaaaaaaaaaaaaaaaaaagtttaaattaagaaccacagatagaccagggcgtgacccagtgtcccacagcaatgcatggcaactgtagactgtgctacccaagagggaggcagcttgagatccacactgcgaattttttatgttacttgtgaaaggaaaaactatattaacattaacacactaaccccctcctcaaaattaaaacgtggattgatccagaagaggtataccaaacactgaaaggcatcacgggtacaccaaggaaacagggagaaatcagagagaacagaacacattgagcatttccaaaatgtcaaataatggcaactgatttcagaagcagattttttaagtttgcagttattcagagaaaaaaaaatcattcctgtttacaattgacagtcttgtgaaggaactgacaataaaatggattaagaggttattacaaaagtagaataacaatacattttcaccttctgtcttttcagctacccaggtgtttatgtgttttctggacttctctacggcgctgataaagtcaagctcctccatctctgcttggtagaatttttggcaggaatctctaaaagactaggatagacagagtgacataactgcctggctacaaaaatgatgaacaccaacggcctacttcttcattgcaccaagtcagaaaatctataattttatgattgacatacataatttacaaataaatatgaggacttaacctaaactacaacttcctagctttagctatatttaatcctagcttaaaaactaagtcaaggtcaggtactgtggcttacacttgtaatcccagcactttggggggccgaggcgggtggatcgtgtgagctcaggagttcgagaccagcctggccaacatggcgaaagcccgtctctactaaaaatacaaaaattagccatgtatggtggcatgcacctgtaatcccagctacttgggaggctgaggcaggagaatcacttgaacccagaaggcggaggttgcagtaagccgagatcaggccaccacactccagcctgggcgacagagcgagattctgtctcaaaaaaaaaaaaacaaaaaaaaaaaagcaaaaaacactaagttgaatcagtctctgaatatcaaacgaacttcaccaactgctggatcctttaagggagcagccatgcatcaaggagctgcctgacaagatgctgacaagacacttcaaaagcgtgaagtagatccaccttattgaaatgcagagaatttaaaacatattggcaggtgaaaagaaattacaaaagcctatgtatggcataatggcatttagagccacacgcttcctgctgggccccagcccccactacctggccacctttatttctttagtgaataagagcaagtatgacttactgagaggaaatcacaagacttttccccaaagagcctgttggccatcctaagcaagtactgcgtgccagtcttgttcacttcggtgagaagagactggaagccctggtggatgtctccaccaccgccacttttattgaaagaaagtatctgaaatcaaaaacagaatgaaaacaaatcattcctgtatgctctgacttcaggaaatggggcaaccccaaactcagcctaacaaccatccagacccttattactgcttaaaagatctatccgaggctgggcgcagcagctcacgcctataatcccagcactttgggaggccaaggcgggaggatcacctgaggtcaggagttcgagatcagcctggccaacatggcaaaaccccatctctactaaacacacaaaaatgagctgggcctggtggtgcgtacctgtaacccagctactcgggaagctgaggaaagagaatcgcttgaacccgggaggcggaggttgcagtgagctgagatcgtgccactgcactctagcctggcgacagagtgagactccgtctcaaaaaaaaaaaaagatccatctgattaaaggccagaagggtcttgaaagcccctccctgtaccctgtctgtgctggcatgagctgcaacgccctccacaaacccaggctcctgatgctcagtacttggagtctggtggcaaacaagggtgccaaccagacctcctgtctatacaaacacaggccgcccctgacatcagaaggggcagactccctcctgcccgtggctctggaatgcccgtgtcactggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtagagagagttgcttgaagaactgaggcctctagccgggcgtggtggctcacacctgcaatcccagcactttgggaggccgaggcgagtgcatcacctgaggtcaggaatttgagaccagcctgaccaacgtggagaaaccccatctctactaaaaatacaaaattagcctggcgtggtggtgcatgcctgtaatcccagatactcgggaggctgaggcaggagaatcacttgaacccgggaggcggaggttgcagtgagccgacatcgcgccattgtgctccagcctgggcaacaagagcaaaactctgtctcaaaaaaaaaaaaaaatcgaggtttcaggtgtgagagaggccttcttgaaccttccgggccaggtgtccactgaaacagctgcatgagtgacctgcactgcttcctgggagcagtcctgcctgctcaggccacggaatctgagaaataatcaatcattgttatttccagccactaagtttgggatggtttgttttgtggcaacagctgacacatgcagccatccagaagtggaattctgccatgaccaaaacctaaaacatgtggacttggccttggacccaggcagctggcagaggctggacggacaggacgaaatgactcctgggggctggagaaagggggctgtgtgtgtaccagctgaagaagtggaaagaaggtcaccctcagtgacagggaggatggagtgcctcccccgggaactcctgcatctggctaaggggtccaggaggaagctggcttctttttgctgcctagggtaacacatgggaagagaaagatgaaggaactgttccattttcaagcagaatttaaaggaactatttccaatccaggatgtactgggtggagaataaaaatgtttcttcttcccagcctttccagctggcaaaagattctaaaagagatggcctcagggcaaagatcaaatcccagacactggcctcaagggtgaggtccaaatccactttgttaaaccttagaagattcagacagcatcttatagaccatctggcaggctctcccatggcaccctgactcccaacccaacaaagagcactcaggatggcggtgggggtgcttttgtccagggaagcagaattttaagttgatagaaattccacagtggttttcaggcacttgtaacagcttggactaaaagagagagacggctcaaagtgcagggaggcctctgggtgcccacgttctacaggtgggaggtaggctgggagcgcagcaagcacgggccatttcttacagaacaggaaaggagctgccaagagcgacaccaggacacagagggcagagcacagccagggcagcaacggacaagggacaattctgggaagctgcagtggaggctcatcaaggaacaccctgcacccagggctgagaggtgaacaatacatgcctggctgggcttgggaattgccactgctccgtgacggccacgtgcctcccacgcctactgtgatgggctgcatgtgtcccctcaaatttacacactgaagtcccaactccagtgtctcaggatggaactgcatttgcagagagggcctttacaggggtgattaaggtaacataaggccattaggttgggctttaatccaataggactcatgtccttataaaaagaggagatgaggacacagacacacacagagagatgaccatgtgaggacacagggagaaaacagtgtctacaagccgaggagaaaggctgcaggagaaaccaaccctgcctacacctggatctcaggctcccagggaaccaccaggtccagagggcagaccacagcagtcacgggtggccccgaccagctacatctgtggtgtgcgcaccctctctcaacccctctcaggcgcggagatgcctctgcctttggcagtggggccttggcaagcaggacacaggcggggacgtgatgggtacttgtttcaagcctgtcttctgcgagcacttcctctcagaacccagccgccaggcctacggaagcccaggcaacgctgctgaaggaagcatgtggaaggccccagcggagaaggccacggagaagacgcccagcgccccgctgagcccccgctgacgcagcccacaagggacccacccagtgccaagtggtgcagaagcaccactcaatccacccagattcaacaaccaggaaagctgctaagctgggagagctggttacacaacaacaaataaccagaacgctactgaaaacatgtttagctgacaaatgccattctaagaaggctttacgcgtaaatgagaaaataaagactcctaacaaccaacaagcagatgacagtacccaaagatcatcacaggactcaacctgaaccttgtgactttacaaccatctacaaactcacgaacaagctaagccatgtgatgatgaaatcattcattcctctgaatcgggcgccccctctccaccccagggggtcagtcagggtgttgtccccagggtgctccagcatgggtggcatgcccttccctgtaaactcgccacccacaccctgcaatactgcacagtcatccgtctcgagcgatccctttgggatttggaataaggaggaccagctaacttgacagttaatagcaccatggctgccctgaagctgtacctgggccatctgtgcagcggtgtttccctttgcccccatgtagaccatggccagggcacaggacatgctcatgggtgagaaaaacacattcttcgagttgtctttacccagcgttttcaaaaggtttaaggcaaaggtgccatttgcttctgcgagaacatccatgatggcagacctggaacaagatttaaaatcagtatcacttaagcacagcttccacgcgactgcatctcacgcgccttaccgacagtcaccgccgatgctgtggttcagtgggcaagcagaaacacacacagaactctggctgtttctttttaggaccctccacattattttgtgtgtttctaatgttaagtgtggaaaatgaaagagttctatgtgaaacgccgccctgttttgtgaggactcctccctgcacgcctgcccgcacgtggagaaagtgggaaggaggcaccctttcctggagtctcttccttggggtggaattacagaaggggcactggcttttgcttctatgtttgtattctttggtgtgttttgcgggcttaaatgtactgttttaatttgaaaaatattcaaaatgatacattcactgacagttacacaagaaaagatggccaaatgtttttataatgagagagagaatcccatttctgggtagcaagagccttaaaaaaggatcaatcaagccacatacaaagatgcgtgaaagcctttcaaatgcctcctgacccttggatctccttctaggaaatccctgcaggtggcaaagccccaattttggaccacgcttggggacatcctgctgcaacaagccaggccttcctgcgcctgaactcacagcacactcaggacaccaccttgcctcatgggctgtgggtgcatgcccatctccaccttcacagacaggctcaggggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatcaatgccccactgcactacagggaaggtgaagttgacggaagtgaagctaagaagtagctgggcttgaaacgcagggcggatgcgctttctgagctgctgctcaagaagaagaatctgcagaatcaggtgagaggacaaggggcagctaagggccccacaggcagtcaggctgggaaggaggggatgcaggaatgcagggatgcggggcctgcctgctctgacacagttctcagatgtttaccaaatgaatatgtcccagtcagagaatgccagcattctaagacagtcccagtgactcacttgagcagtgagtgggaacccacggaacaaggaaggggagaagctggagcagacatttcctggagcagatgggagagggaaggaggtgcctactggaggccctgtgaggagatgctgaattaagcggctctccactgtgcatgcctttacatttggagctggggttggctgagcaagtgctccaaagatacctgggtcataatccctgggacctgtgaatgccccttacatggcaaaagggactgtgcagcacgattagattcaggctcttgagatgggagattatcctggattgttccagttgaccctaaatgtaatcacaggtatccttctaagagggagggagggggagatctcacgggaaaaagcaatgcaaagaataaagcaaaatgccactccactggccttgaagatgaagggcctcaagccaagaaacgcaaggaccacagctgcagtagctggaaaggcaaggaggatcctctggaggagcctggccctgcggaacccatttccaacctccaacctcagaactctgagaaaataaacatgtgcagtttagccacgaatccatggtcatttgttacagcagccacgggaaaccaagacaataactcatacacctgataaagcttgtttgctgtgcttgtttaaatattttgttttcaaactcttctttattcattacacagaatacttggggcactgggcactcctggcttgccaagcctttccaaacatattttaagattactaatttctaataaaaggacaatagaaagtacatattactaaaattcttctgaatataagggagtctttgatgatacataaataaatccaggattccgcagagccctgggaacaccagtataaacaaaagtagccattacacggaactgaagcaaaattgggcctatttttggttctttggattctagatcacaagaactgcccgcttatcaacttgaagagaaacaattggtaaaacagggaaacttctaggttaagaataagaaaagaggagatgccccaaagcaagaagcacagcctgtgaagtccgtgtctcaggactcaaagccagcagacaccctgacacgtggggttttccctggcctggggacatggacttctgtctttgtccccaagagggctcagcccacgtggagaggctgccaggtgagatggctcctccataaaccaaaaaaaaaagacagaggttaagtaccatgtcagctggccaggggaaggtcccacatgctcccccaaccccatcctagactattctaccgtcagcacacgttttcccctcaaatgctgaaggactcttacgcttttttttttgtagagacaaggttcttgccaccttgcccaggctgctctccaacgcctggcctcaagtgatcttcctgcctcagcctcccaaggtgctgagattacagccatgcaccacgcccagcctaaaggacttttaattcaaatggaaatgtccacctaagaaaggctaataataaaacactccgtctccggtaatatcccggagaatctgtttcaggcgctgatctttatatcagtaacttcaacaaagcaaagccacctttgtctgaagacacgcccactggggaggtgcctgtctggccagcccaggttacaccatctggggcagaggagaagtcggtgcacatgagtttcactgtgtcaggggatttaatttgaaatactgaactggagaaaccaaagcaggatattcggaggagaagtcagtgcacatgagttttactgtgtcaggggatttaatctgaaacactgaactggagaaaccagaccaggatattcggaggagatggcacgagtcaggaggaagacagggtctctagtcctggctctggtaccctgggcaaatcactggactcctgataccagtttcctctctgtatgaggaaaagcatataccagataatctgggttcccttccatctctaacattcaataattgttaataccaaatgcagaaggaagagcaaaaatgtagctcaattttcaaagcccacagtgaggtcagtaatgatattccatttcttagttgaaaacactgctgacagccgtgaaaggtaaaattctatctatgccttacataaaaattgctgagcaacaaagaaacaataaatcaaggatgtcctagagatttaattttcttagcagaaactatgttagtcattaaataactgaatatcctactcctgataaacacccttacgtcaaacagcaagtggtacttcccatgcttccttaacaaggtaagaattacctacttcagcagccaccagcacagctgatgatagaacattagtcccttaactccccaaacaggaacaagataaaaatatctgtcgtcccaaccttgtgtaactttgttcagatagttctggcaaaggcaaatacaactcatgaaacataatgagaaaggagattgtcagaaaggagacaaaatgagcacagttagcaaacaatttgatggtctacccaaaaagcagccagaatcagtaaaatactcttaaaactgaaaaataatggagtaactgggctactaaaaaaataggaaaaacagaccccagtagaaacacgtgcaaaggacattaacaaatttacccccaaaaaagaaagacaatagctaataattatatttaaaagtttcaacttcagaaaaaaatatcacttttttgatatatactatgtgctaggtccacactgaaagacccttaccctctgagatagctgctgagaacacctacgttttataagcaaagaaatcgggccttagctctttaagtaccatgtctccagagaacccagggcaacaatggcagaatgacggctggaagccaggaccgcatggctctgtagttcactctcttaacaccatggtgcacagccttcccaaaaagcaatggtggagagtacattaaagatgccttttcaaaccatgaaccttgcaaatacaaaaacaattcatgctaatactgacaaagacaggcaatccttctcacgccatgcaagtaatacggaggcagcagggacagagcttggcccgtacccactcccgtattttccatacatcccccacgccatcacacctgcccaccagaccatgcaaaccagggagggaaacaagataagccatgttccaccccaaatcttacccaagggagttaagcctgatgcccacatgcatacaggatcagaacgacgatcctgacctcttgccttgttgtattactaaaaccctctcctcaggggctcatctgccatgccctgatcatgacacatctgtgctaacatgatgttccccggtgcctgccactagcgtgtgtaatgctgctgacacacctcatgactatccatgtcaccctaaaacaccaggaacacctgtcccgagggccagcccgggaactcctgcccctgtgccgctgccctcctgctccagcataagcccattataaagccttgtctgggacactttctctgtctcatgtcaatttccactgcatgagaatctaagaacccacgatcagtaacaatactgtaaattggtacaccagtatttcctgagtatgatttagaattatgtcaaaaataaaagtaaaatacaataaagtgaaggaagaaaagaaaatgtcatggaaacattcatactatctgaattaaaaattccacttctaggaatttcactgaaggtaaaactcacaggttttgtacataataaaacattatgtacaacattatgggatataaatagggctaataataataaaaatcacagtaatgacatgggaatacacaagattacattaaaaaagatataaaactatacatacaatttaaatttatccatgtaaattaggaaaaaaggtaagtgtaggcacaatttacagacagaatagagggaaatactatacaccaaatgtttctaacggtaatttttatgttttttgtgtttttctggattttcacattttctatagcatataatttatggagggggttggttaactcttctttttatgaaattactatatatacattcagtttaaaaatcaggtggtgttaaaagagatgttataaaagacaacaagctccttctcagccctcccaactccccagaagcaatcacttccaaaccctttgctctttcttctggtatttaccaccatatttctacataacgtgtatactactatttttgacctaataactttatcatgttttattttatgtatgtatttatttttattagggtaggggtctcacgctgtcgcccaggctggaatgcagttgcatgatcacggcccactgcagcctcgaactcctggcctcaagcaatcctttagcgtcagcctcctaaagtgctggaactacaggcacccggccaaattctagacattatctattgccttcctaatctagaggccgagggcccggtcccgatccacaggtttgctttattatcactaaatagcattcgatgctaagccaggtggtgggatgggaacccatttcctttttatgtaatgctgatttgccttatattaatagtgcctttcccccctttccttagttttctatgtactatgtattttcaaattctccccaaatgttctacaggtcagtcaaaccctttcagtacttttttcatatgcttcgacacaaggaataatctaccagctgcattttcctctccctccgtctgtcaccatgctgctgagcatgcgcgactttcacgccgaagagaaatgttcatagacggggacaagtttccctactataatacatggccaatttatagtttggcaggctggtcagactaattttttttctcaaacacagcacattgcttacagggcaaagaaattattttttcttatttaagtgttgatgacatattttaatatgtctaattttttaatgctttatgcaaacttacaaattgcacaaaccttagtagacttttgaacttctacaaatctgataaatcaagacatataaatctagtaagctagcctctcctaagactttcaaacagtacaatgattacaaaacttatttctatacctgtacttatgtctagcaaaagttattcattaatatcacagatttaattattttatctttgttatattttcctattcctttcctaaggtaacactaatgcttattttaacagtttcctatggggaaaattaatcttatggggttaaatcctaagggatcatccctttctgtaaaaacagggtggggctccctggttcatggtctttgtgcatcaaagcagtttctcagcacagggcacacactctttgatgccaagcatatctgactagttagggcagctttgagctccaatcctgccttcactgagattttataaggcctcaaccaaacaccaaatttcagtgtcttgtagcctgatgtccttccttaaaatgaaatacggagttttcctctatctgagttgcatagaccagtgttgtatggtataacttggtctttttgttgaatgtttaggcctttaagttggtttttacaactactgtgtttgttagcccaggaagctataataactaaactttttccatagcaatcctagacacagtgcaaacattactgaattcttttgtgcctttttaaggctcatcttgtttgcctcatctgaacttattaatgagcttgggctttttacaaacaatatatttcaatttgctgatgtttttttttcttcttgttctaattggctggtgggaatctctttaaattagttactttccctccaaacacacttactttatatgcaggagtccccagcagatccgtctgtggtctgttaggaactgggccacgcagcaggaggtgagcagcaggtgagcgaacatcaccgcctgagctccacctcctgttaggtcagtggcagcgttggagtcttgtaggagagtgaacctacggtgaactgtgcacgtggtgatcttggttgcatgctgcgtatgagaatcgaatgcctgatgatctgaggtggaacagttttatcttgaaaccatacccccaactttatcagtggaaaaactgtcttccacaaaaccagtctggtccctggtgccaaaaaggttggggaccattgctttaaagcaacagcaaagtcttaccaaaccattttagatttttctagtccaaagactagatatgataggtgcacaccaccacgcccagttcatttttattttttgtagagacagggtctcgctcggtggccgaggctggtcccaaactcccggcctcaagctatctttccacgttggcttcccaaagtgctgggattataggcatgagccaccaagcctagcttgggaaaaaaatgtaaggcacttgctgatttcctccagactggctctttgttctctttttctgtcaagtacaaaactcttagactgatatcatctgggacttctcacctttctccaggctgtgacacacacagaaaatgatgtttgtatgtcactttggggccaggctactcaccccaaaggtgaccagtgcagagctccagccacccagactcctcgagttggagggatctgttaacctgcccagggcacaacacccacacacaagttagaaagttctgctctggaagactgaaactggaccccttccttacatacaccatgtacaaaaatcaactcaagatggattaaaggcttagatgtaaaagccaaaactataaaaaaccctggaagacaatctaggcaataccattctggacataggaacaggcaaagatttcatgacaaagatgccaaatgcaatcacaacaaaagcaaaaattgacaaataggatctaattaaacttaagcactcctgcacagcaaaagaaactatcaacagagtaaacagccaacctacggaatgggagaaaatattcacaaactatgcatctgacaaaggtcaaatatccagcatctatatggaacttaaacaaatttacaagaagaaaacaaacaactccattaaaaagaaggcaaaggacatgaacagacacttttcaaaagaagacattcatgcagccaacagccataagaaaaaaggctcagtatcactgatcattagagaaatgcaaatcaaaaccacaatgagataccatctcacgccagtcagaatggctattattaaaaagtcaaaaattaagagatactggcaaggttgtggagaaaagggaacacttacacactgctggtgggtgtgtaaaacagttcaaccattggggaaagcagtgtggcgattcctcagagctaaaaacagaactaccattcaacccagcaatcccattactgagtatacaaccagaggagagaggaatagaaatcattctcccataaagatacacgcacgcgaatgttcaccgcagcactattcacaatagcaaagacatggaatcaacctaaatgcccatgcatggcagatgggataaagaaattgtggtacatatacaccatggaatactatgcaaccataaaaaagaatgagatcatgtgttttgcagaaacatggatggggctggaggccattatccttagcaaacacacgcagggaacagaaaaccaaataccgcatgttctcacttatgagtggaagctaaatgatgagaacgtggacacaaagaggggagcaacaaacactgggtcctatcagagggtggagggtgaagggtgggaggagggagaggaaaaaataactattgggtactaggcttagtacctgggggatgaaataacctgcacaacaacctgcgacatgagtttacctatgtcacaaacctgcgtatgtatcctgaacctaaatagaggtttaaaaggttaaaaaaaaaaagaagaaatcatataaatgaatgttctcttctgaccttattccctcatttacacttttcatcatgatatttgattccattttgccttctatactaattctttggataccacaattatagtttattgagtcttccgttccctgcgctgcctatctctggggtccttttgttatggtggctggtgtttgctttattttatttaggtctctcttttgtacctagactttccaaacattcctaacaacccttggatgtcagtacatagttaagaggaaaacacaaacaatgctggaagttctgtttacatggaggaagttctgtttacatggacaggacatgtcagctgggagcttcactgcagtgtgctcaagggatcagcagcttttttgtccgggaaccagcaaatgggagaactcttcggtgtggctatcggtggtgttctggaaggagatggggtggaagcagatgggggtcggggggcttctactggatctgtaatcccctcacgtccccactgcctcccccacagtgcctgcaggaccctgagtttgagcattttcattatcacttcgcaataatgcataaacactgaacaattaatcataaaaaagattggagagatccaaatcctaaaaggaaagaaaaaataaatccacatttaaagtttaccactcaagatactccaaatatcaacaaattataaacaatctagtgagatttttctatcgagggctttctgttatcctttcagcaaacgtgtgagtaacaaggatgcctgtttcacagtcacgttgcaaactcaagacctgtcaatggctttttaaggacctacttctttagcttcagtaaataagatagctaagtgtccttcatatatatatgtgaatacacatgtatatatgtacatagacaaatatttatgcaaaattaattgtttcaaaatttaaaaactataccatttaaaaataaaaaatgatatttaatcacagacataaaaactggatattaaagtcttattaatgaacaattttatgtattttttaaacaagcctaacaaatctatcctggcatcactttttttttcctgtagcatcaccagtaactgagcaatgttcacaattgattttattcaactaatcaagtcttaatttttttttaggtgtcactattgaattgtgcttctcaacttctattaaggatgcctttatttcctactaaatttaaccatttaaagactggtttaatggaaacttggacttcctgctttgtccctctgtttccttgtgcagtgtgtatgtgtgtgtgtgtgtgtgttgtgtgtgtatgtgtttaatatatctgagcagcctaacatataaatgggagttaaacattattttcaggctaggcgcagtggctcacatctgtaatcccagcactttgggaggccaaggcgggcagatcacgaggtcaggagtttgagaccagcctggccagcatggtgaaaccccattgctactaaaaatacaaaaattagccaggtatggagcccgggaggtggaggttgcagtcagccgaaatcgcaccactgcactccagcctggcaaaaaaaaaaaaaaaaaaaattttctttctttggatgccttggcttaatcccaagtgcagtaagcctggaaatgtaaggtgtgtggtcttccctgggaccgtacaacatctgcttgggtgcccttattattacatatgtggaaaagaatgttggttctattcatgctaatttcactctactgttactggtccgtgttaactgtttcatgctgaattgtaataaaatgcattggaattggccttaacttaaaatacttagtttacatagtcgagtatgaccaaagtacttttctctttggtggcacatcacaatggatgcaattactcagatacggtcctgaaatgagaacaaacgccatctatgctgataacagcagtcactggtgttaatcccagcacacataaaagccccagcaatacaaggccggcccaggaccttaactagaaggtcactgaacacatcagatctcatcgcatcaggcctgacccccaccagaaaggatgcaggcagctgcagggctgtcattaggcacgagagcatcccagaaagcaaaagtgcccaaaaaatggactcagatgccccctcgcatctgagtattcctgacagcatgtgaacattaattattaattttctgtacctcagttttccgaagccaatctttaggacaaaaaaaaaaaaaaaaaaaaggaagaaaataacttaaatgccaatttgtagttaaagtttcctctttgccttgaagacatcaaagcctgtaatagtttgcctgtagggagtttaattcaaacacagagcggtaaggagatccgggctggtccacacgatcgtctccacaggtctgggcgacctgaaagtgctgcggattggccaagcccagcacggccagtccagtgaacacacgcagggggcccggatggcaccgtttggcgccgaacccctcggcctctctccgcctcccgcccggctcctaacacccggcgccccaagactgagcacgcgtcctccgggtcgcggagcgggcgaggggtcaccgaggccgcggggccgaccggggtcacctgtggcccgggaggctctgcgccgcccccatcccgcgccggccgcctcttccgtgggcgctgggcctgggcgcccggggtcctcgggtccgcggcgtcaccggccgggctcgcggccacgcacgactcacccggccgcgtcgccgttctctgccgctgcgaggctccggaagggaacccaagccggacgctcgcccgggcccccgccccgctgggactgctggggtcacagccccgcgcggccacgccccattctcggggctccagcgtccccgcgcgccgtcgacccacgcgcgttcccggccccgcgcgacccccaccctgcccccctccccgctcgcgcccccggctttcccgactttggagcgacaaacccaagccagcgtgtccgagcggctcccaagccagacacgtactccagagcggggagcgagcgagcagaacggcgggcagaggcgccggagccgccccggacctcaaatactcgcggggaggcgggcggagtcccgggtctcgagctaccgtcgcccgtccggagcgcgaagggagaggcggggcgggacgtgcgggtcaaccccacccgccagccggaggggccgcgagtcctgcccggaggccttgactttgaccacagtacagggccccaccagcgtgtttatggtgcctctgtggagactgaatgctggcctgtttccagaaaagggccggctcctgatacacggccatccactggggagtgcagaacacgcatttaaaaatgagcagactagatacaggtcacaaagactttgctgatgaaacagcttgcggcaaagaagccagccaggggcgggcgcggggctcacgccagtaatcccaacactgggaggccgaggcaggcggatcactggaggtcaggagttccagaccagcctggccaacatggcaaaaccccgtctctactaaaaatacaaaaattagccgagtgtaatggcgcgtgcctgtaatctcagttgctggggaagctgaggcaggagaatcacttgaacccgggaggcagaggctgcagtgagccgagatggcgccaccgcactccagtctggtccgtctcaaaaaaaaaaaaaaaaaaaaaaaaaaaaaaagtagactaaatagcttttgcaaagcaaaaggaatagtcaagcagagtaaacagacaacctacagagtgggagaaaatcttcacaatctatacatccgacaaagcagtaatatccagaatctacaagaaactcaaacaaattagcaagaaaaaaaaatcccatcaaaaagtgggctggcatgaatagacagttctcaaaagaggatatgcaaatggccaacaaacaagaaaaaatgctcaacatcactaatgattagggaaatgcaaatcaaaaccacaatgtgataccaccttactcccgcaagagtggccttaatcaaaaaatcaaaaactcaaaaaataatagatgttggcgtggatttggtgaagagggaacacctctacactgctgatggatagtacaaccactgtggaaaatagtatggcgattccttaaataactaaaaatagaactaccatttgatccagcaatcccactactgggtatctacgcagaggaaaataagtcattatacaaaaaagatacttgcacacgcatgttaatagcagcacaattcgtaattgcaaaaacatgaaaccaacccaaatgcccatcaatcaaagagtggataaagaaactgtggtatgcgtatacggtggaatgctactcagccataaaaaggaatgaattaatggcattggcaacctggatgggattggagactgttgttctaagtgaagtaactcaggaatggaaaaccaaacattgtatgttctcactcataagtaggacctaaactatgaggatacaaaggcataagaatgatacaatggactttggggacttgggggaaaagggtgggaagggagtgagggataaaaggctacaaatttgagttcagtgtatactgctaaggtgatagatgcaccagaatctcacaaatcaccactaaagaacttacttggcagggcgcagtggctcatgcccgtaatctcagcactttgggaggccaaggcaggcagatcatgaggtcaggagttcgagaccagcctggccagcatggtgaaacccccgtctctactaaaaatataaaaaaattaggcatggtggcacacatctgtagtgccagctactgaggaggctgaggcaggagaattgcttgaatctagcaggcggaggttggttgcagtgagctgagatcatgccactgcaccccagcctgggcaacagagcaagaccccatctcaggaaaaaaaaaaaaaagcttgccatgtaaccaaataccacgtgttctccaaaaaactatggaaataaaaaaactaaaatatatattaaatttaaaaataaatgtatataaatgagcagagcccacatcattgagccgtgtgttcaaggacttccagttctctccaggcataggaattagaccccagggtactgacaggttagccaagtaagtatgaaaactccatctgccatctcagacagagcagtcttggaaaacagaaacatctagcataaatggaagtagggaagatactagccaggtgttttacatgagttcaattttgagaactcaagctgttttactccctctgtgcttaccctaaggcagagtttctcaactgcgacactgttgaccgcatgaacccgataacttgtggttgtgggggctgtcctgccatcacacatgtttcacagaatctctggaggagattcaccaagtggatgccaggagcaaaccacacgcccctccctagttgtggcttaattagtcttaagtgatataaattgcgaatatttcccccagcttgtcatctgttttctgacattgcttctggtgattttggcatacactcttttaatgtagtcaactttaatgatttttcctttattgtttctgagtcgtagttagaaaaactttctctattcacaaggagcaatctctttttttttaaaaaaaagaataatctctagattatagagttcactaatgttttcttctagtatttgcacagttttattttttatatttagattgctgatccctttaaagtttattctggtgtatgggaaatatagatccaattttaactcgctttcaagtgactttcagtttttccacctctgtttattgaaaaaccattttcactaatgtcttcacatgccacctatgttatatatcaaatagctgcatatacttgggtctgattctgaactttctaaactttctatttggttctgttggtcagattctttcagttatagaggttttctcttatgattcaatatctcgtacagcgcattctccttactgctcttctgcttcagattttcctggctctccttgttgctttttctcccatacaaacttttttttttttttttgagctggagtccctctctgtcacccaggctggagtgcagtggtgcgatcttggctcactgaaacctccatatcctgagttcaagcgattctcatgcctcagcctcccaagtagctggtattacaggcgcatgccaccacacccagctaatttttgtattcttagtagagatgagggttcaccatgttggccaggctggtctcaaactcctgaactcatgatccaccctcctcagcctcccaaagtgctgggattacaggtgtcagccaccgcacccggcctcacccatacaaatttaagagtcaacttgtctagctctaaagaaaaaaatcttgttggcagggcatggtggcttacacctgtagtctcagtactttgagaggccaaggcaggcagatcacttggtcaggagttcaagaccagcctggccaacatggtgaaaccccatctctactaagaatacaaaaattagctggacctggtggcgtgtgcctataatcccagctgcttgggaggctgaagcaggagaattgcttgaacctgggaggcagaggttacagtgagctgagatggtgccattatactccagcctggatgatggagcgagaccctgtctcaaaaaaatatatatataataattaaaaaaataaaattaaactgtagtcaaacaggccagatgcagtggctcacgcctataatcccaggactttgggaggcagaggtgagtggatcaccagagcgagactctgtctcaaaaacataaaataaaataaaaataaaataaatgaaaataaaaataaatcttgttggtaatctattagaaacatattgaatttacatattaccctgttataaaccaacatttgtactttgatttagttgttctagccaagaacatgctgggtctttctgttccttcaaataatttttttcctttttcctttaaagttttgttcatgtaagatttgcacatttcttgtttagtttatttctagttattttatctctttgttgatattgtatgtaagcaagttttttccattatattttccaactagcttttgtttgtggatgagaaaattgtttttatgtattaactttataacctgctgccttactgaaattttttactatttgtattttttattgattcttttaagtcatctatagctatactacatcacctataaatagaaatagttgtacttctttctccaatgttcatctctctaatcgttttctcttgtttgattgcattggctgataccttcagtggagcaaattgcctgaccacttgtggtgttagtatctacaaaatgaaagtgtgagcccatatagcttcaccaaagggcaagtcattcctaacctcaatggcttcttctcaaaataggtttactgggcagggagacctaggaaggggttctgtagtctggcattctctgccatcccacctggatttaaataagattgaagaactatttccaaattacgtaggttaataattctgagctcagcatcctcctagagagacatatctggcataaagttgtttcataaatgtttatcacattttcattatatcgtattctaacaggcttataatgagaagcaatcaaaaccaaaagtaaccaggtttctaataataagtgagatgagtgcacagttggagaactactctgatgagtggttctgatgctcatgggacaaaggcctgggttttcgttgtctataatcaaacgtgaaaaagcagtttgatgtggcaccactggaaatgcgtacaggccatttcttcccctcttcagccattttcagatgggaaagcagaggggattctggcattctccaaaaaagacccctggaaaacccgtctccagagcctcctgcctgaaggtaacattcaggctcttctatattttttctctttcccgtttttctcatttaataaggaattggtcaatcatgcaatatacgcgtggggctaacctcccgagggagagcctcaccctctctccggacccagagtgaggaaggaaagatgagcaggggtgaatcaatggacttctgagtcacactttagttttcctcagaacttttcagggactgggccttcactcaagaaatttcccaggcagctgtcttgaaaactgagttcagggtgcctctaagctatctcagtgccaggtggtggctggaggagaggtgaatgccactgttagaagacactagagagctgaaggcaggcatctcattgtccgtttgtagaggatcacagtcacaattgttattccatggaactcggtgactcattggtgtttaatgttcagaaaattcatttcaaacataagatgtcataacaaagacctgacttcagggaaagcctttttctttcccacctgcttaattggtccctgctgctaaccatgactgaaaacacatgggttttacttagcaatagcgtgacattttcttttctcagacttctccggatgggggctagttcagttttggtttgaaaggacttcagtactccatgtaaaataaaagtaaaaaaagcctttttggtgtgtaaaccaaaaagtatctgagacaagtatcaatcaatttagaagtttattttgccaaggttaaggtcgtgcccgtgacacagactcgggaggtcctgagaacacgtgcctaaggtggttggggtacagcttggtcttatacattttagggagacataagacatcaatcaatagatacaagatgtacattggttcggtttgaaaaggtgaaacaactataatcgggcggggaggctccaggtcataggtagattcaaagatgttctgatttgcaattggtttaaaagagtttatctgaagacctggaatcaactgaaggaagtgtctgggttacgataaggggttgtggagaccaaggttcttattatgcagataaagcctccaggtagaaggtttcagagaggatagattgtaaatgtctcttatcagacttaaaatgtgccaaactcgtagttaattctctcctggatcaggaaaaaacctggaaaagggaaggggattctctacagaatgtagatttcccccacaagagacagctttgcaggaccatttcaaaacatgccaaagaaatacattttggggtaaaatacttcaatttctttcagggcctgctctttgtcatgtgatgctattctaggaccaggctggaatttggtgtctgactgctacaaaaaaaaaaaaaagctgtttcattagtattaagatctctattttaacattaatgttggtcagttgtgtctgaattccaaagggaggaaggcatgtcctgccccctcttcccatcatggcctgaactttggaatgcccttggcccagagaaggggtccattcacatgcttgcagagctcagagttttattcttagtttacagctgtttacaagacagtctgaatttacaatcaggaaactggaaatagagatttaccagcttcagcatgtgtccctgaagcttaaaaaaataaaaataaaaaagatttactagggatcttcgtcatgggtactaaacacatctcatttacttttgaatttggaattgttacaagtaaatattttgtattgctgcactttattttttaaaacaattccctttcaaatgttagaaatcatagattgaggaaaacactttcaaaaagaatgtgcaaccacaaccagctcatgtaacacaaatcgggtttggtgtaagaacacagcactctaactcacccatgaccaaaccaaagaacagcaactaagagatcactctgaatgagcgcactctgttctgctgacatatcagctctaacacagaaagggagaaaagaagttctcctgaataactgtgactatttcactgtgacacttacattatgtaataccatcattctccttgtaaatttctcagaatttcatggattaacagactcataaaacttgaagagcatttctacctcgatgttaatggtaaagatggatttgaatttatttagcaatatttaaaaaaaaactaggtcacagtaaattgaaccaaggaagactcagtgtctaaatggtaaataaataataaactggggccatggatgagtaaaaaacttaccctaacagataaaccatccatgattaggtcaattgcttagtttactctatttggttaattgcatatttatcatacaactacaatgcaaacattgagattggtccagagctagaacccctgccctccaacagaggacataagttcctaggcaactacctacaccaaatttgttttccttatagataatgtaaaccaaaaataaaattctaagtaccccagccaactgaatggacctctccaccaagggcattccaaagttagtgtgaaaaactagttcaggccatgatgaaaagtgaggacaaacatgcctcgttctcattacacccacgtgcctttggaattcaggcacaattcctcatcttaacgcagacattctcttctattgattccatctgcatgataggaaccttagtctccgcaaccccttatcttaacccagacacccagacattcccttctactgattctaaatctttagataataacttaacccttttcaactaattgccaattagaacttttttttttttttttttttttttttggagacagggtctcactctcttgcccaggctggagtgcagtggcatgatcttggctcgacttcccagactcaagcaatcctaccaccatagcctcccaagtagctgggactacagtcacatgccaccacgccagactaatttttttattttttgtggagacaatgtcccactatgttgccaggctggtcttgaactcctgggctcaactgatcctcctgcctctgcctcccaatgtgctgggattataggtgtgaaccactatgcctggccagaaaattcttgaattcacctatgacctggaagcccccacttccggttgtctgcctttctggaccgaagctgcatacattttacgtgtattgattgatgtcttatgtttccctaaattgtataaatccaagttgtagcccagctaccttgggcgcatgttctcaggatttcctagggttgaggatttcctgtgtcaggagtcattggtcactcatatttggcttagaataaatcttttcaaatattttacagagtttacctcttttcatcaacaatagtaaacattgcaatgtttcctaggaacaacagaaaaattatccaaatgatatatagcaatgccaatcagcaatgtttctatacttttgtcagaggcatttgaaccagacctactccatcttgaatatgggtaggtcaattaaggctatcctttaataaatatcatggatcatcaaatatgagagctacgggactgcattcccaggaggttaggcattcttagtcacaggatgagataaaaggtcagcacaagatacaggtcacaaagactttgctgataaaacagcttgaggtaaagaagccagccagaacccaccaaaaccaagatgatgaccaaagtgacctctggtcctcctcactgctcattatacagtaattataatgcattagcatgctagaagacattcctgccagcaccagaacagcttacaaatgccatggcaatgttagggagttaccttatatgctctgaaaaggggaggaaccctcagttctgggagttgtccacctctttcccggaaaactcatgaataatgcactccttgtttagcatataatcaagtgataactataagtacactcagttgagtagctcttgcctctgctctgcctacagagtagccactcttttgtttctttacttctctgataaacttgctttcacttaactctataggcttgccccaaattctttcttgtgagagttccaagaaccctctcttggggtctggattgggacccctttctggtaacactttctagctctcatatctgatggcctatttaaaaaaaaaaaatagtagcagccactcccagtgactcgcttggtaaacctgattgggtcatggatcacttctaaaggacacctagcaggcaggcagcagagaacctgttacgaggccatgaatacagacaaaatgcatgtaacctttcctgccagtgtaaggaagtcaaggaggagagtttaaaataagatgctgttcaaagtggtgcaagacacaaggaacagagatcggatgagaccacaggcaataggcaaataaaagatgcactctcttcctctgagaggtggtgacccactttcctaagagaaaagtgttttgaagactgacttcccaattttttctgccccgggaaagcttctggaacaacactttaggggctactgacaggctgctctgcttctcaccagccatgagcatccaaccccaaagcagtccccaggcttctctgtgtctcctctacaaggacgggctggggaagaccctaagctccactccctgcaccatccctagcttatgagagcagccaccatgctccctgctcctgcatttattgcaaagagcctagcttccttccagaattttctgggactagagcaaacaacctgccttattttctgaaatatcatagtggagggttgagagacactggaacttacttttctgggtggtctctccccagctttccttccagatttgcagggactaagtgctagagcctttctcctcttacatatgagagtagacctcgaattgaggtaaagccatggtccttcaatctaggcctaatattggctttgctccctgctccctggaattttgaggcaagtccagcatggacttgcctctcccactcatacaactcaagtagttcattgaggtgggtgaaagacccagaaatgtaaccaggccacactctcctacacctggaatttgtaaaccctccccacggcaaatgcatatacttgaagtccctccctcactaagtaacggagctggaaaaccctatgagacaaactagtgactagttccccataacttcgtgcactaatctttgttgcacaagcattgtatcagatcacagagagttgagaaatagaattgcaggaagcatggtccttcctttttcaggcgctcagatggctgggaaaggcactgtgcccacagaatggcatgtgcctgctctaacagggcatgcacgcacccatgagaacagaagccaggaagaacggctctgtgagcctcaggatgtgttccctggggcctcagctgagctcagtctcgtaggaagagtaattttccagagctgagaaagaacaaacaagtgacaaagattcctagcttggccaaacattagtcaggtttctttcttttctttctttctttctttctttctttttctttcttctttctttctttctttttctttctttctttctttctttctttctttctttctttctttctttctttctttctttttctttctctctctctctgtctctctctttctttccttctgagatggagtctcactctgtcactcaggctggagtacaaggttgtgatcttggctcactgcaatctctgcctcccaggttcaagcaattctcctgcctcagcttcccgagtagctgggattacaggcatgcaccaccatgcctggctaatttttgtatttttgctagaaatggggtttcaccatgttggccagactggtctggaactcctgacttcagatgatccacccacctcggcctcccagagtgctggtgttgtgagccactgcgcctggcccattagtcaggtttgtgaaacttctattaggtctacctgtgcacttccatgtaaaatctagttttagcaaagaactccccagtttcactgtgcaatcacccttgatatctgatcaggcacctcatcctccaccgcctcccaggggctgtctgatcaccctgacctgccttccgcaagaattctgtgaggtcggtttagccagaatccctctgacccctgatgtctcctcttagtcattttccatccactgaccccaccctgctccttggctataaatccccacttcctcaggctgtatttctggttgagcccaatctctctcctgcactacaagactctgttacagcagtttctaaccctattgagttggtcctgaataaagacttctttactatgctttaataagtatcatggatcatcaaatcatttatttatttatttattaccaccggcaacagaaaggtgcagtgtgacagcccacaggggcaaagggtgagtgtgctttaagggaggagagaagggtgtgggctggggagaggcccccagggaggtagggtagggctggatggtgtgtcagggatgggctgggaaagagtccttgtgccattctaggaaatttgggttttatccctcagacattggggaaccagcacaggattttaatgagaggagaggattgctttctcttttttccctttcttgcccccttttttccatcctttcttcttttcctcctccctcccccgccccaacccccgtctcactctgtagtccaggctggagtgcagtggtgtgattataacttgcggcagcctctacctcctgggctcaagcaatcctcctgccttagcctccagagcagggactactggcatgtgccaccacaccacaccttccttcttttcttccttcccaactccagcatcaggccttaggatgggcagggtgcagaagacagtgacagcagggagctgtttagaaattggcctcaggagcccagaacacaggtaatttgggccttagccaggcactggcaatggtgatgtctgtgaggcagagagctaattagggggcagaaatcatagactatactgaacaagtggattttgagagagaagggcagagttacagttccagatggtttgtatttattctaactcagagaactgggtacatgaaagagtatatagggggaggaggatcagatttaggggtcagataatcagtttgagtcaaaaggggcttagagtgctggtgaacatttaggtgaagatgtccagaggacaggtagaaattacgacaaaggtaagagctatcgatgctaaatgaagctgggggagaaactccttgatccagcaacaaacattttaaaagacagctggaaaaggagcacatggcaaagaggacagagaaggagaagacagaagaaacagagaaccaggtcagcatccgctgctggtgctgagaggaagaggagagtcagaattgaaaagggcatttctcattcccaagtcgttagttaccaagggacgatagatgggaggagcaaaaactgaggcagatccaggcctggagacacatggagagagttgtcttagaatactctttcaagaaacttatctgggatgaatgagaagacgaactggagctggaggtgggactgtgtcttttgagataggagccttggctgtgacccatacaatgtgtaaggagaggcatcacacctcttccacccctacaagttgatactctcatatttaaaatctgagttaaggccaggtgcggtggctcatgcctgtaatcccagcatttttggaggccgaggcaggcggatcacttgcagtcaggagtttgagaccagcctggtcaacatgatgaaaccctgtctccactaaaaatacaaaaaaaagttagccaggcatggtggtgtgtgcctgtaatcccagctactcaggaggctgaggcaggagaattgtttgaacctgggaggtagaggttgtagtgagccaagatcacaccactgcactccagcccaggtgacagagtgagactccgtttcaataaataataataattaattaattagccaggcgtggtggcaggcacctgtaatcccagctagttgggaggctgaggcaggagaatcgctttaacccgggaagctgaggttgcagtgagccaagattgcgccattgcattccagcctgggtgtcacagcgagactccatctcaaaaataaataaattaataaattaaaataaaatctgagttaaatttaaataattgtgttgttctggagattttttaaaaaatatcatcactggtcataagaatttgaggaatagctaaataacaaaacagaggtttctctctctgtctctcttcctttttccataacaagagaagctcatcttcttatctggtctggaatcacttgggtgacatttcaaaatgcaaattaagagccaggtgggcaggtccccaatgcgttgggatgggccgcagctgactgggcagcctcccttgagctcccaggactttgccgaagggagtggcgtccatttgcatgaggagctcaggaaaactgctcctcaggtgccgagttagagacacctagtgagcttcaccagagtagttttgaccagggatacaacaaagctcctaaaactgaaaaagcacgaaaacaaaaatggttgtgaacagggctcagcgatgacgaggctacattcagccagtgtgtgtctggtgccatggtagacacacccctgggatcctgccgccctggcacagggggtgctctgggagacagaggctggaattggactgcattgcagccaggtggccttggagacccagaagggtgcctccttgggcaaacttaatgttccccctaaagagatccctttgaagatccgcatggctttcacacaaagggcgtggggtttagttccaaaacgtaggcttgggtattatagaataaaagcaaaagagggcacaagatgtgcattttcattatgtttacttagtgaagggtgggcagacattttcattatttttgggttttttgtttgtttgtttttgagacagagtcttgctctgtagcccaggctggagtgcagtggcaagatcttagctcactgcaacctccgcctcctgggttcaagtgattctcctgtgtcagcctcctgagtagctgcgattacaggcacccatcaccacgcctggctaatttttgtatttttaatagagacggggtctcaccatgttggccaggctggtatcaaactcctgatctcaggtgatccacctgcctcagcctcccaaagtgctgggattacaggcatgagccaccgcgcccggcccattttcattatttttaaacaaaggcgagcaattcactttctgggtgcccacctgaagtagagaatcccaaccccttaccatgaaaacagataatctgttcactgagccccaaggacaaagcagccagggtcgactgaggggctactgcagccttcctctctgactcctcccacctaaccattccctcaatacctcaatacacacactcctttctttcccaagtctattgcctcttccaaaagcaatgtaagatccgccccagaacagtggggagttcttatcctttccgttacctaagcaacctgagggcaaagacctttagatcaccggcagtgctgttctttgggtaacttgatctttgcttatcagctttaataactttattatacgaaatacccagccttgatgaagtatcgatgactcactaactgtggtgtaactaattgtttcattcattctacaaacttttttttttttttttgagacagagtctcactctgttgcacaggctggagtgcagtggcgcgatctcagcttactgcaacttccacctcctaggtttgagcgattctcctgcctcagcctcctgagtagctgggattacaggcgcgtgccaccacacccggctattttttgtatttttagtagagacgaggtttcaccatgttggtcaggctggtctcaaactcctgacctcgtgatctgcccaccttggcctcacaaagtgctgggattaccggcatgagccaccgcgcctggcctcattctacaaacttttattctgcactcactataggctgggagctacactagggcctggggacatgaagacaggcgacacggtccctgggctcaagatgccagacagatgtgcaaacaagtgaaatctgatgtgatatgtgctttagtggtgccaaggataaaaggataagtgttaagaaaaagtagcaacaatatgtctgactgggagaatcaagaaaggtgtcatagagtccctaacacttgagctgagaatgagaaagagcatgagctggccaggtgacacacagagcatattccaacctaggagactgggaaatgggccaaaatatatacgtttgaggaaacaaatagcttactatataattaaatatgaggcagtttagactgggcccttatggataagtcacacccataaattttatttcatcttacaggcagtggagagcctctggaggattctgagcttcgtggtctcatcatcagagttatgtatggcaaccatcccaacctttttggcaccagggaggggttttgtggaaaactatttttccttggacagcagaggatggtttcgggatgattcaagcacatgacacttcttgtgcactttattttcagtgggagccctgagcttgttttcctgcaactatctggccccatgtgggggtgatgaagacaacggcagattatcaggcattagattctcataaggagcgcacatcctagatcccttatgtgtgcagttcacagtagggtttgtgctcctataagaatctaatgctgcctgatctgataggaggcagagctctggtggtaatgcaagcaatggggagcagctgcacatacagataaagcttcactagctcacccactggtggctcacctcttgctgtgtgtcctggttcctaacaggctacagaccagtcaggtctgtggcccgggggttgggaactcctggtgtatggaagagactactctgcagcaatgtggacaaataggatgagggtgagctgtcaggggagacaggcacacatggcagagctatttaaaaaggaggatagatgaccaggcacagtggctcatgccagtaatcccagcactttgggaggcagaggcaggcggatcacgaggtcagcagttcaagaccagcctggccaacatggcaaaacctcatctctgctaaaaatacaaaaattagctgggcgtggtgacatgcgcctgtaatcccagctactcaggaggctgaggcaggagaatcacttgaacccgggaggcaaagattgcagtgagccgagatcgtgccattgcactctagcctgggcaacacagcaagactctgactggaaaaaaaaaaaaaaaaaaaggaggatagacagggcttggggattggtggatgggtagataaggaaggaggagtctagcatgactctcagactactgacttggaccagcaggggaatggctgtgacaataaataagattgggaaaacaagaaggtgagcaaatttagaggagaaaatgaatttcatttttggcatggtgtggaaggctcgggagagaggtctaggcaccagatgtcaacgtgaggtgaaatggatatagctgaagtcaagggtgtggtgaggttttgcagggagagcagggacctccagcaaggccagtgcataagggagaatagagaaaaaaagaaccagaaaaagacaaggagaggccagagaggtgtggaaagaaccagggaagacagttattcacaacaaacaaaagagggcagagttttagagaaggaactgagcagtttggggctccaggtggggcaggagtgggtggccacggttgaggggcagtggccttcaaattggtctgggtaggttctaatgggtcagattggtcagtcctttccaggacactgaaggctgcagaggtgtgactggatgctggtggagggatgcatggcggggaagctgagtcagatcctgaaatcctccaagcatgcgcctgaaatgaccaagggaaatgaaggcggaggctgctgtcgcctggtggcctgggaagggccaagagccagggagctggagggaggagagaacgtgcgacctcagcacggagcactgtaggggaggcggggctggagggagatggcgccgcgctcccggatgaacagagaaagcgacagggtgagtcgcagggcacagtgtgggatgagtcaccgacagcaaggcatggactccgggaagaaggggagacgagccgggaaagacttgcatcggggatgtgagctgagctgcacccagacaaaagcggctcggggctcctgaaagcagcaggcaccgccggtcctgccaaggggctacttcctgcgcggagtaggagagtaggagaccccaggccagtcccaatccccggcccgtccgggatgaggggggctgcgggagctgcgggggcctcctccagggaggacggttgcagggtccctcggccgccgcccactcccgggggcgttccttcctcccagctgcgcccggagcgcctgctgcctggcgagagcccgcccctctgcaaccagcccgctgcagcggagggcgcctgggtgccctcggccgagccagcagcccacggtcggcgccgcactgtcccctggtggcggagcgctcccgcgacccggctcgccacgcctgggaggggtccaggaggacgcggctgggacctgggggctctcagggtggggccttgggggatgaggctggggcccgcgggaaaccgggctggggcgaggaggctcgcaggacttcctgccacagaatgtttcgatgctttttttaattctgcaaatgtaagcctttccactttaagtccaagctcagcgcagaggactgttctataatacatacaatttagtttaaaaatgttgcaaatgttaacatgtgtcacaaactcaagcaatccagtattatagaaagcaaagaatgaaatgtgctgcttctttctcccccagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttgtgagagctgggaagtttcagaggtagggtgtctttaatgaaggggctgggcattaagagcacgggggggaatattcgtgctttccttgggaaagaacggagatttttcccggaatcaagaaacccctttttttctgtcccttcttggtctcttccagtcgttgtcatggcgacatgttgtttagcatgagaacaggatgatgataaagccagaggctcttcagaggcgccatcttggatttcgccagcttcagctggtttcgtcctaagaaggaacttcgaaacacaggcattctttttcctgaaaataagcagagttacagctgagtaggaatttagctctgtcccatatgctatcgcattgggcagcaaaagcagggtggggtccagcgaaatcagcaggcactgcaatgagtaacatacccagccacgtttatgcagcatttttacgaaaatgaaaccatactacctgtaaaggaagatatgctaacaaacaacaaaactggcaggaaccaagattcctactgacactacccttagttttaattttccctgacaacaaatgaggttaacagagcataattatctaccgtgaccccttcaaaaagacaggctgtatacatttgcactaagagaagaaatcgtgtaatgtcagcaaatttcccccacttaaagcttctctatttaaaaagcttcacgcacacatgcacgcatatgtcttcaagatgaccacaatttattttgcagtcattctttgcaccagttcccaatttttcccactagcttgcaagctccgtgactcgaggagaccgggggatcagagtttgtttttgcggagaagtgagtcctttatgccccaaatagtgactgacatagagaaggtactcagtaaacactttttaaaggaatgcctgcctgactgaagcttaatgatgtgaggcttctagtgggataccctaccttgttttaacctgaagtgactcttccttagctaagagagccagacggactccatcgtgactccttcactcgcagccccttacccacccccttcctcaaggacttaacttgtgcaagctgactcccagcacatcaagaatgcaattaactgataagatactgtggcaagctatatccgcagttcccaggaattcgcccggttaatagcacccagagcccctgcgtttgtgtccggttgataacgcccaaagcccggcgtccatcaccttaggatagacttaaagcctctgcacctggaactgtttactttcctgtaaccgtttatccttttaactttttgcctactttacttctgtaagattgtttcaactagactccccctctcccctgtctaaaccaaagtataaaagaaaatctagctccttcttcggggccaagagaatttcgagcgctagctgtctctcggctgccggctaataaaggactcctgaattcgtctcagagtgtggcgtttctctgtaactcgctcggttacaacactaggttaatctttttcctttaactgtttgtttaaaatatattatgtttaagaccttctaactggtcagcctccaagatagtattgtgctgggcttgctttattctggtttggtttccatgatcccagttcatgtgttacctgcttctcttttgaattcacaatgatacacaacttttaatttgttagaacacaaacataaggaatttttttttccattttaatgtgagatatgacagaggcaaattgtttcttaaagacataaaataattaaaataattacataaattgtaataaaataattattacaatgttctatctttggcattaaggcatagaacaattttttaatcctaaactaggctgggcatggtggctcactcctgtaatcccagcactttgggaggctgaggctggtggatcacttgaggccaggagttggagaccagcctggccaacatgatgaaaccctgtctctactaaaaatacaataaaaaatttagccgggtgtgatggcgctcacctgtagtcccagctactcaggaagctgaggcaccagaatcgcttgaacccgggacgcggaggttgcagtgagctgagatatagcgccgctgctctccagcctgggcaacagaatgagaccctgtctcaaagtaaattaaataaataaaatcctaaactgtaggaccaagatttgattcagaaaagagactttcttgtactaatttatacactgttcatgtcagatccaatctttctttttattagatgaatctggaaaagcaacttagaataattcaatcagtctaaaagaataacagctgatgagatgcagtcaataagcagttttgtattagtatttttataagaaattagaaaaacatgattttgggggagatcttctcatagttaacagcacatataacatataagttagaaatgtactctgctagctcataagattttaaagcagggattttagtgtcattaaacttttatttataatagtttttttaatacaatttttttttttactttggaataactttagattcacaggaaagtcagataatacaggtagttaccatattcccctaacacagtttcccctaatggtaacatatcaccatggtagtgttgtgaattcttatgttgggttgcctccacatccattttgaatatacattggactttcccacaccaaaatcaaggctcagtcaccccggacaaagttgctggttctccaccttctcccagttctgttatgtggtggatccagatatctgcctcatacaactatctcctgttgaccacttctctatggcacagctagaacctattggccacactgaccctcacaccccacctagaatgtgcagatgcgccacagggcccaccactcagtcactgtgccacctcctggaactcatgcctgcttgctgtaaacccaccgaataaaactccccatgggaaacctgtttggataacaccctggacccaataaaggtgttggcccatgggttgctgtcttggtctctctgcctgcactccctgatttccatgaaggtggcctccaagtatgccatgtgccccaggatctgtaagtaataaactatttctagcctgtgtctctcctaatcgttgtaggggtgctccgcatcttgaagatcttaaagtaaaacagatacatttgtggaaactaaggtcccaacgttgtacattactattaactccaggcttcatttgggtttcagttttttcattaatatcagcctaagtttttaaaaaatagtcagccgaaaagaaggatttaattttatgtggtaatttctgcacaaacataatattcttgagaaacatcttgtctatcaataacatgtttaactatatattatatcaatatgctcaagaaatcaggccttggtaaagatttttcttttttttttttttttttgggacggagtctcgctctgtcgtccaggctggagtgcagtggcacgatctctgctcactgcaagctccgcctcccgggttcaggccattctcctgcctcagcctcccgaatagctgggactacaggcacctgcaaccacgcccggctaattttttgtatttttagtagagacagggtttcaccatgttagccaagatggtctcgatctcctgacctcgtgatccgcccgccttggcctcccaaagtgctgggattataggtgtgagccaccgtgcccggccccaagatttgtctttactaagtaatgcatgtgaaatataataactgacaatgataatacagtgaccaggtaactcaaaaattataagtcattcaattgaataacatagtgtttttgaaatgtaaaaagataaatataaataataagtcatattaagacaaaatttatttaactgataaaagtaaaatttgttattctctctagctgtatagataagacaggatctctatagtgcattatttcaagacttacttagtaggaaaaccagtaggtttgatttttttttaaatgccactttggttttaaagcactcgctttgtccactagttttctagatctgagtattggctattaatgacatatttctaaattatacacatcaataatgtgacaatagcttcaggtcaggaactactgtgtgatttagatgtttgttccttccaaacctcatgttgaaatttgtttcatcttttttcttgttttcatagataagggcctcgctctgttacccaggctggagtgctgtggtgtgtttgtgactcaccgtagccttgaactcctgggctcaagcaatcctcccacctaagcctctggagtagctgggactacaggtgagcaccgccaagcctgacctcaagttgaaatgtgatcaccaatgttggagtggggcttaatgggtggtgtttaggttgcagggccagatccttatgaatagatgaatgccctccctcaggggtgagtgagttcttccagagctggtggttagaaacaatccttgacctccctcctttctctcttgcttactctcttgccatgtaatctctgcacactccagttctccttcaccttcctccatgagtagaggcagcctgaggccctcaccagatgcagatgcccaaccttgaactttccaaccattcagagtcattagccaaataaaccttttatctttataaattactcagcctcaggtattcctttatagcaacacaaaacagactaagacaggaacctacactccttagaagaaggccatatgatataagggtgttgagtctaagattttagtgtctacacttcgtcttacattttccattctttccattttcacaagtcctatgatacagttgaaaatctttcctacgcactagtaaagccataggaacttaaaattattaagtgtcaagcacatatgaaaatcagacaatgtgcaaagaaaaacgggctatgtgttgcatgagaacgaggaactaatgttcagtttagggatatgaactgttcagaaacttggtctgatcaaagttatgtcagccttaatagtaatctgactgataaacaactaatacttgaaagacggtactgatatggactatttcacctggagattgtttacttgataacttttttttcaagttctgcaaggtgatttaacatccaaaaatatatagtcaatcctgggtattcatggaggactgggaccaggacccctcaaatatatcaaaatccacagatgctcaaatccctgatataaaatggcatagtattgacacataacctttgcacagcctcccatatactgtaaataatctctagattacatatagtacctaatacaatgtaaatgctatataaatagttgttacactgtatttttatttgtatttttttattgttgtattgctttttctttcaaatatattccattggaggttggttgaatcagcagatatggaacacacaaatacaggaggacaactatatctaaatctagattaatgtaagcggtgagaaaatattttatctccgtctaagtaggtcctaccagaggggaaactagactcactcaaagattgctttgatcaatccacacacagttcagtgatggacagagtgtcagtatctgttatatgtgtcactatcccatgctagaggtgtcaatagattatgtaacctttctgaggaatcacaatacaataattgataataatattgatcacataaacatagacttccttgacacaggattgccacagaccttcaatttgtaaaaaaaaaaaaaatgcaacatctgtggaagtactataaagagaagcagaataaggcagatatgcctgtataagactaagggagaatcttaaaagctgcaagagatgtacaagggatcctcaataaatccatacatctgtggccagtgaatttttgacaagagtgccaagtccattcaatgatgaaataatagtttctttaatatatgctgtgagagaaatggatttccacatgcaagactaaagttgggctccacttcacaccatatgtgaaaaataattcacaacctaaatataagaactaaagccatatagaggaaaacgtaagagtaaatcttcatgatcttgtgttttgggttcttagataagacactaaaagcccaggaagaaacaacaaaaaataggtaaattggagttcataaaaaatgtgaaacttttatatcaaaggacattttcaagaaagtgaaagacaacctacagaatgggagaaaatatttgtaaatcctatgtctgataacatccagaatatgtaaagaacacctacaactcggccgggtgcggtggctcacgcctgtaatcccagcactttgggaggccgacgtgggcggatcacctaaggtcgggagtttgagaccaggctgaccaacatggagaaaccctgtctctactaaaaatataaaattagccaggcgtggtggcgtattcccgtaatcccagctactcgggaggctgaggcataagaatcacttgaacccaggaggcggaggttgcggtgagccgagatctcgccattgcactccagcctgggcaacaagagcaaaactccgtctcaaaaaacaaacaaaaaacctacaactcaacaacaaatagacaaacaacccaattaaatggtcaacaaaggacttgaatagacatttctccaaggaaggtatacaaatggccagtaagcacatgaaaagatgctcaaagtcattagtccttagggaaatgcaaatcaaaaccacaatgagataccacttcgcacttgctaggatggctataatttagagggaaaaaaaagaaacataacaaatgtgcgtgagaatgtagagaagttggaacctgtgtacattgttggtgaaaatgtgaaatggtgtagacgctgtggaaaacagtttggctgttcctcagaaagctaaacatagaatgaccatagaattgtaataccgacaattccactccaaggtgtataaccaaaattattgaacacagggactgaaacagatacttgtacaccaataatcattgcaatattattcacaatagtcaaacaacagatgagtggataaacaatgcctggtacccttccttccttccttccttccttccttccttccttccttccttccttccttccttccttcctttctttttctttctctctttcttctttcttttctttctgtcagtcttgctcttgttgcccaggcttgagtgcaatgacacaatctcagctcaccgccacctctgcctcctgggttcaagtgattctcctgcctcagcctcccgagtagctgggactacaggtgcacaccaccatgcccagctaatttttgtgtttttagtagagatggggtttccccacgttggccaggcggtatacacatttttctattattcggccataaaaaggaatgaagttctgatgcatactacaacatggatgaaactcagcaacaaggtttttgaggaaaaaaagcttagtgaaaaggccacatcttgtaggattccacttatatgaaatacatgcaatagacaaattcatggagacagaaagtagattagaggctaccaggagtggaaggaggggagaatggggatttattatccaatgagtgcagtgtttctatttgtttttgtttttgtttgagacagggtctcgctctgtcatccaggctggagtgcagtgccacgatctcagctcactgcagcctccgcctcctgggttcaagcaattctcctgcctcagcctctgagtagctgggattacaggtgtacaccacctggcaaatttttgtagagatggggtttcgccatgttggccaggctggtctcaaacttttgacctcaggtgatctgcatgcctctgcctcccaaagtgctgggattacaggcgtgatctatggcccctgacccaagtgtttctatttgggatgatgaaaacgttttgaaaataaatagttgtaatggttgcacagcactctaaaggtaatttatgccactgaattgtacacttaaaatggtgaaaatagaaaatttcatgttatacagattttgctacccaaaaaacaaaacaaaaaatccaaaacctttatgttattatgaagaagcagttttccaaaggaatagggatgctggtagcagaagggaaagaaatctcattaaataaaaacaaaagcaatgacctcttcaggaggtggctcagctagtttagctttaccttagcaccatgatggttcattttattcagaaatagaaacatggggcgttggggagaagaggagatgtgtacctgcctcacctgcctccctgcccagaatgccgactccgactcttgctttccactaaggctggggattaaatgaaaagtgagaatctggaaacccccagagatgatgtttgtcgttggagctgattttatctcattttagtagcatgacctcctcctcaaactcaggatgcaattatggtcaatctcattagtgtgcagtaattgctcagccccaataccagattagcaggaagttctgttattttccttttgaggatgggctcctactgaactgtcctggaatctaccaccattcaggttacaaaagacccagggaactaggccagtccagctcccaaccccaagcagggagcaacttgctcagtccacgttgtgatagctcctcgctgccacaaggtggtgatgttgcatcacacacgcgcatgatgggcgcgcaggcgccaatgctcccaggacctgctgttccattcctaaatgaaagttgttcccaggatctggactcacaagacaaggcagcctattccctgctggggagctcaggggcaagagggcatctcggagggagggcacattctcacctctgaagacaaggagaacatcatcagcacatagaccaatcccagcagtgcaccttaggatggggagggccactgtgagttacagcaaaatgaacgaatgaatgaaccaataaatgtctgagagggaaagtcccaacgaccctcaggaggtacaatcaagagttgcagttattttcgttaggaacgttctaaacacaggggaaaccttccttccttctgctctattgttggagtggggccatcccgggacaccagaaatcaaggaattgagtttggagaagggacttggggaggtcacagtggcaggtgactgccaaatgaggtggcagaagccagcaagcgctggaaaaagtcggcccaaactgttcaccagcaccgccccccataactccccaccggctctggtttcaagactttccgttttctaggtatttccttggccttaaaccattttcctttaaacgaactttttctgtgaagccatccggtttcccccgatagtggcatctcacaaaggacaatccagtatcccaacagcgtgttgcgttccgcgggacgcagatttccttcacaggcaccccccgggttgcgtttttatagccacacccacccgcccccctatctcctgggcactgctaatgagtcctgcatttctctcctttggtctttggataaatgaaccatccgtgcgtgacctttgcgagggcatcttgcataataccagtacaccagcggcgccgtcggtgagtgacctttgggactggtttctctcaccagcgtaactccccgggagatccgagcaagctgatgagtgtatcagtggctcattctttctgttgcaccacggaccctcattctgtaaccgggataccagccagagatggggagcgggaggcgcagggcaggggcgtccctcctctcagcacagcctccccgcgctggatttctatcaatccagtttccacctgcctggaagtcagcagggtcctccccagtcccagatcgccgggcgaggccccagatggacctcaggggcggggagtgggcggagcttaggggccgaggcgaggtgtgggtggggcgggacgccgctgtggaggcggggcctgggcgcggacgggcgcggagcgaggcaccgcaccgccggggcggggagtgggcggggctcgggggcggggcggggtgtgggcggggctcacgggcggggcgggtgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaaggtgagtgatcccctgtcggggaccgggggacttgggaaggacagttcccggactggacggccagaacgctctcagggatttcagctggccggccatatggccctgtgggtcgtcgcgcccgggccagggaccattctgtacataggatcgtgcttggctctcacggaacgcgcccacacgcagggtcccggtgtcgaatcgtctggtggaatctgccctcaaccctatggagcgggtgctggtatcatagtcatattacaagtaggaatcagcgggcccaaggtcagtctgtaaagggggtaccggggtttaggcccgtgcgctgcccagcgctgccctgaaggcgcggctgaaccactggtttgcgctgcctttgtcaaggacattgtggcactgtggaaaaaatgaaaaatcagcttctctaacctataatctctctgggaaaaaaaaaaatcagcttttttttttttccccgagacggagtctcactctgtcgcccaggctggagtgcagtggcacgatttcggctcactgcaacctccgcctcccgggttcaagcaattctcctgcctcagcctcccgagtacctgggattataggggcgtgccaccacgcctggctaattttttgtatgtttagtagagacgggtttcatgttggtcaggctggtctcaaactcctgacctcgtgatccgcccgcctgggcctcccaaagtgctgggattgcaggcgtgagccactgctcccggccctctttttcttttttcttttttttttagaagagtctcactctgttgcccaggctggagtgcagtggggcaatctcagctcactgcaacctctgccttccaggttcaagcgattctcccccctcagccccttgagtagctgggattacaggcgcctgccaccatgcccggctaatttttgtatttttagtacaggtgggagtttcaccatattggccaggctggtcttgaactcattcttcttcctttctttttcttttttttttttttttgagatggagtttcactcttattgcccaagctggagtgcaatggcacaatctcagctcactgcaacctctgcctcccgggttcaagctattctcctgcctcagtctcccgagtagctgggattacaggtgcgtgccactacacccagctaatttttggtatttttagtagaaatggagtttcaccatattagtcaggctggtctcaaactcctgacctcaggtgatccgcctgcctcggcctcccagagtgctgggattaatgaaccactgcgcccggccaaaaatcagcttctttaacctttaatctctgaaaaaataaatcagtttaacctttaatctccgaagatcacagccaaagaaatacatgaaaaggaacaagtattaaataatatatacttctagctgtgctgtttatagttttgggaaaaaaatggaaataacctaaggtcccagaaataggaaaatgggcacaaaagggtatgcaggcaatggtttagctgccgcatgaatacacactgaatacactgtgagatgttgtctgttagaatgcccagcacggggactgtccacatggaaagaggcacaggaaaaaaagtgaaaacattataaaataacttcttaaaattaaataatgtacacgtcaaaaatatcagagcccacttgacctggtatatacagtttaataaccacatggctcttttttcctgtaggcctgggtaggtgcatagtttctaaaaagggagagaactgtcactgctgtggatggggtgccaagggaagtgcctggggtcaagtgaacagtgacacaactgcaagtcaagagcctgtgttggagtctttccccactatttcaaatagtatagaaaatagagctgagtcactcaaatagagctgagttagtcactcagctcttggacctcagattcttattcttaaccgctagggggatggagacagaagtcacaaactcacatgccaccagccatatgatgtaaacatgtaaactgggccaaggaatacaaaagggagtggtgagctggggacactgaagaatggatgccctg

SEQ ID NO: 56 - DNA, 1366 bp, Homo sapiens
atttaactgaatggtatgtaacaggtgtagtttctaatgagttcttttcttcccctgtggctttagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctggggatacttttttctttctgttttttgtttgtttttaattttagctttaaggagcacatggccagtactgtttcaggggaatattgggtggcgctggggtttgggcttctattgatcccatcacccaaacagtgagcatagttcccaatagatagtttttcaacacttcctttcctcccttccttcccgcttttggattcccagcatctattgatcccgtcttttcacccctgtgtacccaatgtttagttcccacttataagttagaacatggggaatttggttttgtttctgtgttgattcacttaggataatgacctccagctgcatccacgttactgcaaaggacaggatttcatgtttttttatggctgcatagtattccatggcgtccgtgtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcactcactgagattttcttttctttctttcttttcttttctttcttttttaaagagacagagtttcactatgttgcccgggctggtctcaaaccccttgcctcaagtaatcttcccaccttgggcctcccaaagtgctgggattgcaggtgtgagccaccacacctggcccagattttctttaatatttgtctaatatctttccatctccctatattcaagcttcatgtaattttattttctggtaattctctgagcatagagctggatttgctagtttttttattttatgactcaacatgacagtttctatttttcatagaaaag

SEQ ID NO: 57 - DNA, 7227 bp, Homo sapiens
tgggttcatgactttaagaattatttgaagcaaaatttgtaaaaacaagagggttttgcctccaatttatttacttatttattttattttcatcttttattttaaattcagggatacatgagcaggatatgcaggtttgttaacacaggtaaacttgtgccacggtggcctgctgcacagatcatcccatcactaaggtattaaacccagcatcaattagctattcttcctgatcctcttcctcctcccaccacctgccctctgacagaccccagtgtgtgttgttccctgccttgtgtccatgtgttctcatcacttagctcccacttacaagcaagaacacgtggtattttgttttctgttcccgtgttaggttgctaaggataatggcctccagctccatccatatccctgcaaaggacaaatgagataattctcattcctttttatggctgcatagtattccattgtatctatgtaccacattttctgtatccagtctatcattgatggacatttaagtttatttcatgtctttgctattgtgaatagtgctgcaatgaacgtatgcgtgcatgtgtctttaaaacagaatggtttctattcctttggttgtatacccagtaatgggattgctgggtcgaatggtatttctgcctctaggtctttgaggaatcgccacactgtcttccacaatgattgaactaatttacactcctaccaatagtgtaaaagcattccttttgctccacaaccttaccagcatctgttgctttttgactttttttttttttttttttgagatggagtctcactctgtcgtgcagtggcgtgatctcggctcactgcaagctctgcctcccgggttcacaccattcttctgcctcagcctcccgagtagctgggactacaggtgtccgccaccgcgccttttttgactttttaataatagccattctgactggtatgagatgatatctcattatggttttgatttgcatttctctaatgatcagtgatgttaagctttttttcatatgtctgttggctgcgtgtatgtcttcttttgagaggcatctgttcatgttctttgcccactttttaatggggttgttttttcttgtaaatttaagatccttatagatgctggatattagacgtttgtcagatgcatagattgcaaaatttttctctcattctgtagcttgattaccctgatgatagtttcttttgctgtgcagaagctctttagtttaattatatcccatttgtcaatttttgcttttgttgcaatggcttttggcatcttcatcatgaaatcttcacctgtgcctttgtcctgaatggtattgcctaaattttcttccagggtttttatggttgtgagctttacatttaagtctttattccatcttgagttgatttttgtatatggcttaaggaaggggcctagtttcagtttttctgcatatggctagccaattctcccagcatcatttattaaacagaatattcttcccccactgcttgttttttgaggtttgtcaaagatgagatggttgtaggtgtgcagtcttatttatgccttctctttctgttccattggtctatgtgtctgttcttgtaccagtaccatgctgtttggttatgctgtttggttactgtagccctgcggtataaagttgggtcacatgatgcctctagcttttctctttttgcttaggattgccttggctattcgggctcttgtttggttttatatgaagtttgaaatagtttttactaattctgtgaagaatcttaatggtagtttaaggggaatagcaatgaatctataaattgctttagatagtatggccattttcatgatactgattcttcctatccatgagcatggaatatttttccatttgtttgtgtcatctctgatttctttgagcagtggtttgaagttctccttaaggagaactgttcacttcccttgttagctgtattcacaggtattttactcttcttgtggcaattgtgaatgggagttcatttgcgagttggctcttggcttgtctattgttagtgtatggaaatgctagagatttttgcacattgattttgtatcctgagattttgctgaagttgcttatcagcttaagaagcttttgggctgaaacaatagggttttcaagctataggatcatttcatctgcaaacaaagatagtttgacttcctctcctcctagttaaatatgctttatttccatctcttgcctaattgccctggccagaacttccaatactatgttgaatgggagtggtgacaaagggcatccttgtcttgtgacagttttcaaggggagtgcttctggcttttgcccattcaatagaatattggctatgagtttgtcatatatagcttttattattttgaggtatatttcttcaataatttattgagtttttaatttgaatgtatgttgaatttatcaaagggcttttctgcatctgttgagataatcatgtggttttggtctttagttctgtttgtgtagtgaatcacatttactgatttgcatacattaaaccaaccttgcattccagggacgaagactacttgatcatgctggataaactttttgatgtgctgctgtattcagtttgccagcattttgttgagaacttttgcattggtgttcatcaataatattgacccgaatttgtcttattgtcaggttttagtatcaggatgatgctgacctcataaaatgagatagggaggagtccttcctttttaattcttggaatagtttcagtaggaatagtaccagctcttccttgtaactctggtagaattcagctgtgaattcacctggtcctgggctttctttggttggtaggctacttattactgccccattttcagaactcattattaatctattcagggattcaattcttcctcgttcagtcttgggagggtgcatgtgtccaggaatttatccatttctcccaaattttctactttatgtgcaagaggtgtttataatattccctgagggttgtttgtgtttctctggggtcagtggtaatatcccccttgttgtttctgattgtgtttatttcaatcttctctttcttctttattaatctagctagcagtctatttaattagtttttttttcaaaaaaatcctagatttgttgattttttgaaggcttttcatgtctctatgtccttcagttcagctcagatcttggttatttcttgtcttctgctagctttgaggtttgtttgctctaggttctctagttcttttagttgtaatgttagattgttaacttgagatctttctagcttttagatgtgggcatttagtgctataaatttctgtcttaatgctgctttagctgtgtcccagatattctggtatggtgtatctttgttctcatgagtttcaaataactctttgatttctgccttaatttcattatttactcaagagtcattcaggaggagaaggttgttcatttccatggtgttgtgtggttttgaatagatttttttttttttttggagacagagtctcatcactctgtcacccaggctggagtgcaggggtgtgatatcagctcagtgcagcctcctggattcaaatggattcccttgcctcaggctcctgagtagctgggattacaggtgtcttccaccatacctggctaatatttgtatttttagtaaagacagggtttcaccgtgttgcccaggatggttttgaactcctgaactcaggcaatccacccacctcagcctcccaaagtgctgggatgacagctgtgagccactgtgcctggccttgaatagatttcttaatcttaagttctaatttgattgtgctgtgctatgagagactgttattatttcagttcttctgcatttgctgagagtgatttacttccaattatatgatcaattttaaagtaagtgctgtgtggtgatgagaacaaggtatatgcctttgttttttggtggagaggtctatagatatctatcaggcccactttatccagagttgagttctggtcctgaatatttttgttaattttgtgtctaaattatctgtctaatattgtcagtggggtgttaaagtctcacactattattgtgtgggaatctaagtctcttagaaggtctctaagaacttgctttatgaatctgggtgctacagtattgggtgcatatatatttaggatagttagctcttcttgttgaattgaaccctttaccattatgtaatgcccttctctgtcttatttgatttttgttggtttaaagtccattttgtcagaaactaggattgcaacccctgctttttttctgttttccatttgcttggtaaatttttcttcattcctttattttgaacctatgtgtgtctttgcatgtgagataggactcttgaagacagcacactgatgggtcttggttctttatccagctttaaaagactctatgtcttttaattggggcatttagcccatttatatttaatgctagtattgatattgtgtgtatttgatcctgtcatcatgatgctagctagttattttgcagacttgtttatgtggttgctccatagtgtcactggtctgtgtatttcagtgtgtttttgtagtgactggtaacagctttttgttttcatatttagggcttccttcagttcttgtaaggcagatctggtggtgccaaattccctcagcatttgcttatctgaaaaggatcttatttcactttcagttatgaagcttagtttgtccagataagaaattctaggttgggggccaggtgcagtggctcgtgcctgtaattccagcactttgggaggctgaggcaagtggatcacttgaggctagaagttcaagaccagcctggccaacatggcaaaacctcgtctctactaaaaatacaaaaattagccaggcatggtgatgcatacctgtaatcccagctacttgggaggctgaggcacaagaattgcttgaacccaggagacagagttgcagtgaaccgagatcacaccactgtactccagcctggggtacagaggaagactccatctcaaaaaaaataagaaagaaagaaaaagaaattatgtgttggaatgtcttttctttaagaatgttgaatatctacccccaatctcttttggcttacagtgcttccattaagaggtctgctgtttgtctgatgggcttccttttgtaggtcacctagcctttctctggttgcctttaacatttttgcctccattttgaccttggagaatttgatgagtatgtgtctacggaatgatcttctcatggagtaccttactggggttctccgcatttcctgaatttgaatgttggcttgcatagctaggttggggaagttttcctggacgatatcctaaaatatgttttccaaattggtttcattctccctgtctcaaagcaagagttttatacaaattggtttatatctgttccaacctatagcacactcaaccaatattcagctattaaacctgattgtacaaaacaataaaattggttgaactaatgctttctctcatccacagagtactcacacatacacataaaagtatgatagtaggtgcttttagatgtatttctcagctaaaatatgacaagtacatgaagttttaattatacccctttcagaagaaattttccctttcaattgccctaccaactccaaatgtaccaacaaatttcccatgaatcacagacagactattataaccacttgagaacaggaacacagctgatgttctcacttttattttctcaggacctagaagaataatatttaacccataatagatggtcaaaattaacaccacacacacacacacaagcacacgtgtgtacacacacataaattccaatagttatctaaggaaaagtatagaatgaagacaataacagaaacattagtcttatttcttttggtgccacactcttcactttgaaattccctggattcatctctccattttttcttctttctttctttctttcctttcccataatgtgacaaattttgaggtggtaggaatttaaacatgagtaagtcatgtttcccaccatcagatgaaaacaggtatatatacaaataaataatgtgatatacttgaaatgatgacatactttttaattacatggaggttgactctgtttttattcccagctgcttcaaactggagtctatcaatgtgtctattataagaaaattctgctaaaataaaataagcacatgccatatagagatttttataaaggcattctccttgtatcacaataataaatatttcagctagttacatgagcaaaagaattcaccctaacgtaccctccagagcagatcatctgcaggtctaaactgacaaatcctcagctacaatgacacttgcagaggatttctctcttttgaggagtggaaagctggcatctatgtgccacattctctagaattaacatcctttccataaaattactcaagatatttcagagcaatcactcagaaatagttatttatacaacttacttaataatataagtgatggaccacctctaatttaagtgtgttccagtgctttccaccgtgtcctgccttggctacagatattccaccctatcctgtcagtgaccaatctatcctacttgagagaatcagcactggcatatggagggaaccatctggaatttctgttgctcaatgggtggctgatgggggagctgatctggaaagaggctccaaaaagaattaatgagttccagatgtaattaaagactgcttttccccccaaaggggctcaggactagccatggggtggtgcctcttggttccgaattacaccctttaaccacttgttcatccatcaagcactaaacaccaccatctttatcctagtgtgttttgccaagcagtgttttggctttttggtctttttttcctgaaagtgttctatttttacaattagaacactaaagctttaaaaataatatctggaaagttaacaataaggagaaacccctgaatttatccctgcaccaaatgcaacaacaacaacaacaaaaaagactcagtgttttattagaaatgcattaactagcctcaagaccagaaaacctgagccagactgaaagacagatgtctctgaaagagggctgg

SEQ ID NO: 58 - DNA, 17162 bp, Homo sapiens
tcctttcattctcctctgcattgctaatattctcttcctaggaaaattaacctcactcattcattctctctctgtctttctccctctctctctcctcctcctctccccccaacacatagtcacccacacatacagtcacccacctgacctgcctcccacacacacttagaatacacagagtgtagagcttagaaaagagctgactccagtgcctagagaacaaagtccaaattcaaataagtatctaatcctctaccctacaagtggtctcccagcctcatccctcgcttctccccataattctgctggatcatgtgccatcctcaagctataccaaaagccacagtgtcccctaacataccctgacttgtatgcacgtgttttttctctcctgagcagtccagttgttttccaaggactgtctccatttaaaatctctccagaatgatcttcttggaccctggagaagctatcttctctcagtgctgccctgcgctcagtgcccactgcttttgtgctccatatttacatcaatgtttcaccttgctagagtgtgagttttaaggacaaggactatatggtagtcacatgtatattacaagtcactagcacctctcctggtacataatgagcacttgccaaattaattagaccaaattcatgaattagacccatttattacccgtatgtaacaagcaacaaacaaatgggggatgtcagtgacaccaaaatgctttctcttgcctgaaagtttataatttctttgcactctgttaaaactatttcgtggtttttttcaaatattatagaaaatattcatcaaggtataactcaaactcctgccaccatgtctgccagcagaatgtcagtagacctgcttcaataaattgatagcacttatttataatttgcagcccccatttgcatgcaaataatgtgctacagttcataaagttgatttttctcttaagttaaatattctacctacaatgttgttcatgtatcaattaatgaagttttactatattcaacccataaacatttattgagccaggtactgtgctagacccttaggataaaatgacaaataacataattccctgctctcaagaagctcactgttgaaaaaaaccaacacacaagccaagcattacaatgagacaggcttgtttcttttcttacaagggcaaaatgtggacgtttacaagagaaggtagagaaaatgaaagctaaaaggtagcagttgtaggaatacttatcagactatgatcttacttgcagaaatatctcattacttggcttttaaaagcaatcatgcaaacttttgatactctgaacagtacagactactcaacatgatccctattataaccctttatctgtgagccaaatatcattgaaatctatgaacaataacaatacagtccacttgaagaaagtaactagattcctttaaatatcaagatggtagaatgtttacaattaacagcctttagtagcatagcaatatttgtccaaatcagtcagctttttaaaatgtctaaataaactgttggaggaaaaaataaaaagttaagttcctatattttggtcaaaaatgggaaaaagctacagcgtttataacctatttggaacacatgcctgcctctaaaaaggaatcactataaaccctcacaagaaacctctgacacaagatcccctgataaacactcaacctgcatgctcttcccactacactctacctctactccgattgcacagagtcttgcaaaaacctctgtgcaacccaagctcaaattcttcaaaggcactgcggtacagagcccttttagagaggctccaaagctcaagctctccctctccctctccctctccctctccctctccctctccctctccctctccctctccctccacggtctccctctgatgccgagccaaggctggacggtgctgctgccatctcggctcactgcagcctccctgcctgattctcctgcctcagcctgctacgcctcactggttttcgttttttttttggtggagacggggttttgctgtgttggccgggctggtctccagctcctagccgcgagtgatccgccagcctcggcctcccggggtgccgggattgcggacggagtctcgttcactcagtgctcagtgggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggctgccatcccatctaggaagcgaggagcgcctcttccccgctgccttcccatctaggaagtgaggagcgtctctgcccggccgcccatcgtctgagatgtggggagcacctctgccccgccgccctgtctgggatgtgaggagcgcctctgctggccgcaaccccgtctgggaggtgaggagcgtctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggaggtgggggggtcagccccccgcccggccagccgccccatccgggaggtgaggggcgcttctgcccagccgcccctactgggaagtgaggagcccctctgcccggccacgaccccgtctgggaggtgtgcccagcggctcactggggatgggccatgatgacaatggcggttttgtggaatagaaaggcgggaagggtggggaaaaaattgagaaatcagatggttgccgggtttgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgtcaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaataataataataaataaaaaataaaaaaataaaaaaataaaaataaaataaaataaaataaaataaaataaaataaaaaaaagagaggctccaaagtatccacatcttaaccacatcggacgcctttgcccagcctccctgaggctcccacaacacattctgaaatctcagacattgcttaagcagggcccaggaagcctttgcaagacaaaggaaggaaacacagtgaagtgtaccgttaacaaaacccaaaatcaaaaggaagtccaagtcgttgtcaaatttgtaattggtagctccattattaattaatttgtcagagaatttaacacagcaggactatccacagtcataactgcacaagtaaattgagactaggttaaacaaaatttttttaaatttaattttctacgtacctacagaggtgagaactgcctagactacaaaaaataagggggcttgcttgtattgatattttaatctgaaacatcattattgtgtaaacggaatctccttttacattagttttcagagacaagactggaaacagcatatgagcacataatcatatcacagtgtgtttctctctcaaaagccgaaccttctgccttaacactttcacagactcctccaggcctgcttcaaacagacaaaacactcctcctaaaactcaaagaaacatcgcaacacctttgtaataggcctatttcccaagagggggcagataaaaggacaaagcaaattaagggaaatgcggaatataaacttgaaacctactgtcaataaaacccaaaacaaactcgaagcggaggtgaagaaagcagggggaggaaaagcaatgttaaatggtcatctttcttctcattttatttgaggaagttaagtttgcacagctccttacaagctgtctttggctaaaatcactattaatgagctttgacgtttgaaatttaactgagcacaagctaacagcttccagcactgcaccacccatgaagtcaactggaaatattttgctagggcctaacggtgtgtttattgaaaaggcacagctttcaagagaaagtgtttatagcaaccactttacctgctatccctgctctgtgatgtctgtttggttttagggtttggggggtcctctttaactctttctagtcacactgttctaattgttttcaagtctagcaggagaatgttaatgaagttctttgctctacagcaacctggattataaggacagatttgaaaactctgagttatgacaaaggggcaggccacaaggcaaaaagaaaaaagcccatagagaggcttcagctctagcattcgctcattagaaagacaagataaaaacacgtattctttatgggtaatgccattaaaattatcctttcccaaaagagaacacagtgactagatcaataaacctgaaagattgcatggattcttcttagctaaaatcctggttcattgaatgaaagtgaattcattattaaccaagtagtttccccaagagaaaggcatggaaggaagctattcactttactcctcaacaaagaaggctttaggcattctgacttgtttaagaagtaaaatgaaaaagagggattgagtctgaaagaaaagcatactcacacataccctgctcttgcacaaaatttacatgttgtcagtttctacctctaaaatttattaaaacaaagagggagcattattttgaatctcatgccacagtcctaagaacaatggtctgtgttcagtgatcctgtacagattcttgaccttgaacacacctggatgccaatatcagtatgaaattcagaactgctcccctttccctgaagccagtgttacactggagaatgtaggagtatcctttgcctgaggcattcctggaccaagtaaaagtaaaagcagaaattataacctaatctggaatgcctctaaggaatggagaggaaatctcagttacaaagaaaaggaagttcagaatctgcgaactagaaataacataatttcaaggtttttattcaccaaattaacgttgggttacccctacaataccaaggagaaaacgtccaaggatggtgctaaatcaatgaagacaattcagacattacaactagagaaaaaataaggagaaagcaagaaagttggattctttgtccaaagatatttttgtcattactagatatttttccatagaaaaaaaaaacaattactagatcatcaattattttaaaattaaaatgaaatcttcatatgttccttttttaatggaaatgtgtaaactggtacaactatattattttgcaatatgcatgatctgtgaaaaaaattagaaaaaaactacatacaattgaaggctatctctgagtttcatatactttctcaaaatatgtggaaagataaatgtggaagatgtctgttgcagtattgtttgtagaaatcaacttcttgaaatatttattgcaaaacaattaacacatgtttattgattctttattttggcctactttgtaagaaaaatccaatagtgaataaacaatagtttctgggtttatggaacattgtttaagaaatatacaacaacgaaaaatttaagaggaatgaatgttataaaaaagaaagcaggccgagcgcggtggctcatgcctgtaatcccagcactttagaaggctgaggcgggcggatcacttgaggccaggagttcgagacccacctggccaacgtggcaaaaccctgtctgtactaaaaatgcaaaaattagccaggcatggtggcagatgcctgtaatcccagctactcgggaggctgaggcaggagaatcgcttgaacccaggaggtggaggttgcagtgagccgagatcgtggcactgcactccagcctgggcaacagagtgagaatccatctcaaaaaaataataataataaagcatatgctaccctaaatgataagacacagggatatcttttaaaatagaaaggtttcttttttactgatacataataattatacatatttaagggatacatgtgatattttgatactacattctcacatgctatatgagttatttatttctagaagttatacaatggaaagtaatttttaaaataatttatgtaaccatttgtgaataagaatatatttgtgatagttattaattcacaaatggtaccggtcatattaacaacttatttataatcagcatatttccagttagcaaagtgagaatgtaaggtaaaaacgtaatgggattaataggaataattttgctatggggatctgtgtagttataatgatttcaagttaaaaaaacagaaatgtaagtaatatatagcatttgtctctaatattatagaaatgccatattcagacctgtcgtggagagggacatagctgttctcttcacaatctcagtcatgaatatgactaatgagaaatgaaggggagaggtggggaatttatcacaatatccacacaccaaacctcatgtacttcttcaagatgtgtctttcaagactgcactcagaatcgtatatatctattaaaattttgttatcttgtcagttgctgaagaaaacaaaaggatcaattagaaggaagtaggggctactgacagcatccagatgtgagacttgcagtctgacagcaaaggaagggacgaaatacatcaatacagtcatgggccatttagcaatttcaatagcaccacctgggatagagttattatttttttaaaaagtgaaacaactgaagtttgtgctgatgatccagaggtatcaacaaaatatttgatactaccacctatgttcaagtaaaaggacagaaaagccttcgcaatgttttagaagttaatatcaaaaataaacatggcttggtattttgacggaaatgtttcagttgcctagcaaattaactcctgtggtatttctcattccccaagcaaaatagaaaagtgagatattaggaaactttaaaactggaaaaatatatgacaccgccaggagttttgtccagaaatgaaatttggaaatggcctttatccaacaaatagcgtggcagcatttgctaaaccccaggcacagcagtaggtgctcagactacctctggcacacacataatctagcaggaaacaagtataatagccgatactaggtagagcacataaatagcatggctttaaagaaagcgtgggtacagacgtgtagaaatgctaggtgtggttgattaatgccgattgtgactactattaggtacacaggatatgaggacatcaagatagaacaccaaccagcaaggctgagagagccctccagggttgagggcacagcagaatctcagagtccagttgttttctcactcacttcaatacccccattttggtagcacattaaataaattgatctggatttggaaaatagcaaactgaaaaccagaacaacaattaaaatattcaaagctgaaggtatgaggctgggagaaatgataataataacaagaataataatgataaacactgaatgagcatttattagatgtaggacactgcataaaaaccttcacttctataccctgtttgaacttcacaatgaccttccaagagtctaccttattagccctatttatgatgagaaaactgagaaatgcagagggaaagtaacatgaccaaaaacaaaacgctggaaagtggtggaaccaaggctttgagaatctgttttcagactttagcagcccatgcccttaagcaatattaaaaacttgtctcaaaaataataaaagtttcataaatctgaaatgatgaggaaaatatagcctcagaaacagaaaggttaaatcagactgaatctccagtcaaaaggtgagcccaatcagttttgtcctctcacaggaaagaagttctttttctaagaccttttttttttttttctgaaactgaaactgtgaacttttggtattctctgattctccagaagaccctcaagtccctaagccctagcaattgttttattttactagttgaataaaatgggctctggaggcagtaacacaaattcaaatcctaactctaccacatagtcactctgtgacctttggtagtcacctaatttccctgaagctcaatctcttatcttaaaatggagattttttgagggctcttaatgagttaattagtatacataaaggctaactcagtgcctgacatataacaggtgtttggtaagtatcattgttcacttcttgcctttctcaacttttccttaaactaaaacaaggaaaagatagatttcttaagatttagttgttgcatcaccatttatggaaaaacaaagagaaatgaaaacaaaatcaactttccttggtgatgaaaacgccctatgtcttcaatttgattctgggcttcacagtatatacatatattaataagctatacacttaagatctgtacatttcattataggtaatttatgcctcaatatataagacaaattcttgacaaaataaatttttattttaaatataatatctcaaacataataattaattctattggcaaaccaaattatccagcatatattttatgtcgccaattagaaacttaaaagtacaaaaaacacatactacatatttttcatctagccctaatatttcattcccccaccttgctcccactttaaacaatcctaaggaaatttccaacagccactgttttatttctgtactctgcaagtagcacgttccagttttctatgcgagccttttggccacattacagccaactaccaccaccatatgccactggagtccacattgataaaagatctaagagttgaatggcactttcatacttagagagggctttacacctgtagatccatttaaaactcaaaaaccttgcaggaagatatggttaagcactatcaccatcattgaggggaaatgatggctctgagaaattaagtcaaggacccaggaccttggcgttgttagggactaggacccaagtcttccagcatcaagactcacagcttttccattactcttatacctttgacagaggaagagatgacaagacaagtcctccaacttgtgccaactaacgatgagcctgcacagcactagctatagaaaatcaacaacataaggccaggggctcacattgttaaagtctgtggctttagaaaaggatgaaatctgcctaaaaaatatttctctactcttcccagagttgcttttggaagcgatatctttatatccaatacgatccttctcaaaggtgagtattcatgctgcgaatccactccagtctccagggcctttgccctggtactgacattttaccttctacaaaaacttcatgagagaaaggaaaaaaaacaaaaactagatttttccaggtcaaataaaaagaaaaaacttatactaattaaagccatactcttttagacaaaaacactatttcagttctcccttctttgctttttctgctgcaaaacatgtttcaaggctaaaaaggagccaattaaagtttctattatcatgaaatacaattctgttggtgcagtgatactgagcaaaagcaattttattcctgcctttccaaaaatacgtataggtacatgtgaaaacaactatgcatgcaggcacacctgcaggggtgtctctatgtgcacgtgtatgtgtgtagaaaggaagaccagagagttatcacagaattgaacctgcacaattcaccacaaataaattaataatggcatattatgaagatatattttcccattatctagaggaactttgttttgcctgtttttgttattatttttcactcgagtcatcattatcctacagagaggaaggctaacaaaggcctttgatttcaccacttctagagatttaaacaaaagacttaacaatcccaattagaccattaaaatacctcaagagaaaaacaaagaatatacagctatatctgctgaactcccagtaataactcaaggtctgtcttaattttttttaaaccagaggaaatgaagggatagggggagggaggaaacaagggagaaaaggaaggaaggaaggagggaggaaggaaggaaggaaggaaggaaggaaggaaagaaggaaggaagaaaggaaggaaagaaggaaggaaggaaggaaggaagggagagatacagcaatttcactattccacccatgcacctagcagctgcgtttattgttatttatttatttcctcccttttgagctagatcctttttttctcatttagtccaacagagattgtcctcctggtgtgaccttttattcttcccttttccttcacccctccaggctattgccctcatgccagtaactagataacacactctatcaaagatttttttaaaaaatcattgggaaggcactagggctgatagtggcatcaatcgtagcctgacacgagctggggtcaaccatttatctctttacatagcctgtggttactgcagtggccatcttgacttgctacatcttaacaaccttgtgcagatgttgcctctcccaacactgataatatctgctcccccagtccttttgctttccttgtttggcatatttctttgttttattctggtggacatcttttcataataaatcagggcaagaataagtgaagcccctcccgtgtttcagagcccttccatatttcagggcaagggagataattatgggctatacaaagaatcttgctctttgtaccaatattttcaaactaaaatcaaaacacttttgttccttagtaaatagtcatatccttgaagttaaagtgaattcatgtagcattgctcttatttcactggatatgagattttatcaaaagttttttatgaactcatttattttccattctatcccactcttttcccatctctctctctctctctacccccaaaataccattcactagcttttttttttgtaacttattcagcaggcagcatcatgattaagagaaagttgaaagttaggcagactacatttcaaactcatagctccaacattattagccacagggcctagggcaagtctcctaacattttgaagcatccgtttccttatctgcaaaatggagctaatactatctactcagagtgctatgaaaataagtagaaaaaatacttaaatgccatgtgtctgtcacatataaatgttcaatgtatttgagttgccacttactgtcttaaagttaatgaagagttagttgctcagacaatggaatctggtgccaagcatcatggacaaccctatatacaaaactcatctttactgccactttttctaccactgtaacttcacttatttgggtctccaagaaatctgtttaaaaatggaaatacacttgggaagttttagaccttataaacataaactttaaataagactggaatggaagatagaaacaaaagaaagagaaaataaaagagactcaaaggaaaacttggtttatgtgtattgtgctctaatttttaatacaaaccctagatgcctcacgccttctagaaattcaaataaatgtaaaatatagccactatgagagatacccaagttaaaactcaccttcacccttaaaattcccattagcagattcttcttttcaaaggataacctacataacatagtcctcacttaaaaaaataaaagtaaataagctgatagctgttgaaggtagacaatgggtacacagggctcattatgctattctctctattgtcacatatttaaaattgattattttaaaagttaaataaaataggccccaataaatacattgccttaaataggctaattgtgatgtatttccagttgtgccaaagcccagtaaagaatagggtcaatatcccctgatgctgaaagggattgtttcttaagacttcacagagaaatcttaaattgtactttaatgatggactttatggataaatatatagtcatagaaataaatatatcactccaagcattgccaatgttaatcttatgaccattccagatttattcactcaacatacagatagcatttttaaattatttcatcatattcctatacttctacacccaatgcctgtagatactgaaattaggagttactatctctaaactctccagcttgaagattatggggcaagagtgccaaagagcacaggctctggaatcattatgtctcaatttgagtccctgctctgccactttccagctgtgggtcctgagacaagcttctaagcatttctgaatggttatcaacctgtaaaattgagatgataatagtcatcactttaaagtttcattctgaggattaaatgggcagttcaagtaaagggtttcacacagttcctgacaagaagcaagcattcaattaatgttaccccttcccattattattagtagtagtagtagttctttacaataaaatacagaaatatgcttctctaggtggcatcatagcaagtattgaataccctaatatgtttttctttccatttttctcaatcttcccaaaacagcgattacatacttggttgtttcattttaatgtttgaaaagtatcaatttatccaagtgaagttatgaattctgtgagcagaagagatgaggcaaagaaatcaagaatcactccctgattcagtggtgcctggatttgaaagggtgcagtatgaagatgagtttaaacgctggcatggctctcccaatttccacacaatttccttgtggagaagccaccagtacagggaaattttagaacaattttaccaagagaaaagaacccagacccctgctttcttagtctcccctcaggcgtgggcactgaaggcttcaatgagaggctggaagactctaactgtggcccaaatttcatgccacatggcagagcaaggcttttttccaggagcagtgcattgttaacttatcagacacattaataaattcctatctcaaatgtgcagaaaactcacacaaaaagagaagcaagcttgtcttctttctgctccattccagctctgggttaagaaggtactaccttcagtattgctggtacaagggtcctggttcaaaccttcagtccctgcccccattaaaatgtaaaactagattcaaccatcacggagtggcaccagaggattgcaatttcatccagcatgatttttattagccttgcaatttcttaatgggctcccctgagggctggctggtagaatcctgcactaccagtccggatttgctacaggcagcttaataaacatggtatcttccccgtgacaattgtcataacatctgaccagggtgcagaaggcagagctaaaggttaacaaaaccactgctcaggtggcagggaggtgagtggggagaatgttggaaattgtaatctgaaggcaaaggctgcctgctgggttggtgattcttccagcctggccagagctcccaggagccgagcaggcagcttgctgccttctataatcagcatcttttacacatctcatcagtgtcactgttcctgacgtctcattatgcaccagaggtggaagtggacaggtaccgaacacttgaacttttacttttcttattatttccatggagcaccatgaagctgggagttaattaagtcccgtgggacaggcaatcagtgtcttttttgctaagttaaattacattatacacagatgcaaaaaagaggagaaaaaataatccctcagctgtttcctagttaatagagtaagttagaaatatgatgatgccaaactggaagctgaagttgatagctccttagcatacgaggtgtctaatgaagtcatatgacaaatccaccagggatctccttccttaaaggatctcaaagcacttttacaaacacttttaaagaacttcctgcctcaactctgacaaagttaattgggggatgatagtcaattcgatagtttagggaggaaattgtactcagccagactggagaagaaaacttccttggatgtataagatgttagactgaaaagaaaccttcagaggtaagacagaatcagacagtgtcaaagtggaaagggagctaaaaatgacctagcccaaaatttcccaaagtgttccacagagagccaataggtgttgtatggaagaaaaaaaaataagatttttatgaccaaataagcttaggaaagactggtttcaacagagtaaaactgccttccttcctgcaggactctccaagcttttaatgtctgactggacatcgatagaatcgagtctgcagcattcaccaaacttacttcactacagaacactttttttctttcttttttttttttttgagacacagtctcgctctttcgcccaggccggagtgcagtggcactatctcggctcactgcaagctccgcctcccgggttcacgccattctcctgcctcagcctcccgggtagctgggactacaggcgcctgccaccgcgcccagctaatttttttgtatttttaatagagacggggtttcaccgtgttagccaggatggtctcgatctcctgacctcatgatccgcccacctcggcctcccagagtcctggggttacaggcgtgagccaccacgcccagcccagaacacttttttttctaatgagacatgtttctttactaattgcttacagaattcacattggaacatgttgattttgtccagttacagatggggaaactaagaggttctttggttttgtttttttgggtttgttgttgttgttgtttgtttttttccttgagacagagtattactctgctgcccaggctggaatgcagtgcagtggcataatcatgactcactgcagtctccatctcctaggctgaggcgatcctcccacctcagactcccgagtagctaggaccacaggcacacgccactatgcccagctacttttttgcattatttgtagagatgaggtctccctatgttgcccaggctggtctcagactcctgggcacaagtgatccaactgcctcagcctcccaaagtactggaattacaggagtgagccatctcgcccagccatgaggttttccccagacgtgcctccaagcacacaggtaggtaacacccaagccttgaattaggacttagatcagccaatctcagaccactatatcataccacctccctctgtaacttaccaggaatctaaaacaccctacaagaatcaggtatgctctctggtcaccctgcgtttctttgtattactttcagaatactcatccttcatcctttttcacctgcagtcttaagacacctcatttccttatgttctcacccctcgtggaagcactgcctgtcatgtaatggcatctgagctccaagagaacagcagctacatgttttagaactcaccttacctgccatcaggccacagctcagcaagactagagttctgactctgatatgggatctaaggagcattttatgagacacagtggtggcaacaaaatttataaagcctctaacagctttattttcctcctgaattaaatctacactccttagtttggcactcaagattgtacatgatgttttccaacctttgtttctagtaactgccttcctggttactttctttcaaactttacactccagccaaataaaatcacttaaacgtaaaccatgttttcccatctctgggactctgtaagactagtctcttagctagtagacctttgttccttatcttcccttatccacatcctggtaatccttttaggccctaataaaatgccacactctctagggagtttccaggtaatttttccacccagaagatttctttgccttcactgattttccataacaaaatacacatatctttattatcacatgattatattttgcttatagcacagttagtgagtttttatatctcccctattaaatagtacattctacgaggtaggagttgtattttatttctctgtagacttaaagcaacctcccaaagtccaaagggatggactagttctaacattctagatattgaatgcataattttatctaggcccttcataacttcatagtttttggttgtctctcaaaacaatcatctgaaaatccctgggagggactcagacaatgcctgggaccctctgagtgatctgtaaatcatgtttcagaaggattaaagaacggcaatttttttttttttttgaaatggagtctcgctccgtcgcccagactggagtgcagtggtgcaatcctggctcactgcaagctccacctcctgggttcacaccattctcctgcctcagcctcccaagtagctgggactacaggcgcctgccacgacgcctggcttttttttttttttttttttcagtagagatggggtttcactgcattggccaggatagtctcgatctcctgacctcatgatcctcccgcctcagcctcccaaagtgctgggattacaggcatgagccaccgctcccagttgggaagtttaattaatgtttgtatagtatttggggagatgaattatgagaaaccgacactgtaacagactatttctttccctagattgctcttttctttattattagaggaaggttctcttgcatagaactgagtgatcagccatccccgttgggagctggtacatcataaaaatagctgctgtcattttgaaacaggaagacgcacatcacaaaagaaacacctaactgactttaaagtcctgcgggccactgaagatatgtgtgttttatgtagtcattatgctttctcatttggttgtttgtttgttaaa

SEQ ID NO: 59 - DNA, 12248 bp, Homo sapiens
cagactatgatcttacttgcagaaatatctcattacttggcttttaaaagcaatcatgcaaacttttgatactctgaacagtacagactactcaacatgatccctattataaccctttatctgtgagccaaatatcattgaaatctatgaacaataacaatacagtccacttgaagaaagtaactagattcctttaaatatcaagatggtagaatgtttacaattaacagcctttagtagcatagcaatatttgtccaaatcagtcagctttttaaaatgtctaaataaactgttggaggaaaaaataaaaagttaagttcctatattttggtcaaaaatgggaaaaagctacagcgtttataacctatttggaacacatgcctgcctctaaaaaggaatcactataaaccctcacaagaaacctctgacacaagatcccctgataaacactcaacctgcatgctcttcccactacactctacctctactccgattgcacagagtcttgcaaaaacctctgtgcaacccaagctcaaattcttcaaaggcactgcggtacagagcccttttagagaggctccaaagctcaagctctccctctccctctccctctccctctccctctccctctccctctccctctccctctccctccacggtctccctctgatgccgagccaaggctggacggtgctgctgccatctcggctcactgcagcctccctgcctgattctcctgcctcagcctgctacgcctcactggttttcgttttttttttggtggagacggggttttgctgtgttggccgggctggtctccagctcctagccgcgagtgatccgccagcctcggcctcccggggtgccgggattgcggacggagtctcgttcactcagtgctcagtgggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggctgccatcccatctaggaagcgaggagcgcctcttccccgctgccttcccatctaggaagtgaggagcgtctctgcccggccgcccatcgtctgagatgtggggagcacctctgccccgccgccctgtctgggatgtgaggagcgcctctgctggccgcaaccccgtctgggaggtgaggagcgtctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggaggtgggggggtcagccccccgcccggccagccgccccatccgggaggtgaggggcgcttctgcccagccgcccctactgggaagtgaggagcccctctgcccggccacgaccccgtctgggaggtgtgcccagcggctcactggggatgggccatgatgacaatggcggttttgtggaatagaaaggcgggaagggtggggaaaaaattgagaaatcagatggttgccgggtttgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgtcaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaataataataataaataaaaaataaaaaaataaaaaaataaaaataaaataaaataaaataaaataaaataaaataaaaaaaagagaggctccaaagtatccacatcttaaccacatcggacgcctttgcccagcctccctgaggctcccacaacacattctgaaatctcagacattgcttaagcagggcccaggaagcctttgcaagacaaaggaaggaaacacagtgaagtgtaccgttaacaaaacccaaaatcaaaaggaagtccaagtcgttgtcaaatttgtaattggtagctccattattaattaatttgtcagagaatttaacacagcaggactatccacagtcataactgcacaagtaaattgagactaggttaaacaaaatttttttaaatttaattttctacgtacctacagaggtgagaactgcctagactacaaaaaataagggggcttgcttgtattgatattttaatctgaaacatcattattgtgtaaacggaatctccttttacattagttttcagagacaagactggaaacagcatatgagcacataatcatatcacagtgtgtttctctctcaaaagccgaaccttctgccttaacactttcacagactcctccaggcctgcttcaaacagacaaaacactcctcctaaaactcaaagaaacatcgcaacacctttgtaataggcctatttcccaagagggggcagataaaaggacaaagcaaattaagggaaatgcggaatataaacttgaaacctactgtcaataaaacccaaaacaaactcgaagcggaggtgaagaaagcagggggaggaaaagcaatgttaaatggtcatctttcttctcattttatttgaggaagttaagtttgcacagctccttacaagctgtctttggctaaaatcactattaatgagctttgacgtttgaaatttaactgagcacaagctaacagcttccagcactgcaccacccatgaagtcaactggaaatattttgctagggcctaacggtgtgtttattgaaaaggcacagctttcaagagaaagtgtttatagcaaccactttacctgctatccctgctctgtgatgtctgtttggttttagggtttggggggtcctctttaactctttctagtcacactgttctaattgttttcaagtctagcaggagaatgttaatgaagttctttgctctacagcaacctggattataaggacagatttgaaaactctgagttatgacaaaggggcaggccacaaggcaaaaagaaaaaagcccatagagaggcttcagctctagcattcgctcattagaaagacaagataaaaacacgtattctttatgggtaatgccattaaaattatcctttcccaaaagagaacacagtgactagatcaataaacctgaaagattgcatggattcttcttagctaaaatcctggttcattgaatgaaagtgaattcattattaaccaagtagtttccccaagagaaaggcatggaaggaagctattcactttactcctcaacaaagaaggctttaggcattctgacttgtttaagaagtaaaatgaaaaagagggattgagtctgaaagaaaagcatactcacacataccctgctcttgcacaaaatttacatgttgtcagtttctacctctaaaatttattaaaacaaagagggagcattattttgaatctcatgccacagtcctaagaacaatggtctgtgttcagtgatcctgtacagattcttgaccttgaacacacctggatgccaatatcagtatgaaattcagaactgctcccctttccctgaagccagtgttacactggagaatgtaggagtatcctttgcctgaggcattcctggaccaagtaaaagtaaaagcagaaattataacctaatctggaatgcctctaaggaatggagaggaaatctcagttacaaagaaaaggaagttcagaatctgcgaactagaaataacataatttcaaggtttttattcaccaaattaacgttgggttacccctacaataccaaggagaaaacgtccaaggatggtgctaaatcaatgaagacaattcagacattacaactagagaaaaaataaggagaaagcaagaaagttggattctttgtccaaagatatttttgtcattactagatatttttccatagaaaaaaaaaacaattactagatcatcaattattttaaaattaaaatgaaatcttcatatgttccttttttaatggaaatgtgtaaactggtacaactatattattttgcaatatgcatgatctgtgaaaaaaattagaaaaaaactacatacaattgaaggctatctctgagtttcatatactttctcaaaatatgtggaaagataaatgtggaagatgtctgttgcagtattgtttgtagaaatcaacttcttgaaatatttattgcaaaacaattaacacatgtttattgattctttattttggcctactttgtaagaaaaatccaatagtgaataaacaatagtttctgggtttatggaacattgtttaagaaatatacaacaacgaaaaatttaagaggaatgaatgttataaaaaagaaagcaggccgagcgcggtggctcatgcctgtaatcccagcactttagaaggctgaggcgggcggatcacttgaggccaggagttcgagacccacctggccaacgtggcaaaaccctgtctgtactaaaaatgcaaaaattagccaggcatggtggcagatgcctgtaatcccagctactcgggaggctgaggcaggagaatcgcttgaacccaggaggtggaggttgcagtgagccgagatcgtggcactgcactccagcctgggcaacagagtgagaatccatctcaaaaaaataataataataaagcatatgctaccctaaatgataagacacagggatatcttttaaaatagaaaggtttcttttttactgatacataataattatacatatttaagggatacatgtgatattttgatactacattctcacatgctatatgagttatttatttctagaagttatacaatggaaagtaatttttaaaataatttatgtaaccatttgtgaataagaatatatttgtgatagttattaattcacaaatggtaccggtcatattaacaacttatttataatcagcatatttccagttagcaaagtgagaatgtaaggtaaaaacgtaatgggattaataggaataattttgctatggggatctgtgtagttataatgatttcaagttaaaaaaacagaaatgtaagtaatatatagcatttgtctctaatattatagaaatgccatattcagacctgtcgtggagagggacatagctgttctcttcacaatctcagtcatgaatatgactaatgagaaatgaaggggagaggtggggaatttatcacaatatccacacaccaaacctcatgtacttcttcaagatgtgtctttcaagactgcactcagaatcgtatatatctattaaaattttgttatcttgtcagttgctgaagaaaacaaaaggatcaattagaaggaagtaggggctactgacagcatccagatgtgagacttgcagtctgacagcaaaggaagggacgaaatacatcaatacagtcatgggccatttagcaatttcaatagcaccacctgggatagagttattatttttttaaaaagtgaaacaactgaagtttgtgctgatgatccagaggtatcaacaaaatatttgatactaccacctatgttcaagtaaaaggacagaaaagccttcgcaatgttttagaagttaatatcaaaaataaacatggcttggtattttgacggaaatgtttcagttgcctagcaaattaactcctgtggtatttctcattccccaagcaaaatagaaaagtgagatattaggaaactttaaaactggaaaaatatatgacaccgccaggagttttgtccagaaatgaaatttggaaatggcctttatccaacaaatagcgtggcagcatttgctaaaccccaggcacagcagtaggtgctcagactacctctggcacacacataatctagcaggaaacaagtataatagccgatactaggtagagcacataaatagcatggctttaaagaaagcgtgggtacagacgtgtagaaatgctaggtgtggttgattaatgccgattgtgactactattaggtacacaggatatgaggacatcaagatagaacaccaaccagcaaggctgagagagccctccagggttgagggcacagcagaatctcagagtccagttgttttctcactcacttcaatacccccattttggtagcacattaaataaattgatctggatttggaaaatagcaaactgaaaaccagaacaacaattaaaatattcaaagctgaaggtatgaggctgggagaaatgataataataacaagaataataatgataaacactgaatgagcatttattagatgtaggacactgcataaaaaccttcacttctataccctgtttgaacttcacaatgaccttccaagagtctaccttattagccctatttatgatgagaaaactgagaaatgcagagggaaagtaacatgaccaaaaacaaaacgctggaaagtggtggaaccaaggctttgagaatctgttttcagactttagcagcccatgcccttaagcaatattaaaaacttgtctcaaaaataataaaagtttcataaatctgaaatgatgaggaaaatatagcctcagaaacagaaaggttaaatcagactgaatctccagtcaaaaggtgagcccaatcagttttgtcctctcacaggaaagaagttctttttctaagaccttttttttttttttctgaaactgaaactgtgaacttttggtattctctgattctccagaagaccctcaagtccctaagccctagcaattgttttattttactagttgaataaaatgggctctggaggcagtaacacaaattcaaatcctaactctaccacatagtcactctgtgacctttggtagtcacctaatttccctgaagctcaatctcttatcttaaaatggagattttttgagggctcttaatgagttaattagtatacataaaggctaactcagtgcctgacatataacaggtgtttggtaagtatcattgttcacttcttgcctttctcaacttttccttaaactaaaacaaggaaaagatagatttcttaagatttagttgttgcatcaccatttatggaaaaacaaagagaaatgaaaacaaaatcaactttccttggtgatgaaaacgccctatgtcttcaatttgattctgggcttcacagtatatacatatattaataagctatacacttaagatctgtacatttcattataggtaatttatgcctcaatatataagacaaattcttgacaaaataaatttttattttaaatataatatctcaaacataataattaattctattggcaaaccaaattatccagcatatattttatgtcgccaattagaaacttaaaagtacaaaaaacacatactacatatttttcatctagccctaatatttcattcccccaccttgctcccactttaaacaatcctaaggaaatttccaacagccactgttttatttctgtactctgcaagtagcacgttccagttttctatgcgagccttttggccacattacagccaactaccaccaccatatgccactggagtccacattgataaaagatctaagagttgaatggcactttcatacttagagagggctttacacctgtagatccatttaaaactcaaaaaccttgcaggaagatatggttaagcactatcaccatcattgaggggaaatgatggctctgagaaattaagtcaaggacccaggaccttggcgttgttagggactaggacccaagtcttccagcatcaagactcacagcttttccattactcttatacctttgacagaggaagagatgacaagacaagtcctccaacttgtgccaactaacgatgagcctgcacagcactagctatagaaaatcaacaacataaggccaggggctcacattgttaaagtctgtggctttagaaaaggatgaaatctgcctaaaaaatatttctctactcttcccagagttgcttttggaagcgatatctttatatccaatacgatccttctcaaaggtgagtattcatgctgcgaatccactccagtctccagggcctttgccctggtactgacattttaccttctacaaaaacttcatgagagaaaggaaaaaaaacaaaaactagatttttccaggtcaaataaaaagaaaaaacttatactaattaaagccatactcttttagacaaaaacactatttcagttctcccttctttgctttttctgctgcaaaacatgtttcaaggctaaaaaggagccaattaaagtttctattatcatgaaatacaattctgttggtgcagtgatactgagcaaaagcaattttattcctgcctttccaaaaatacgtataggtacatgtgaaaacaactatgcatgcaggcacacctgcaggggtgtctctatgtgcacgtgtatgtgtgtagaaaggaagaccagagagttatcacagaattgaacctgcacaattcaccacaaataaattaataatggcatattatgaagatatattttcccattatctagaggaactttgttttgcctgtttttgttattatttttcactcgagtcatcattatcctacagagaggaaggctaacaaaggcctttgatttcaccacttctagagatttaaacaaaagacttaacaatcccaattagaccattaaaatacctcaagagaaaaacaaagaatatacagctatatctgctgaactcccagtaataactcaaggtctgtcttaattttttttaaaccagaggaaatgaagggatagggggagggaggaaacaagggagaaaaggaaggaaggaaggagggaggaaggaaggaaggaaggaaggaaggaaggaaagaaggaaggaagaaaggaaggaaagaaggaaggaaggaaggaaggaagggagagatacagcaatttcactattccacccatgcacctagcagctgcgtttattgttatttatttatttcctcccttttgagctagatcctttttttctcatttagtccaacagagattgtcctcctggtgtgaccttttattcttcccttttccttcacccctccaggctattgccctcatgccagtaactagataacacactctatcaaagatttttttaaaaaatcattgggaaggcactagggctgatagtggcatcaatcgtagcctgacacgagctggggtcaaccatttatctctttacatagcctgtggttactgcagtggccatcttgacttgctacatcttaacaaccttgtgcagatgttgcctctcccaacactgataatatctgctcccccagtccttttgctttccttgtttggcatatttctttgttttattctggtggacatcttttcataataaatcagggcaagaataagtgaagcccctcccgtgtttcagagcccttccatatttcagggcaagggagataattatgggctatacaaagaatcttgctctttgtaccaatattttcaaactaaaatcaaaacacttttgttccttagtaaatagtcatatccttgaagttaaagtgaattcatgtagcattgctcttatttcactggatatgagattttatcaaaagttttttatgaactcatttattttccattctatcccactcttttcccatctctctctctctctctacccccaaaataccattcactagcttttttttttgtaacttattcagcaggcagcatcatgattaagagaaagttgaaagttaggcagactacatttcaaactcatagctccaacattattagccacagggcctagggcaagtctcctaacattttgaagcatccgtttccttatctgcaaaatggagctaatactatctactcagagtgctatgaaaataagtagaaaaaatacttaaatgccatgtgtctgtcacatataaatgttcaatgtatttgagttgccacttactgtcttaaagttaatgaagagttagttgctcagacaatggaatctggtgccaagcatcatggacaaccctatatacaaaactcatctttactgccactttttctaccactgtaacttcacttatttgggtctccaagaaatctgtttaaaaatggaaatacacttgggaagttttagaccttataaacataaactttaaataagactggaatggaagatagaaacaaaagaaagagaaaataaaagagactcaaaggaaaacttggtttatgtgtattgtgctctaatttttaatacaaaccctagatgcctcacgccttctagaaattcaaataaatgtaaaatatagccactatgagagatacccaagttaaaactcaccttcacccttaaaattcccattagcagattcttcttttcaaaggataacctacataacatagtcctcacttaaaaaaataaaagtaaataagctgatagctgttgaaggtagacaatgggtacacagggctcattatgctattctctctattgtcacatatttaaaattgattattttaaaagttaaataaaataggccccaataaatacattgccttaaataggctaattgtgatgtatttccagttgtgccaaagcccagtaaagaatagggtcaatatcccctgatgctgaaagggattgtttcttaagacttcacagagaaatcttaaattgtactttaatgatggactttatggataaatatatagtcatagaaataaatatatcactccaagcattgccaatgttaatcttatgaccattccagatttattcactcaacatacagatagcatttttaaattatttcatcatattcctatacttctacacccaatgcctgtagatactgaaattaggagttactatctctaaactctccagcttgaagattatggggcaagagtgccaaagagcacaggctctggaatcattatgtctcaatttgagtccctgctctgccactttccagctgtgggtcctgagacaagcttctaagcatttctgaatggttatcaacctgtaaaattgagatgataatagtcatcactttaaagtttcattctgaggattaaatgggcagttcaagtaaagggtttcacacagttcctgacaagaagcaagcattcaattaatgttaccccttcccattattattagtagtagtagtagttctttacaataaaatacagaaatatgcttctctaggtggcatcatagcaagtattgaataccctaatatgtttttctttccatttttctcaatcttcccaaaacagcgattacatacttggttgtttcattttaatgtttgaaaagtatcaatttatccaagtgaagttatgaattctgtgagcagaagagatgaggcaaagaaatcaagaatcactccctgattcagtggtgcctggatttgaaagggtgcagtatgaagatgagtttaaacgctggcatggctctcccaatttccacacaatttccttgtggagaagccaccagtacagggaaattttagaacaattttaccaagagaaaagaacccagacccctgctttcttagtctcccctcaggcgtgggcactgaaggcttcaatgagaggctggaagactctaactgtggcccaaatttcatgccacatggcagagcaaggcttttttccaggagcagtgcattgttaacttatcagacacattaataaattcctatctcaaatgtgcagaaaactcacacaaaaagagaagcaagcttgtcttctttctgctccattccagctctgggttaagaaggtactaccttcagtattgctggtacaagggtcctggttcaaaccttcagtccctgcccccattaaaatgtaaaactagattcaaccatcacggagtggc

SEQ ID NO: 60 - DNA, 8544 bp, Homo sapiens
tgggtgaagtggtaatgtctttccataattcattaaaaggagatcttcaacatagaggagtagctgatgatcttaaagcactcgctagtcatgagatggtccttctgaatttaactgcagcgtgcaatgaagatttttatttctctattttttttttttttgagatagagtcttgctctgtcgcccaggctggagtgcagtggtatgatcttggctcactgtaacctccgcctcccaggttcaagtgattcttctgcctcagcctctcgagtagctgggactacaggcacacgctacgacgcctggctaatttttgtatttttactagagatggagctttgccatattggccaggctggtctcaaactcctgacctcatgatccgcctgccttggcctcccaaagtgctgggattacaggtgtgagccaccgtacccagcctatttctcttcttgtagaaatttctgaatcagaattagaactatatatgctatcataattgtaaaatccacttattgtaagaatgaaatcacatttctacctataagtactgactttttcttggttggataactgagaaaacatttgaactgcaactcttgcttgtccagctcagatctccttcgacatgactgccagcataagctatctacaatgcaaatctgattctgtcacttcgagcttacaaatacttcatggcatcccagtgcctaaaggataaaggctaagctccttagggaggcacagaggaccctctgtgacctgacttccagctgttcctcctcctgctgttttttgcctttaccttatgcacgagagcaacacccaacagccacatttcctagaaggtgtcactctctctctagaagatatcactctttctctcaggaaagtgagaaagaaaaaaagcagtcaggccgggtgtggtggctcccacctgtaatacaagcacttcgggagatgaaggcgggcggatcacctgaggttgggagttcgagaccagcctgaccaacgtggagaaaccccgtttctactaaaaatacaaaattagctgggtgtggtggtgcacacctgttatcccggctactcgggaggctgaggcaggagagtcacttgaaactgggaggcggatgttgcagtgagctgagatcgtgccattgtacttcagcctgggcaaaaagagcaaaactctgtctcaaaagaaaaaaaaaaaaaaagaaaaaaagcagtcctgggctgcggtaagctaaactgtcctggttctaacatctaggcctggggttgtcctgttgaaccgaaaccaggccactctatgagcatgctggagcaagacaaaaataagaccactttacagtgagctgagatcaccccactgcatgacagtccgggagacagagcgagaccctgtctctaaaaagaagaagaaaaagaaaaaaaaccactccacagtcatgtctgagcacagacaaaaacacaaatgccataaactacaaaaaatgcgaaacatcttcctctcccagctaatatgagtgactgctgtgcccttactaatcacagctttaccccaccttctagataaaaattcatcatagaattatcaaatccagagcaaaatattgattctttaaacccttcccaaagtcacctactgcaagtctaaactgcaacaagttcctctcaactctgcactaagatgccccatggttcttcatggtgtgctttcttcctcactgcaacgaaccaagaaacccaacttgttcaactacaagtgtgttcctttggccaaaaggcactgacacaaggaagcttttcctgtctgccccaggctggctgaggactgccaccttctctgttccaaagatgtcctgtaccttacagcactgcattatgcaggctatattgtattgaaattctgtccatccatgtctgtctccctctggagaccttgggccccacaggaaccatgttttatttttttcctcttattcatttttaagtcctcagctgacaaagaacctaggtcatagtaaagtttcaaaaaaaaatgtttaaagaatgaatgagtagatgctgcacatttcttgggtccaagatttaaagatgcagcttcacgtaacacatcattttacaacactgtcaactataacgtcatgtgctttaagaatgcagtctggttgtacaaggtgactcatgcctgtaatcccagcattttgggagtcttaggcaggaagactccttaagcccagcagtttgagaccagcttgatcatcatagcgagactccgtctctacaaaaaataattagctaggcatggtggtgtgcacctgtagtcccagctactcgagaggctgaggtgggaagactgcttgaacctgtagggttgaggctgcactgagctgtgatggtgccactgtactccagcctgggcactgagctagactcaaaaaaaaaaaaaaaaaaaaaaaggaatgcaatctgggcttctcctcctaactctcttgcctctgaatattcctttttccgaagtgtgtcgagaaacaacctaagtttggagagattaagacacatatcgatgtagagaaagcttttttttttttttttttttttttttaagacagggtcttgctctgttgcccaagctggagtgcagtggcacaaacacagcttactataccgttgacttcccaggctcactcaatcctcctgctgcagccagccgagtagctgggactacaagtgcataacctcatgcttggctaatttttaaattttttgtagagatgaggtctcgtcatgttgcccaggctggtctcaattcctgggcccaagcaatccttccatcttggcctccctaagtgttgggattacagatgcgagccaccacccctggccaagggaaagctttttaaaaaatttaaacaaactcaaaagttttatcagttctggaagatcatgataaaaatgaaatattggagaaagcaagctgttacccatcaatgttgagaaaatgacaaaacatatcaagttttacatggcaacatctgtttataatgtgttaaattttttttacctgttccttaaggggaaaaaagtgggtaactcaattaacatcaggtaggactctaaactttcaaagtaacttaacttatttatttgagacatggtcttgctctgttgcccaggttggagtgcaatggctgatcatagttcactgcaaccttgacctgctggacttaagcagtccccttgcctcagcctcctgaggagctggaactgcacttgtgtgccaccatacccagctaaaactttcttttttacttgtattaattttttttttttttttttttgctgggaagactcagacccaagtaaccttggatatgagctctccacctggttaaaactttattacagtgctgatttcttctgtttctaagtttttgccaatctttggcaaagatcaagacaggtcataattcttaaagttcagctgcttgtagagacatttatagcaaaataaaaaacttaaaaagaaatgttaaagagtacatttttccttctttttagagatggggtctcgctatgttgtccaggctggtcttgaactccagggctcaagaaaactgcctgccttagcctcccaaagtgctgggattacaggcgtaaatcaccatgcccagccaagactaagtttttaattttactgcctggttatattgtatataaatatttaaaatatcaatcttgggctaggcacagtggttcatgcctgtaatcccagcactttgggaggccaaggtgggaggatcgcttgaggccaggagttcgagaccagcctggccaataaggtgaaatcccgtctctactaaaaatacaaaaaattagctgggagtggtggcatgcacctgtaatcccagcaactcaggaggctgaggcaggagaattgcttgaaccagggagatagaggttgcagtgagctgagattgtgccactacactccagcctgggtgagagagcgaaactccgtctaaaaaaaaaaataaataaaataaaataaaatatcaatcatgacaatttaataggaaaagtcttaaatattttatgttcttaaactaataaagtgactttgaagccaacaagaatgctgaaaacaaactgtgtatattttaatctttcctaatgtttttatgttcttcttttattctactcaaaaggcaaacattttgtttccatggtttgagaatttagtatattgaattattatagatttttatttgtgatttgcctttgtgctcgattaagtgattgaaatctggttttaataagatataaacttttttctaaagacctactctagaagagcaaacagatgtatatcatattataatattatatcataataaatgtgctgttctctttctttaatgacactcatttaaaatatagatacaggtccaatatcccttgtctgaaatgcttggaaccagaagtgttttggattctggattttagaatatttgtatcacgtaccttcccaattaagcatcctaaatcttgtttttcttttcgagatggagtcttgctctgtcacccaggctggagtgcagtggcacgatctcagctcactgcaacctctgcctcctgggttcaaggaattctcctgtctcagcctcccgagtagctgggactacaggtgtgtgccaccatgcccagctaatttttgtatttttagcagagatggggttttgtcatgttggccgggctgatctcgaactcctgacctcaggcgatccgcctgcctcagcctcccaaagtgctgggattacaggagtgagccatcaggctggccaagcatcctaaatcttaaaatccaaaaatctgaactctgaaatgctccaatgagcatttcctttgagcatcatgtgggttctcaaaaacttttggatttcagagtattttggatttagaattttcagatttgggatgtacaactgtataaacacactagttggttttctaacaactaatggtcagaatgagaatcctttcatgaataacacattttattttctactaatcaagtggaaaaaacaaacttaagactcatttgataatcactacactaaaaggttttaaaatgacttaaaaatattttttatagtttataaaactatactttctataaaaaatgaaagaactgaaattcttcagacaatactttgttcatatttatgtatttaaaatttttttttaaatattttaaatgttttgtagagaaagggtctcactatgttgactaggctagtctcctgacctcaaatgatcctcccacctagacctccccaaaggactgggattacaagtgtgagccactgcacccagccagacaatactttggatgttcatttcatttgcctattctactttgtctagagcatgcacaataggaatatatatttttaaaaactgatatcttaattctgaagaaaaaaagtttctgacattatttttaaaatgtgtcaaagtccatacctgatttcttaatgatgaaagaatgtattccttttcataatgggaaattctcttgtgtttttgtggtgtgtcactaactaaccagatccacaaaagaaaccaaaatattccaatagtaccttaaaatagaaaaataatagttagataaaattagaatgtaccaaataacaaacaaaacaaaacaaaaacacaaaattagaaagcaccaacaacaatttttacatgtcttgaaaaaattatgtaactataaattcaatgtaaaactgacttcagtttggattcaatttcaagtttctctcaattctttaatgggataattgctataactgtattattgcttatacattttgaagaaaacaacttttttttttttttttgagatagagtcttgctctgtctcacaggctggagtgcagtgacgtgatctcggctcactgcaacctccgcctgctgggttcaagcaactctactgtctcagcctcctgagtagctgggactacaggcacgtgccaccacgcctggctaatttttgtattttgagtagagatggggttccaccatgttggccaggctggtcttgaactcctgacctcgtgatccacccgcctcggcctcccaaagtgctgggattacaggtgtgagccactgcacccagccagaagaaaacaacttttaaccacatgactttgcctatcagggtctaccagacaaatctttttgaagatacatttccacaatctacatatttccaaaggtgtctgtttttgttagttgagttttaaattttgattgcagatatatttcttgcatgacatgtctatgtgaaaatctaatttattaaaaatgtgtatcatgctgccaaggaaattgagcaataaaatgccttgggactaagtaaaaagaaaaaaaaaaaaaaaacattaaaactaccaagtgagaacatcctactttgcttgagaagaaattcaaaatacctaagatagtgattttttgatagcaaatgtactatttaagtacaggatcaacagtcatttctactgagaaatattccaaaactaacatcagctcgtaactcaaataggtcaagtaaatcataccaacttgaaaaacaggttatcaggaagtgtttcagaactgtggttcagtgatttggaagatatatttttaaaacattattaggctactattattacattttgaatttgttacattataatttagttaaaattttaaacttaccaaaaaagtagaagacataagtccaattcatatagtagcaaattattccagaaagaggaagagaaattactgtcccaagctgtgctcctagaacaacacataagactattttataaactttggagagagaaacaaggataggacagacaagtctactgcttacagaggatgggtaacaggctgggcacagtggctcattcctgtaatccctgcactttgggaggctgatgtgggtggatcacctgagcctaggagtttgagaccagcctgggcaatatggcaaactcctatctgtactaaaaatacaaaaattatctgggtatggtggtgatgcacgcctgtagtaccagctacttagctacttgggaggttgaggtgggacgatcgcttcagctgttgaggctgcagtgaggggcgattgtgccactgccttccagcctggagtgagaccctggctcaaaaaaaaaaaaaaggctaaaatgtggtcccatagaaacaagattagaaaaaagatatagaggtagtataacaggacaagcaaaggaatggaagtagtaaagcagagagtaggcttgggaacttcatttgggtaaaggaaaggaaaagcagataaagctggaaaaataggttggacagttgaacagttactgagtacctactccatgctaggcactatctgccagagatataaggctagctgcaacaaagtagtgaagactgtaaagaatcttgcccctagttcaaggagtttgggatttattcaataggtaaaagggaaccttagatagtacctgttcttgaacctatcatcagatttctcatgtcaatctcaacatagctgcaagaataatcttcttaaaatgtaattgaatcatgcctcttaaaaaacaatctacattttttcctgtagcctgtaagacctgatataacccggctcttatctctttctctaacctcatcttatgccatcatcctccttactcactgagttctagccatccaaggtagttttccacttcttttaacccttatgttatttcttgcctgagtgccctcgtacatgctgttctgattggctgaaatgctcttctccctgcatgaatggtttgttcttatccttcagattttagcttaaaagtaccacagagaggccttttctcaactactgtatttaaaaagcagtccggtggaaaaattttaatttagtcaatgaaagaaaggctagaatttcttatgcaatctgataaaattataattcacatatataaaactcatgttatctcacctgtagatcaaaatgatggcaaataaagatgcaatagaaaaaagatgcatgaagagaggggttgagaatcatgatacattcattagttaatcaaaacagaaatcacaatttaaggacaaaaacactcaattttctagctactggcctttttttttcttttttttaaatagcatctctaaacaaacaaaaataaaatttaaaacccccaaaaaagtaaacagaaaaagaaaaaaaatagcatctctataccaatatctgaaaacacaacatactttgaaatagatgatggcagatggggaaaatgacattagtcaattaagctgcattactataagttgttgagccaaagagaaaaattggtaataaagttatactaccgaaacttaatgttctccccaaaggggcatccaatccaacattgcatcgttctggtatgcaggccctttttcccaaaggttgatatatacataacatattacagcaaaatt

SEQ ID NO: 61 - DNA, 2116 bp, Homo sapiens
tgggtgaagtggtaatgtctttccataattcattaaaaggagatcttcaacatagaggagtagctgatgatcttaaagcactcgctagtcatgagatggtccttctgaatttaactgcagcgtgcaatgaagatttttatttctctattttttttttttttgagatagagtcttgctctgtcgcccaggctggagtgcagtggtatgatcttggctcactgtaacctccgcctcccaggttcaagtgattcttctgcctcagcctctcgagtagctgggactacaggcacacgctacgacgcctggctaatttttgtatttttactagagatggagctttgccatattggccaggctggtctcaaactcctgacctcatgatccgcctgccttggcctcccaaagtgctgggattacaggtgtgagccaccgtacccagcctatttctcttcttgtagaaatttctgaatcagaattagaactatatatgctatcataattgtaaaatccacttattgtaagaatgaaatcacatttctacctataagtactgactttttcttggttggataactgagaaaacatttgaactgcaactcttgcttgtccagctcagatctccttcgacatgactgccagcataagctatctacaatgcaaatctgattctgtcacttcgagcttacaaatacttcatggcatcccagtgcctaaaggataaaggctaagctccttagggaggcacagaggaccctctgtgacctgacttccagctgttcctcctcctgctgttttttgcctttaccttatgcacgagagcaacacccaacagccacatttcctagaaggtgtcactctctctctagaagatatcactctttctctcaggaaagtgagaaagaaaaaaagcagtcaggccgggtgtggtggctcccacctgtaatacaagcacttcgggagatgaaggcgggcggatcacctgaggttgggagttcgagaccagcctgaccaacgtggagaaaccccgtttctactaaaaatacaaaattagctgggtgtggtggtgcacacctgttatcccggctactcgggaggctgaggcaggagagtcacttgaaactgggaggcggatgttgcagtgagctgagatcgtgccattgtacttcagcctgggcaaaaagagcaaaactctgtctcaaaagaaaaaaaaaaaaaaagaaaaaaagcagtcctgggctgcggtaagctaaactgtcctggttctaacatctaggcctggggttgtcctgttgaaccgaaaccaggccactctatgagcatgctggagcaagacaaaaataagaccactttacagtgagctgagatcaccccactgcatgacagtccgggagacagagcgagaccctgtctctaaaaagaagaagaaaaagaaaaaaaaccactccacagtcatgtctgagcacagacaaaaacacaaatgccataaactacaaaaaatgcgaaacatcttcctctcccagctaatatgagtgactgctgtgcccttactaatcacagctttaccccaccttctagataaaaattcatcatagaattatcaaatccagagcaaaatattgattctttaaacccttcccaaagtcacctactgcaagtctaaactgcaacaagttcctctcaactctgcactaagatgccccatggttcttcatggtgtgctttcttcctcactgcaacgaaccaagaaacccaacttgttcaactacaagtgtgttcctttggccaaaaggcactgacacaaggaagcttttcctgtctgccccaggctggctgaggactgccaccttctctgttccaaagatgtcctgtaccttacagcactgcattatgcaggctatattgtattgaaattctgtccatccatgtctgtctccctctggagaccttgggccccacaggaaccatgttttatttttttcctcttattcatttttaagtcctcagctgacaaagaacctaggtcatagtaaagtttcaaaaaaaaatgtttaaagaatgaatgagtagatgctgcacatttcttgggtccaagatttaaagatgcagcttcacgtaa

SEQ ID NO: 62 - DNA, 14549 bp, Homo sapiens
taccagaagccacagagtatataccagtaactacaaaaagaacagggataatgtaaacccaaacaatggtttttatccaggtattcccatcctaatctgaatggagttccagaataagagcaatctttcgttgttcagatttcaagatgattcattgcacaaaaaaagaaaactattgtgatagttgttttcactgaacatgtccatcatggtgtatctgaaagctcttttccagggtgactccacccaaagctcctgctaagggagcagcctaggctgtcttactctgcaacacccactcatccttgccttgccacaactaattggaccagcatctggcaccagaagattcctatagaaaaaaaaccaaaggtagaatcagtgtcatgaggagggagttagagctggggctatgagaggtcatgtcaaactaagttataagacaacagaaactataaataagcagggcccaggatgaatttggagaagttagcaggaagccagattatacagggaagtcattgaaagatttcaaatatttaaaattagtgtttagggcaaggtgtggtggctcacacctgtaatcccagcactttgggtggctgaggcagatggatcacttgaggcaaggagttcaagaccagccatggggaaacctcgtctctactaaaactacaaaaattagccgggtacggtagtgtgcgcctgtaatcccagctacaggagaggctgagtcatgagaaccacttgaactagggaggcagaggttgcagtgagccgagattgtgccactgcactccagcctgtgcaataagagtgagacttcatctcaaaaaataaataaataaacataagatgaaataaaattagtatttagaactttagaaactgaatagttattggaggttgaggacagaagtggcaccagatgaggggtggcagttacttggactaaaggtgttgtgaaggaaatagaagtgggcatattcacagtgtattttcaaatatagtttgccaaagatttaatgatggactgaaagtagggagtaagggagcaattgggtggttgtttgtaacactgactgagctggaaaggaagggagagtaacagatttcaagtttgtgtcagtgaggaaacaatcagggaagcaaaatcactataagtattatgaaataaaggttttattacaggaataagaatttatatgagatgagagaagctgagaaagtaatgatccaaaagggagacttggagaatgagcagtgtcactaaccagtccttcacaaggctgggtgaatggggagagcttacaggacaatctggaagccagccatgtctcgttcctggagtgagaccatgaaaaggaactatctagaaggctgttcttcgccaggcatggtggctcacacctgtaatcctgggactttggaaggctgaggccagcagatcgcttgagcccaggagttcaagaccagcctaggcaacatggtgaaacccccatctctacaaaaattagcagggcaaagtggtgcgcacctgtagtctcagctacttgggaggctgaggtaggatcacttgagcccaggaggtcaaatctgccgtgagctgagattgtaccactgcactccaggacgagatttttgtctcaaaaaaaaaaaaaaaaaaaaaaaaggctgttttgtggctggtggcaggcctgtggtcgctgttggttcacaattgggtaaaagaactggctacagaccaggggagagcaagatgaagatgaaaacctaccagcacttctgcatgtgcttctcactacatttaaccaagttcacacattgcattttgttgtttcttcagtttcttctaaactagaatgaaaatgtccaaaaccatagcaactagctacatgtggccacttacattaattaaaatagaataaagtcggccaggcatggtggctcacgcctgtaatcccagctctttgggaggccgaggcgggtggatcacgaggtcaggagatcgagatcatcctggctaacacggtgaaatcccatctctactaaaaatacaaaaattagccagtcgtggtggtaggcgcctgtagtcccagctactcacgaggctgaggcaggagaatggcgtgaacccgggaggcagagcttgcagtgagccgaaatcgagccactgcactccagcctgggcaacagggcgagcctccgccttaaagaaataacataaaacaaagtctaaaattcagttcctcagccacactagctacatgtcaagtgcccagtagctacatgtgacttgagatgaacacatcaatgtagaacttttccaatctttgcagaaagttctacttaacatgtttccttaaaataaataatactccctccctttatttggctagattgaggtctttaatctagcacaaaaggacccaattagaatagagccacttgagacttaaccacttatataaattaattgcattattgtgtctattttttcaactcagctgataaaatgtgactagttcttctctccctgtatttgcatagagattagtgaagagatgaaaagccagcaagaagcatatgaggaaataaaagttctagataactcaatcacagatttctccaagaagacaaggacaatcatatagtttatcagattactaacttgtatatctgtagtcctacttttattttctatattttttgttataaaagataatacatgctccaataaaaaattcaaccattatataaacatataaaatagaagtaaaaatgtcctgtaatctcattgccaaatagagctactatataaaaatatgtgtatttctttcagtttctttctctctagatattaatattattttcacatgtttaacaagaatggtttcatatcatacatgtcatcttatgactataactagctttttcacctaatatgtatatttgggcacgttctcttgtcagtatacttcatacttcatatacttcaattttcaatagttgcatagaattttactttatagaagtttcataatttctatagccatactattactggttggattggttttttttttaatccattagaaacaattccataataaaagtctttgagtatttctgttatataagcatattttgatctacctcctttttcatgatcttgacaattatttaaatttattgttaaattggcaattttatatagaggaattttcatataaataaatgaatagaacttttacaatattaaatcagttgctaaactgattcaatcgtgtgtgtatttactttgtgtaaatgttggttagggaaaagagtacaaatacaaaccccaaagtctaaaaatgctcaaaacccactctataactggaaaagacgtacaagtgttaaagtacagaaagggtagttactgggcagaaggaaaatatagccttagggatgggaagaaataaaactgcatgaaaaggaaataaaagtgccataggagattttaatactgcattttactaggctaaggctgacaataaataaagaaggacaataatattaagtaatttaattagtttaaagtagtattttatatatatgttgaacttggtactttacagaaagtacaacttttcaagcatttaaagaatactgacaaaaggccgggcgcggtggctcacgcctgtaatcccagcactctgggaggccaaggcgggtggatcacaaggtcaagagatcgagaccatcctggccaacatggtgaaaccccgtctctattaaaagtataaaaattacctgagcatggtggcgggtgcctgttgtcccagctactcgggaggctgaggcgggagaatcccttgaacctgggaggcggaggttgcagtgagccgagatcacgccattgcactccagcctgggtgacagagcgagacgctgtctcaaaaaaaaaaaaaaaaaaaaagaatactgacaaaaatcatgctctaggtcacaaaaaaaacctgcaacaaatttttttttctttttttttttttgagatggagttttgctgttgttgcccaggctggagtgcaatggcgccatcttggctcactgcaacctccgcctcccgggttcaagcgattttcctgcctcagcctctcgagcagctgggattataggcgcccgccaccacacccggctaattctgtgtatttttagtagagacggggattcaccatgttggtcaggctggtcttgaactccttacctcaggtgatccacccgcctcggcctctcaaagtgctgggattacaggcgtgagccaccgctcgcagccaacaaattttaaaatgcaaaattgaatagcctaaatcttctgaattcaatttcatacctctacaaattaaccacaaaaggttagtcaaaaactatgccccagttagaatatttaattggattttatttatttatttatgtatttatttatttatttgagacggaatctcgctctgtcgtcaggctggagtgcagtggctggatctcggctcacttcaacctccgcctccgggttcaagtgattcttttcagcctcccaagtagctgggactacaggcacgtgccaccacgcccagctaatttttgtattttttagtagagatggggtttcgccatgttggccaggatggtctccatctcttgacttcatgacctgcccgccgcggcctctcagagttctgagattacaggcgtgagccactgagccgggcccaatttgattttaaaacaaaaattaaaataaattattctaagtatattttggattaaacaaaaaattaaagatcaaaatagaattgcaataaacatttatttgggctgaataacaaaagctgagcattaaaatcaacattcaacaagaccaaggccaaatatgagtatcataatgataaaataaacttctagaacacaaaaataaaacctgatattttatttttttaacttaaattattgccaggaacagtggctagcacctataatctcagctactcggaaggctgagacaggagggtctctggagcccagaaattccaggctgcagtgagctatgatctcgaactgcactctagcctggggaaaagagtgagttccatctctaaaaacaatttaattattattgcaattctatcatcaaattataaatgcctaagactagcatagaggaacacaaatttctcagcactgttacctgctagactcctcctgcagaaatctgctgcatgtttgccataccaaacagatgtttgctttcaattaaggcagtctgtactgggacctcaagtctgaataggcattatctaggtgaagaggtagggaaagaggaatccaggctgaaggaacaacatgtgtcaaagcagaggggtaagataaatatgggggcttctagaaatggaaaaacgttcattgtagtcagaatgcagagtgggcaaaaggcagggctggggaaggagaacttcttgcaagatgtgatattggagaggtaatataccgtcatattaggaaacccttgcacaccacctggagctgaggctttcgcacttttttgaccatgactaaaagaaaaagatatatttcataataccaccagcttacacatttcatgtatatgtatataagaactatatttcatgcgaatacttttactatgtccaaagctcttttgtattttctattgcatgttcacttttacttttaaaaaattctgtctgtcttctactagactacactgagcctttgtgtgaattagaaataagtattctctttaggcagatatagcttagagattgtgaagaccaggccttgaaggctggaaggggcagtggaaagtgactttatccaaaaaagatgccccttcctcaagttggatgaagctccacatatttgcccccaacatttggagagcgtggggcaagagtgcaaatggaagcctacatacccttaagtctatttaaaaccgtagaccaatctaacaaaccaataaataaaatgtgttctggccgggcgtggtggctcacagcagtaatcctagcactttgggaggccgagtaaggtggttcacctgagtcaggagttcaagaccagcctggctaacatggtgaaaccccatctctacaaaaatacaaaatatttgctgggcattatggcaggtgcttgtaatcccagctactcagtaggctgaggtgggagaattgcttgaacctgggagggggaggttgcagtgagccgagatggcaccgttgcactccagcctggatgacagagagattccgtctcaaaaaaaaaaaaaaaaaaggtttctacccttctacctcaacttatataacttcatagtgacctcaaagattcaggttccaatttagaattcttggactcagaattcaatgtaggcacataacttcaagcctgctccccttcttttcccaccctgaattccaccctatccaaaaagggctttttgtccatttacatctgaacactctgtcctactaatctcacagtcctggagagtagaagtctgaaatcaaagttggtagagccatgctccctctgaaacctttcttgtctcttctcagcttctggtggtattcaggcaatccatggcattccttggcttgcagctgcataactccaacctccacctttatcatcacatgatattctttctgtgtctctgtcttttttatggccctctgttataaagactgcagtcatattggattaggacccaccctactccagcatcacctcattttaactcactacatctgcaatgatcctatttccattctgtggtactagggattaagacttcaacatatcttttttgggaagacataattcaacctataacaaactagtaaattctgtatttgttgaatgaatgaatgtgattcagaacgctggaggagaaatttgccttactccagaggacaccatactattgtagtgagagggaatgaaaaacagtggatacaaatgaaagctggtgtaaggaaattgtgtcatctgacaacatcaaaattctccatgaaggaggtaaaatcatatttttaggtgaggaaagaattgggataggggagaaaggagtgaagagatgtggaggagaaaggaagtctgaggaacgaaaactgacaaagtggctgggcacggtggctcatgcttgtaatcccagcactttaggaggctgacacagatgtatcacgaggtcaggagttctagaccagcctgaccaacatggtgaaaccctgtctctactaaaaatacaaaaattagccaggtgtgttggcacgtgcctgtagtcccagctactcaggaggctgaggtgggagaatcactgaacctgggaggtggaggttgcagtgagccgagaccatgccattgcactccagcctgggtgacagagtgatactccgtctcaaaaaaaaaaaaaagaaaaaagaaaaaaaaagaaaactgataagggaaataagaattgcctgtagtattgagagcccggttgagttggagactataaatttatggtggcataagtctgtgctgccatgtgatttaggcagcaaggctcagtaatactggcatgttattgggaaaggcaactggttgaatcaatccatagctggggtttttccaggtagtgttacagactaatgggttcttcttgcccactgcacagaaaagccaatacaatgagatagcagtgttgcagcagagagtttaattatagcaaggcaactgaatggaaggataggagatatttctcaaatctgactccccgagaactcagaggctagggttttgaaagataatttggtggactgggtttagggaatgaatactgctgattggttagggatgaaatcatagggacattgaaattgtctttgtgccctgaatcagtttctgcatggggggtgtcagggaatcacaggacccacagagtcagttctttggcatgggtcacaggtacagttagcatctgccaggatgccaaagtctgaaaaatatctcaaagaccagtcttagattttacaatagtaatgttatttataggagcaattagggttacaaatcttgtgacctccagctctgtaactcctgaagagtaaacaattatagaaaagcaagctagggaacaatggcttgttatcgtttaactgtatctacatcttcacagaattcaggccactcccataattctaaccttgtggactttcattagctttagggaggtagttttggttcctgaacaataagggttagttttaagaagggactgctgtcatccttgctttaaactataaactaaagtcttcccatagttagcttgaactatgcctgggaatgagcaagagtagttaggccttgtgaagttagaagcaagatagagtcagttatgttagatttctctcattgttataatttttgcaaaagtgatttcagtagttgcccaggaaagaagacagggtaaggaagttgggaatattgcacgagagggccaccaataaacctcgaaattaggctggataggaagggaagttaaaaacaagtaggatttgatatgaaatgcagaggtccttaacttttcatgccatagacactttgccagtctggtgaagcctattgaccccttctcaaaacatatttaaaaatgcataaaagatgctcttcaatttacaatgaggttacgttccaataaaccccattgaaaatactgtaagttgaaaatgcatttaatataactaacctactgaacatcatagttttcttagtctaccttaaatgtgctcagaacacttactttatcttataattagacagaatcatctaacgcaaagttaaaatcttgaatatctcatatgtttattaaatactgcagtaaagtgaaaaacagaatggttgtatgagtatttgacctacagtttctactgaaaatgtattgctttcatgccgttgtaaagatgaaaaatcataagttgaaccattgtaagttggggaccatctgtataagattacaaatgaaaccctttacattaaaatacaactatcaaaatatttaaacaaaccaaaagtgtcccatagtaatatatgtgcttctttgcattaaataacaaaatctgtgacaggcttaaagagtatcataatttctacatagaaataatgtagaggtttacatatttgtatctgatctgaactgtaagatatataaaaatagctgtgggtctcagttcctctgggaaggtaagagcctaactctggtgggcaagtgggcaccttgctccagtttgcaataattgcctttctaatttcatggacattagatgccacatggatgaaagaggcaaacaccatatccacatcccattctaccccaaacttcagatcctggatgtccttttctgacatggcaagcaggtccacagtcaccaggaaggtctacaccctttttgctgcccaaggagccataattttccattgctatcaccaggaggtcagtacctttctgctccaactgcagagaaataagttattaaatctatagatcttgctgcccctttccactaccttacaaatgttcttgtagtccagctacaggaagttctcatcataagttttccatgtaggcattatccagtgtgatctgaaggtggctcccttcttcagctccacctccatggggacactgctctgtgtgagcccagttcagatctcaggcccgttagtgtccagagccacagcaactagccgctagagattggggtcagaagcaaggctttccatagttgtgcacacattcctgatggtctctgcgtggtactcgtaagttcagacaagccatattaattccagacttaatcatcaacatttccaccaatcaggaaactaggccgatagtacagatgatgccagtgctctgggctgtgggggtggccagtgagtgttcaggcagcacacatgctacagcagtgtgtcagccaccaccgtgggcagctgctgagtctgaaatgaaggccctcctggcttcactgtggggcttccacttggcttctgaggtctttcagcgttttctggctcagactacttgcaaatgcagagaggtcaggagcctagggacattcactcctgtccattatatatgttttatttccagaatgtctatttgattgttttcatgtcatccaaattatttttgatggtcttttatttctgtatcatataccaatgccttcctttatttctttaaacattttaacatactcattttataatttttatttaaaatttctgtatctgaagtccttgtgagtctggtcttgaggtttgaagattttgctaattcttattcgtgctggctcagttccttgcgtgttttggatttttttttttttacttttaaatgtgtttaagttgacatataattgtacatattcatggggtacatactgatgtttcaatatatataatgtatagtcatcagatcagggcaattagtacatccaccatctcaaacatttatcatttctttgtgttaggaacattcaatatcctccttcatgttacctgaaagtatgtattattgttaactatagtcatcccacagtggtgtagaacactagaacttattcctcctacccagctataattttatatgccttttttttttttttgagatggagtttcgcttttgttgcccaggctggagtgtagtggcgcaatctcggctcatggcaacctccgcctcccgggttcaagcgattctcctgcctcagcctcccgagtagctggaattacaggcatgcaccaccatgcccagttagttttttgtatttttaggagagacggggtttctccatgttggtcagtctggtcttgaactcctgacctcaggtgatccgcccacctcggcctcccaaagtgctgggattataggcataagccaccacacctggccttaattttaaatcctttaacaaatctctccctaccttcccatctcccatacccctgctaatctctagtatccttcgttctacattttacttctatgagatcaactttttttttttttttttttgagacaaagtctcactcttgtccccctggctggagtacaatggcgcaatcttggctcactgcaacctccgcctcctgggttcaagcaattctcctgcctcagcctcttgagtagctgggattacaggcacccaccaccacatccagctaattttcgtgtttttagtagagacagggtttcaccatgttggccaggctggtctcgaactcctgacctcaggtgttctacccacctcggcctcccaaagtgctgggattacaggcgtgagccaccatgcctggcaagatcaactttttttagtttccacatgagtgagaacatgtggtgtttaactttctgttcctggcttatttcacttaacatagtgtcttccagttccattcatgttactgcaaatgacatgatgtcatcttttttatgactgaatagtagcccattgtgtatatatacacaccacattttccattttttttctttttgagacagggtcttgctctgttgctcaggttggagtgcagtggtgctatcatggctcactgcatggctcattgcagcctcaatctcctgggctcaagtgatcctcccacctcagcctcccaaggaactgggactacaggcacacactactgtacttagctaattttttaaatttttcatagagatggaatctttctatgttgcccaggctggttttgaactccttggctcaagcaattctcctgcttcagcttcccaaagtgctgggattgcaagtgtgagtcactgtgtccagcctaaattttatttacccatttatctgttgttggacacctaggatgatttcatatcttagctattgtgaatagtgctgcaataaacatggggatgcagatgactctttggaaaaaaaaatagctgtgctttctattggtgacaaacccatagatattgctagtactattgtggtgtacagtttacatttgttattgaaagaaatgctaaatttcagttagtgtttagtaaaagtatacatattttcccctgtccaagttcatagacttcttgaattttatccatggttctctatgggacagtggaatcccaggtaaaaaggactgaagtggagggagaaagtggaggaagtcaaagaactgataaaccaaattgtatggacattgacatgtaaatattagaaatagatattacagaatagagccatgaacctggtcccaaactcttcaaaattaataaggggcagtaaccacaaagtaagaaaatgatagcctcgaagtaagacaaaaggtgacaggccaagtggccatgaacatgaaaagatcagggggttttacataaagatggaggagtaattgttaagaagtggcagtagggaggccggacacggtggctcacgcctgtaatcccagcactttgggaggctgaggcgggcagatcacttgaggccaggagttcaacactagcctggccaacatggtgaaaccttgtctctactaaaagtatataaattaggctgggcatggtgtctcacgcctgtaattgcagcactttgggaggcagaggcaggtggatcgcttgaggtcaggagttcaagaccagcctagccaacatggtgaaaccccatttctactaaaaatacaaaaattagctgggcgtggtggcacacgcctgtaatcccagctacttgggatgctaaggcagagaatcgcttgaacctgggaggtggaggctgcagtgagccgagagcgttccactgcactccagcctgggcaacagggcaagactccatctcaaaaaaataaaataaaataaaaaataaataaaaatacatacattggctgggtgtggtgacatgcatctgtaatcccagctactagggaggctgaggcataagaatcgcttgaacctgggagccggacgttgcagtgagccgagattgtgacactgccctccagcctgggtgacagagtgagactctgtctcaaaaaaaaaaaaaaaaaagtggcagtacggagcaaggaagatactaaccttaacttcatacctgagggaggaagcaagctgcagcaagagaaagcagtaccctaaggaaggaagaatcagattttaattagggcaaggacgtggaagaaatgcatgcacccaaaaaaaatggtggaggatataggggtagtttcttatccctgtagactgtgcaatggaaggattgagagagagagggccatgttggggggtagtgtagactagaatggctgcaaatggatatgagaggatagattaccagagaggtttaattttttaatggtaatataaacccactagctagagattattctactgtccagagataaccagtgtaccattaaacatttggactatttattgctataaactttgtcatcaggataaaattaaaggcaacctaaatttctaaaattgattaaataaccgtttaatatctacaaaaataaaatgcagccaggcgcagtggctcacacctgtaattgtagcactttgggaggccaaggcaggtggatcacttgaggtcaggagttcgagaccagtctggccaacatggtgaaaccccatttctactaaaaatacaaaaattagctgggcgtggtagtgcgcactgcagcctgggcaaccaagtgagactctgtctcaaaaaaaaaaaattaaaaaataatccaggcacagtggctcatgcctgtaatcccagcactttgggaggccaaggtaggcagatctcaaggtcaaaagattgagactatcctggccaacatagtgaaaccctgtctctaccaaaaatacaaaaattagctgggcatagtggcgcgtgcctgtagtcccagctactcgggaagctgagacaggagaattgcttgaacccgggaggtacaggttgcagtgagccgagatcgcgccactgcactccagcctggcaacagagtgagactctgtctcaaaaaaaaaaaaaaaaaagaataaaaaaaaatgctctcaatattgccaatgaaaagaatgagtagaatttttaataatgttgaaaattgtcatgatagaaattaaatgagctgggtgtggtggccctcgcctgtagtccgatttattggggaggttgaagccaagaattgcttgaacactggagttcgaggccagcctgggttacatagcaagatcctgtgtctaaaataaataaatattttttaaaaaagaatattaaatgaaaggaatcaggatgacaaactgtatataattcaaattttattaaaatttatatctgcatagaataatacatcaaaaattgtataacagttacctctgagtggtgggattataggttattttaatcttcatatcttccttatttttacatttcatatcttttatatatctttttataatttttgtaggttaaaaaatagagcctttaggaaattagata

SEQ ID NO: 63 - DNA, 3848 bp, Homo sapiens
ctatgatcagacacaaatccaatcagaaatactccatgttactcttctcttccatccctgcttgtcttaagtgccaatgatatgtcaggtattttgctggtttttacattcctttattccctgacaacttgagttggcttttcctagttagtacataagatgatttaatcttgcgtatgttcataaaacttggttctgtgactgccaaatatcttttgaagtagtattgtcactctgttcctcttttaggaggaatatggaggtgtagagtaggtcagttttattccttggatattggtgtcaggttgggtgtaaatattttccaaccaagccctgcaatccagtgcagtagagctaaacggacagtgacccatgttcagtggctgaatgtttgctgtggacctgggatgttaactttgcaaaacaaggtataagtggaacttttccaaaaatgttttttgagagtatagtgttgaaactgccactggagcaaagagcctggacagataggattgcaatatggagtccctctgggcttcgttcatctgcttttacttgtctgagccggtaaagggctgggatcaaatgtggatggctttcctaatgatagccaagatttactgaggacttgcgatgtccatccgctaatcagtgctaagtgctaggcatggcttatctcctttactcttcaacaacagtcttatcggcaaggttctagtattatcctcattttactgataaggaaatgaagccttagaaatattaagaaatttgcctaaggtcaaacaccaaatgagtgccgttcttcattctgtaatagagcttcttttacattgtatacatttaaggaatataacatgatattttgaaatacatatacatagtaaaatcatatctacagtcaagctaatttacatatctttcacctgacattgttacctttttaatggtaagagcatctaaaatctaaacttttagcacatttttcatattcaatgcaatattactaattatagttctcatgccgcatattagatctctagacttattcatcctatgtaacaacaactttgcaccctttggcctacattttggtccacatttccccaattcctccttcgcccctctatgcacccagtgacccctattcactctgtttatacgtatttcacttttttttagattccacatgtaagtgagatcatgtagtatttttctctttgtgtttggcttacttcacttagcataatgtcctccaggttcatccatgttgtcacaaatggtagaatatcctacatttcagggctgaataatattccattctctctccctctctctctctctctctctctctctctctatatatatatatatatatatatagatatagatatatacacacacacactatatatatacacacacatatatatacacatatatatatacaacatatatatatatacacacacacaaccagccgatataagaactcattccttcaataggcactctctctctctccctctctcatatatatatatgaatggataaagaagaaattgtgtttttatatatgtataagttccacttatacctatacatacctctctctatatatacacctctctctatatatatgtgtatctatacctctctctctatatatattcatatatgttctctatatgtacatatatatagagagaggtgtatatatatataccttcttcttaaagaagaaattgtgagagagatatataatatatatatcgtatatgtataaagtatatatatatatatacacctctatatatatatctatacctctctatatatacatatatgtatgcatacatatatacgtatatattcatatatacgtatatatgtatgcatacatatatgcatatatattcatatatattcagctcctttgcccatttttaaatttggttttttttttttttttgctattgagtcatgtgagttccctctatattttaattatcaatgccttatcagatgtatggttggcaaatattttctcctaaatctgtaggctgtcttttcattttgccaattgttcactgtgcagaagctttttagtctgatgtagtctcagttgttcattgttgcttttgttgcctgagcttttgttatgatatccaaaactcattgccaaggccaatctcaaggagctttcctcctacactttcttctaggagttttatggtatcagggcttatgtttaggtctttaattttgaattgatttttttgcatatggtgtaagataaggatccagttgcattctttggcatgtgaagatccagttttcccagcaccatttatggaaaagaccaacatttccccattgcaaccttttggtggccttgttgaaaattgttctcactatatatggttaggcttccgttccattggtttatgtgtccacatgttttgattactatagctttttaacataatttgaaatcaggaagtgtgatgcctctcacttttttttttttcttcagattgctttggctatttgtgttctgttgtgacataacttctaagaagggatttgtataaaatgtgtacaacacgttatggtttattaactttctttcactggccttgtttaattttactctcaccttatctttttagggttggtgacattattctgattttgcagatgaggaaacagaagcacagagacgttttgtggcttgctttgctgtccttaggcagagaggagtctgatggagagttaactatagtattctccgtggcagatggctgtgcctcctgtccagggcaatttgccttagcaggctggagaacaaagagcactgagccaagagtccttggccccaccaccttccatataacctgaggacttctgtttcctcaatatggttcttggggtcgtttttaggatgaattgggttttgtgagaattgtgtattgccatgcaaatatatgttatgaataatacctttgaacagtcattcttcagcttatggaagcctatccatttaaggtagaaacttaagatgtatctttctcctccctgtatttggtaaagttaggagctagggcagcatagttgaaatgaattaaaagaacttttttttccatttttctaatttctatttccataatataagtacccattcatggaaaaataaaaattaggtaagtgatagaaattacaaagaaagttacaaatattcaaaatgcttcagtctaccaaccttgaagaataaaatattttcctattcaagaacaaagaatcttgtggttatgttgatagagaaaatatctttaagccacactttttaaaagtcatgcaaaaataagctctgaggtttatttgttttagtgggctgtgctccactggcatccttcctgggaacatcattcttctttccttttgttttcccctgaatttttgagcataggtttacagtttgaagggggaaaaatattttcagcttacatttactgttttttttttttcagtaataagaccacataaggttgagatccaggtatgagaaagcttaataaaacttaatgtcttggttcttgatgaccagccagtgcacatgccactaagtaagtgagattcatcctctaaggattcacagtgaatctttaaccctgcccttgagaaagtattaaagaagatccagagacgggagcaaaacaaaatacacaaccagagacactgtgtgctgtcagcagcaggcatgtactggtcaaggaattagatgactcaaggtggtgactcattcagcaactatgtagtgtttgcggttgaagagaaaccttggccag

SEQ ID NO: 64 - DNA, 8239 bp, Homo sapiens
gctcctctattcctagtaacagaatcattatctcaccaaacctcaagatttttaacctcatttctcatttagtgttaaagaatatatgtcacatctaggctgtttttcccttttcttgacaagatgtcttaggtaaagagatcagtgaatagcaaattatggtggtttcctttttttttttcctgctgtttgctaacaaagtcaccattcacgtaaactttagggctattagacatgattcacccctaacataccatgtagctttattcgaaaagtaaatggctccagcctgggcaacagagcaagactctgcctcaaaaaaataaaaataaaaaaacaaaaaaaatacagctgcttaatccttgattttagttataatttacaataatcattacctgcttaacctctggatcaaatgcctgctcctttgctgaaataactgtgtacagtgtatatacaaatatatacagatacatatccacaccccaaaagtttcttcattggctgtctatgagtttaggctgtttaaataatttgcaacacattattgtagtaaatagaataaaattatatgcagattagctctttcttttcttacaaaatacagcaacacatacatgctaggacaactttgcaaaaacttacttattctgtgcctttccagttctgtcactgtactatagtactacaaggcaggttaggcaacaattaggaaagtttcagaaccattagtctcacaaactttcatctaggatgcctctggtggcctctgaagagatcttctccaaaccctcatctgatgctattgcaactaagtagacgaactacggttctcagaatatacacattaataaggctctttttagcttcacccttttcacttctgtgctttatgatggactacaatactcataatgcaatactacagcccctatcattgacactatcatttccatcaaacacaaagaaacctccttctggattaccaaaaactaagaaatctgggccaggcgcagtggctcatgcctgtaattccaatacgttgggaggcggaggtgggcagatcatgagggcaggagctagagaccatcgtggccaacatggtgaaaccccttctctactaaaaatacaaaaattagctgggcgtggtggcacatgcctgcaatcccagttactggggaggctgaggcaggagaattgcttgaaccagggtgtcagaggttgcagtgagccgagatcaggccactgggcactccagcctggcgatagagcgagactctgtctcaaaaaaaaaaaaaaaaaaaaaaaaaaaaacttaagaaatctcttagttctagtgttatgagaactaggagtaacctgaactcagaagttgtttatgagagtataaactggtacattcactttagaaagcattctaaagataaacatgtgcacatccaacaattacgctcttgtttttatatcctcgtgacatgaacaccaaaagatatgcaaacatatttataacagcatttttcataatattaacaaatgcaacaacccaaatgttaattacaagatgactgtgaggcccggcgtggtggctcacgcctataatcccggcactttgggaggctgaggtgggcagatcacgaggtcaggagttcaagactagcctggccaatatggtgaaaccctgtccctactaaaaatacaaaaattagccaggcatggtggcgggcgcctataatcccaggtacttggggggctgaggcaggagaattacttgaacccgggaggtggaagctgcagtgagccgagactgtgccactgcactccagcctgggcaacaagagtgaaactctgtctgaaaataaataaacaaacaaaagatgactatggtatattcacacaacagaatttcacacacagtaaaaacctaatgaactacagttaaacacacaacatggatgaatctcagaaaccatgaattttaaaaaggaagtcacataaggtcatatgcaataaactatcatatttgtacattgcaaagaaaccagtaaaatgaaacattattatttagaaaaataacaatgtaattttacttatttcattttattttgagacagggtctcttgcccagacaggtgtgcagtggcacaatcacggctcacaacagccttgacctcccagctcaagcaatcgcaatcctcccaagcagctgggactacagatgtgcatccccacgcccaactaatttattttattttttgtagagatagggttttgctatgttgcccaggctggtctcgaactcctgggctcaagcaatctttctactttgcctcccaaagtgctgggatcacagacatgagacaccacaccaggacccctggtaattttgaaaaggaaaagtgtttaaaaacagtttagtgggagtcagggagatggactgaggagtacacatttagcttcaacaggactggtaaagttacaattcttaagttgggtaatagtaggcttattcgtttcattaagctttaaacatatgtgtatgtgttttgagtgtgtatcatctagaatctctggaaaactaacattccagctaatcataaggtgacattcctgataactgggaacgatgccaaggaataaaatcactttattattactatttgataacttttgtagtaagaaaatgacaggtgcctcgaaaaattaaagcaaggggtgggtaagggaagtgagtgtggctaaaaaagcaacatgaggaatccttatagtgctgaatatgttctttatcttaactgtatcaacataaataccctgcttatgatattacaccatcgtttcaaaagatgttaccattgggagaaacagggttaggtgtatattagatttgtgttatttcttccaactgcatgtaaatctaaaactacttcaaaatagaagtttacttttaaaaacaacaatagaaaaaggtccttttagtcctggatttctccaccttggcactactgacattttgcagcacctaattatttcttgtgggtctgtcctgggaattgaagggtagcatccctggcctctatccactaaatgccagtaatgtgcctccattcgtgacaaccaaaaatgtctccatacatgccaaatgtcctcagggggggaaaattgccccagttgagaaccagtgctctagtcataaaagccaagaagagatatgaaaatgttcctaattgaagaagatgaaagagatataacaactaaacgcaatacttgatcctggactgaatcctgtcctggagggtaaagaatgctataaagaacattattaggccaattaacaaaattgaaattaaatggtagattaaataaaagtattgtatcaatattaaatatacctaagttggtaactgtagcgtacttacgtaggagattactgctatgcttaggaaatacatactgaagtatttaggggaaaaggatcgtgatgtatgcaatctaccatcaaatgattcagaaaaaaatatatagaaagatatatacacgtgaatagtatatatatctgtgtgtatatgtatttaatgtatatattgacatatatagacatatctacgtagcaggtggatctgattaaagagtatgcaagtgtgttctttgaactatattatttttgtaacttcgctgtatgtttaaactaattacaattcaggtgtggggtttaagtggaagaaaaaaaaaaaacttttggccgggcacggtggctcacgcctgtaatcccagcactttgggaggccgaggcgggtggatcacgaggtcaggagattgagacgatcctggctaacacggtgaaaccccgtatctactaaaaatacaaaaacaaaattagccggacgtggtggcgggcacctgtagtcccagctactcccgcctgggcgacaaagcgagactccgtctcaaaaaaaaaaaaaaaaaaaacttttataaatcctaaaggcaggtttcacagcagtagtacagcataagtgataaacatcccaagaagataatgactactaacgggataaattcctacttcaaccccaagacattcgttggaaagaattatctaccttcagcctctctctctctccttgcctactttctggaggtgaccccctgaacagtgcgggacagaaaattaatctatcccattaaaaaaaaaaaaaatttctaggaagtgactcaataaacctacatctccgctcgatttctccacaaatcactgaggcatcttcatcctcaacaattaagaagcaaaatcgaggaaagcatacaagtgtttcaaagaaaaccacttatgcactcagctgagcaagaacgttaagtggactagagaagagacaacacggaatgtctaggaggagtgagtaaaaaggaaggactaaaaagagataaatcaggagccagtctgagagagctagaatgcgtatgcccgccagaaaaaaaagtattccaatgagtgcgagtgtgtcagcgggagaggggtagctcacctggctgtggtaagcagagggtgctgagtgcccaccagcttccgcacctgcatagcgatgttgctgagctcgtcgctcagcaggcagcgaaggctcatgaaggacgtggggtaccccacgatcttctccgcctctgacactacctgattccagtgggccggggacttggaggaccgaccacgccaagagcccaccgaggagatggtgtcgagggacggggaccaccacaggcgacgcggggaacccgaggctccaagataacgtggcaagtgcaacagcagctgccgaaagttcatggtttgagtctggaagggtctgggacctgggggtatccagaagtgccgcgggaaacaaaccaggggcagaggaggaacttacagtaactaaaaggaagcggcaattcttgaccctcagagtaaggtggcttcctggagcagtgaccagaaacgaactttaactgctgctttctgcagcccaggctgggcaaacaacagtcccagctcagcactgcccccggccacccggggtagaaaccacagccactgcctatgtggaggacgccatattggaggcatggaatgcggcctgccgtaaagacagaggcgggttgttaagtatactctctactttacggcgtacccgagaacgcccccgcaggggcggtgctttggaggtgaacccgggttgggaggttcagctcctcccaccccgccgctctgggccagcaaaggtcgtcagtgacagggatcagttgtgggcggcgagtggtccctctgcacacggtatctgggccgagtctggattcattagagtccccggcgcccagcactgagtggcatgcataagtattggtgtcacgaacaacggtcagcccccggcttgcccgcaaggaagggcgtcgggcggaggcaccagttcctcccggaagctttttgtcgctatcgccaccagcccctggcagtggcagtggccgtggccgggcgtgaaggcggcctctcgggctgcatgcctcctggagctggggccacgtctcagtggtggaacgcctagtcggggcgtggggctgagccctcgtgtcctcagggcccaaccagacataaggcagcgtggtgcggcggaaaggggtcccaaggaaagtcctcggatccaacttcgaattaccggcctcctcgctgagccttgggagaaacagcggtgcctccttcccgcgggtgcggagaggaagaatgaaacgttgcctactccctgcctcttatcttcctctttatgcctagcctggagctcaactccaggattgaagactatcgctgaccggagtgcttttcacgtactagttcatgtattactttatttaatcctcagaacaacctcattaagtagataatattagtattctccgtgttttgtatgaggaaactaaggtgcagtcgagtcgcgtaagttccctaagaccacactagacagggatgtgagcccagacaatctggtttcagaatccgtattctaaccgaaagattacaccgtctaaataataggctcccatccactcttttctccttattgctgagaggaaacagtcaatatgattatcttttaagtaatgctacctatttttttttcaaatgtgcctaagatcttacctcctttcttatcacctaaaacaggtgttaaccgttcttaataaaggatatattatccattttttacactcttaaaaatagcttataaaactctctaaaactttcaaaatccttccaaattcatggtattttatttttattttttatttattttttgagatgggtcttgctctgtcacccaagctggagtacagcggcgcgatttcagctcactgcaacctccgcctcccagtttcaagcaattcttgtgcctcagcctcccaagtggctgggactacaggcgcctgccaccacgcccggctaacttttgtatttttagtagagactgggtttcaccatgttgaccaggctggtctcaaactcctgacctcgagtgatccgcccacttcggcttcccaaagtgctgggattacaggtgtgagctaccagctaccatgcccagcctgtcagtattttttaaatgagcatcatgcataatactgtaccagcctcttgagctacaaataaagattgggacttaaagagtagttgttcactttgcaaaacaagatgattttctctacaaaagatttagcttcatactctccctttggcaagttttccttgtgatttaaattttttatttacaaaaattcagtttaggtgtaacttttcaggggcacattttatttaacatgaattgtgattataagtatcaaacacagtctatgcccttaaagtaagtaagctgaagtttgaaaataattcctgtgaaagagataaactcttggcaacaaaattcaggtctgttaggagatgaaaataaatatggagagtgagatactttaccattccaggagatgaaaataaatatggagagtgagatactttaccattccaaaaagttccaaggccagagcttctgggttatccaaggtgaaagaagtcatgaaaatacaaagatagatagagactaatgtgatatattgtgcacctgaggctgtttcttcagcctcatggtaccttaagggtaacttttcacgcaatttcctcaatagcaattcacagcatgtactttaatttctccacagaagccaagtgcattattctctggtcatactctattaaccaagtttttgattattcatgggactttgggtcccatttactttaaataatcagcattttcctttatacttacagttaaaaggttgcattatacttaatgataatcagtttttagaaggttaaaatggtatttgttctttaatctcccagataaatatataattccttagagtctttatgattaaagaaatttctgaattgctagtgacttttggagaaacagggagggggagtatctgtgattctgcccttcctctgccactgataatagttatattaaagatgtctgtgaatgtgtgcataaagaaagaatacagcaggatttctcagccttggcatttttggcgttttggaccagataattctttgttgggggaaggggggcagtcctgagtattgtacggtgttgagtagcattcctgacctctacgtactagatgttaagcagcacccctttccaagttgtgacaacgaggtatgtctccaaacattaccaaatgtctgtcaccctggagtgcaaaattgcccactgggaaatgggagatgctgaaagaaaaaaacagtgtccatccatgacatttactcctacaaagcagcaaaaaagaagtcctgggtgtgagtagccctgcaggttagagagtggtcactccacaacctatggaaactttcagccacactcagggacttccccttggcatcggagttgttttggagacagcacgctgacaaaaaatgatcacagttcctcctctacctttttcaggattctgaagcttataccagtagaactcactgggcactctgcattctactgaccttagaaagaagtaaggtcatatttgatgtccttttctttggctggaaacccgagccagccttggaaaatacaagctcttaacaaggatagtgctgtgggcgctggcatttccatgattaggtgagtggaaatagatagagatattgcagccaccc

SEQ ID NO: 65 - DNA, 3876 bp, Homo sapiens
aatctaactgctattaaacatgcaatatattctgcccttacatttttcagccatacctcatattcataaatgggcagattctatggctgacaggaaagtgacagatcattcaaaacatacactttaaaaataacaagtgattctacagacctgctgcttatgaattagacaggcaagccacttatcctacataaatttgtttatgcatctgtaaatttagaatagcaagtgctgacttccagaataagggttagaaacaataatgaatatgcgagcaatttctaaattttaaggttatttagaaacacaagcattttattataaatgctagtcctggaaaattgatgtcatgtttgttatgggacttctattacctcaaagtcctttccatgtcctatcctaaatcgaagagcctccagtgacatgtcttcccgaaccttctatttttctttttctttctcgtctgcatctgtttctaacagatgatgtaacacttacatctctttaagaattctgctgggctgcttagcaggctcctctgaccaattttattgactgttgagacagatttgaaaaaatctgagttttagaatcaatattttaaaacgcagtacctttccaaaactctgtaagctggcccacagctattatggttgataaagtgctgactcacacctttttttgtggaagaaagaaggccgtatgttttaagagacacagccattagattttttcataaatgcaggtggaatctccactttgaaaagtaaatacctccagcatccccccaaaccaatcatttcatataactggccatttttacaagactccaaatacacattcagggacaatttagaggtggaaacctgtgattgttcaaaccatttgatcgctttttcttttaaggagaattaaggcagagaaatctgctctgtcccaagctcaggtgggataccacgctcagagtgggctctttaggaggactccatgcctgcaacagctgccaacagggagcacgcaaaacaggtcatccaacagccacatttcagggaatcaggggctcgctggcggtttccagactgttctgtactctcacaaaaagaaacacaaaccaacttactgtggattcgagccagtcgaagatatgcttccaagagccagagaaaggcaatgaggtgatggcgggacttccagcagtgccacagctgggcgtgtgctcacttaccagcttacatactgcctgggtattgtttatggccattgcttttctatgtgaacgtatgatgagggttgatgtaaatctatgtcaaccatataatccaataaagcaggagctgtgttttattaaaaaataataaaattaaagtactttagggataagctcatggtcttgggagaaaatatattttctcagtgcctcaatttctcagtccatgaaatgggtgaccagataccatgatgttataaggtgttgtaagacagaaaaaaaaataaaaattcaaatttaactggcattcaaatcacctgagtctcttgttgaaaagtaggttctgattcagcaggtctggggggagatcagatattctgcccctctaaccagctccctggtgatgctgaggctgtattctggggaccacacggtgagtagcagggagatagaggagaacgctattcctaggcagcatagtgttttatgcttcctagggttgcctagtcagataaattgaagaaaaggaactttacagtgaaatataatccaaatgccataagggctatcaaaaggcaaagtgcattaaaatattttattagaaacaagatagaacaatgggaagacttgagtaattgtttccagtctactttcaatgtgtttcctgatgaccaacatccaactcatttctcctggctcagttcagctagtgaggactaagcagaggtgtgttattcacacctatttagatgctgtgtcctggattgtcgagcacagccctcattttaaagttctgcttcatcgctccttttagcacattctattggatcataaatccttagttctggttcagacaacatggccactatgttagtttaggctgtctcactgctctaacagctacggtttcgccttatgctggctggcgtcgagttggggctgcacactgtccttcggggcccagctctcttcttcctagtggctctgctgttccctagagtctcaagttccttgggtcctctgcatttgggtgatgttttagagaccaggcctgaaagtggcagacatcgcctcgtctcctggtgggagcccagccccatgactcccctgactgcagggcacgcagagccagacacagggccaggagggaaggaaacacagcattctctctgcccggctgcccatttagcactaggtggattattaactctctaaacaatgaagaacacactggacttgaagagtgagtgccaacagggaagggaagggatggcagcggaacgtgagctcaggacaggctctaagctgggccttgggacccatctcttgcccagggaaagggggtctttggagaactgttagctccctcagaccaaatgcattcccaccacagccgaaaggcctcccaggaactagagcagtccacgagtgaggcccgggaagaggagtacaggacagtctgcagatacagggggtctcaggtgcagctcagaccttaggaatctgaatattcccccaaggcccattccaccccatccatgcctgacaaaaacactccgcttcttgatgaggaaggaatcattacccggggcccaactggactgcccccaggggtgtgtgtagggggtggggggtgagtgtggttgtgtgtgtgttgtgtgggggagtgtggttgtgtgcggggtgtgtggttgtgtgtggggttgtgtgtggagtgtttgtgttgtgtgtggtttgtgtgtgtgtgttgtatgtgatggtgtgggtgttgtgtgtgatggtgtgtggtggtgtatgggatgtgtgtgtggttgtgtgtgaggtgtgtgtgtggttgtgtgtgggtgtgtgtggttgtgtgtgtgggtgtgcgtggttgtgtgtgtgggtgtgcgtggttgtgtgtgtgtccgggaatggcaggagagggccgtcacagttaatgtatatgttacactcagagaagactcttaccaccaaagctcaattatttttcaaactctaaatgcagacaatgtagccatatggaaaaattggttgatgacaacaaaatggtttgttgttgttgttgttgttgttgttgttttgtagtttggtagatcatctctatctggccgagtattgttcaaaccccctcctgagcctcagccagggactgctctagctcctggaaggccacgtggctagcgttggaatggatttggcccgagagagctaaagattctccaaagagaatctttgtcacaaatatgttcctttagcaccaacttacatgacatgactttcgggtcaaatgcaggtgacaatgaccggtctgtgcgtcacacagggttcccaccgtctgcttaggttttaaggtgaaactgattctaatgatgttttcagtctgtgtggttttgtgtgtgaaactaaaggcttgctctaagaaagcacatggggctgaggcaggagaatggcgtgaacccaggaggcggagcttgcagtgagccgagatcgtgccactgccctccagcctgggcgacagagcaagactccgtctcaaaaaaaaaaaaaaaaaaaaaaaagcacatgggcgggctaatgatgattttgtctctgagtttgaaggaattcagccagtgggcggagggaaagtcctcattgtagaaattaaatttatatcccaagga

SEQ ID NO: 66 - DNA, 27445 bp, Homo sapiens
ctcttcaccctagtgataggtgttgtgttcatccttatagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagagccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaaaagaggtggatactgagatctaagaggaaaggatagtcattcacgttctgagatatgcgctctctctattgttctcgtacacaaagggatagtctcttttctggagctgatgtccctgcttggaggttagccccaaaacatggctcttgtattgttctaagagaaaaggctttcattttggttcttctgattggtgttacctactgcctaatatgtgttcattttttgacagagaggcagactattgaaaaagtctgtgtgaacagagagcagttcattaagcccattgctttcagtaatgtggccttgaccccttctgcttcccccttctcccatggagcatggcagggcttggttatttagagtccatacatgcaagccattgagagacttgtttgctcaaatgcaagtttgctcaaaaacaggtcctgaaggcttgcttaggattacagggatgctgggtaagaacaccgttcctctctctcgctggagaaatccctgtttctctgactccctttgtgatcctcacagtaatgtattctgtgccactgtaggacacaaggctctgggccagtagaacaggcagagaggtgacactgggcagcaagctgagagctctttctaaatggagtgaaggaattcagtggcctagtttcgccattctctaatgagaaaccaaggccaggctgaaaagtgcaattagatgtggtggattgtggtaacggcctccagataaaggggttatccctgtggaagtgacttttccccatttgatcccttttcaactctaaatggccaggcccagaacagaagaagggttgggtctggaaggaaggctccaaaggatgaaagcttctccctgatcataaggaagtgcatctttatagaattgttgtgcataatgtcagtaaatccctctcacttgacaagggactggattcatcttgccttgagacgggccagtagttatcagtgagtcaaagcaaagtgaaagtttcaggagatgggaccaatggtgcaatgctcgccataacaaaattccttaaaaataaaaaagctaatgttatagcaacaaaaaaagactgaagcaaaaccacactgaaatgcatcccactccaggagaggaattcttagcgtaacactctaaataaatggaaggaatcatcaccttccttattttacctctgccttgttcaccaggctgcccagtgcttaccatgcagaaagcagtcagctgtactctggaagtttctgttcttctttcctggggcttaggatattctgggagctgtctgagccttgtgcctaaggcttatcaggtgatataatcttcctgttctgggctgcttgctggaggaataggaagtgacatttataagacacaggcggtgtgagcatccatgtgtggtcttggtctaaaccagctcttgaacaggttaaagcaaacagcaataacaaaacaaaaactactgatgctgagcgttttgatcctagtaatatttcaaatattgtccttctgcatatgttctatccatatttgattccaatatacattattaagctttcttgggtactattttgctggggctcttgcgtgaaggtggtacctgtctcatgatccttaaaagagagaggcttttttcatccaaagctgtagtgttgggaactggggtgggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcctcttgaggacccttctagagttactctagacttgtccctgtttcatgtaggcatgtgcccaccccagcctaggcaaaatctctgtcctcttcttttgggagttctccaaggaaagaagagactgcaggtgcagtcacgtgtgtggctcacaaccatgtcaggtagttctaaaataaattcctcctgtcatattaccacttccttttcaatgggggaaataagtagctctaaatttatgtaagcctcagtggttaagacccttccttaagaaaaatggacgtaagttgcccttcctttgaaagcagagcttgacaccttcctggctaatgagtgtcctcatcaagatgccccctggagtcacatcatggattaacgcagaaaggtgagttctgaggctctgagtagcttcataccctccaactgcttcccttaaacctctgattattctggcttttaaacaaaagcactgtatcatctgtgccaaatgtattccctgactaattactgagtacagtcacatagttatagtacactaataatacaggctggaaactgaagctcatagaagtatgtagtttccccaagagtgcagagctagtaagtggaagagtcaggattcaaacccagagcccctttctgaaatcctcagaggtgttcaacagcatgatcctcccttcctcttgacagctcgtatcctcctcctgaggtttagggcttcactctacctgacctgtgaagatttgaaagcacatatctaggacaagtattagaaagtcttcatacttcaggaaaggattttaggaaaaaaggaaaaaaaaaatctcccatagatgttgtattagtccattttcacactgctgtaaagaactacctgagaccggttaatttataaagaaaagaggtttaattgacccacagttcacatccctgggaggcctcaggaaacttataatcatggcagaaggcgaagttcagaagcaaggcacatcttatatggaggcaggagagagagagaatggggaggccaggcatggtggctcatgcctgtataatcccagcactttgggaggccgaggcaggcagatcacgaggtcaagagattgagaccatcctggccaacatggtgaaaccccatctctattaaaaaacaaaatacaaaaaaattagctgggcatggtggcgtgcacctgtagtcccagctactcgggaggctgaggcaggagaatcacttgaactcaggaggcagaggttgcaataagccgagatcatgccactgcactccagcctggaaacagagtgagactccatcccacaaaaataaaaaaagagtggggaaatgctacacttttaaaccatcagagctcgtgaaaactcactatcacaagaacagcataggggaaatctacctccatgatccaatcacctccctccaggtccctcccctgacaagtggggattacagttcaacatgagatttgggtggggacacagagccaaaccatatcaaatgtgtagtccttatgtagcccctgtgttaagggggtagatggggctcccgatttactgaccttcttagtgagggacacatatccgctaggtgaaggaggccctgttcacaggatgatgtatggagtatgacagagtaggtgagtcatggctccttggctagaccccaagggtgggatgatctggaaccacctgagttaatgacactcctgaagccttgcaggtatccctgcatagacaagctggatagcctacttccaacatcaaaagcataacagaatgggagactccttagtgtagttcaggggatgccatgtgcctggcttgggactcatggcccttggacttagatctctatactgccaagtgtcccgtcttcattcttgtgtagatgacctcttcactacttaattttggtttgttgaacttatagcctgttcccttagcttttatttacttacctttagctttcttttaattccttaccacattgtttttcctatcatgtactttagcttaatttctctgttttttaaacataattttaaactttctttctttctttcttttttttttttttgagacagtcttgctctgttgcccaggctgcagtgtagtggtgcaatctcagctcactacatcctccaccagctgggttcaagcaatcctccttcgtcagcctcccaagtagctgggattacagacgcgccaccaagcctggctaatttttgtatttttagtagagatggggtttcaccatattggccagactggtctcaaactcctgacctcaggtgatgtacccgccttggcctcccaaagtgctgggagtacaggcatgagccaccaccacaccgagcctagtagtttttgttttgagaaagaatagttaggtgcttttcttttcccttccccagtcatgtctacagtgatcttattagctgtgaacttaggtacctcattttttctcagatgaatacctgcttctaaaatctaaatgcaaagtaagagtgacagtattactataaaattcatagatgttcattatctaggtatattcaaaggacagaattttatgtcttcttccaaagtgtacccctgaccctccaccacaccacacacacacacacacatgaaataataaacagagcagccttaggaagagggcagttcaattcctggactgcaaaggacttcttctctcacacacttgtttttcctgaggaatgacatgatctggaaatcctaggtatcccccttctccaaccacttgacaccaggtggacacagagctgttgtacaccaggagaagatccagtcaactgtgggaaagactgaaccatgaaccatccagaaatactccgtaacaggggcctgtcatcagattatgatgtaccttttctagccacctctggcctctatgtcaaccttattcacacctcaacaaaccatgacttctgaggattctctttttttttttttttttttttttttgagacggagtctcattctgctgcccaggctagaatgcagtggtgcagtctcagctgactgcaacccccgcatcccgggttcaagcaattccctgcctcagcctcccaagtagctgggattacaggtgctcgctaccacacccggataatttttgtatttttagtagagatggagtttcaccatcttggccaggctagtcttgaactcctgaccttgtgatccacccacctcagcctcccaaagtgctgggattacaggcgtgacccatcgcacttggccaggattctcttaatgtaatacagaccctcatttcttccccgtatcatatgatcctggcagatggcccagccccagtagatttttggaatggaggtatccatacttttctcagtcattattaaaatcaagaaatagaatcacatagcaacacaaaacttggagcttgaccctcattaaaagaaacttacaggttcagagtccagttgaagaaatctttgtatctccagtatttttgtaaagaggtcagggtggtatcatgagtaggcttaagtccctacagtctttgtgaacttttataaatgccttgggtatccagtttctcaacatagcatcttcatcaccaactgtacctcagctgactgccccaagggcccacccgtgtgtgcacacgttgcaggtgtttactgtccctctcaccatgtcctcctccacctctcccctctgtttgtaactgtcctgtctttgatatttaaaagctagttggccacttctggccatgccttatctggtacctgttagccaaccatgacagtgatgccatacccaggactgtctgcttcttgttctcaggcaggtaggtgctctcagcactgatgtctcttgctttccaagtcagcttttacatctggcctgctaggaactggagagcattttcagtcttcatagcagcagcataggatcctgcaggctctgtatccacctaagttaaggtaaggtggatacacatcctggaaactctgtatctacctccacaacagctgcagaggatgcctgcaggatcacactgagcagacacactagtttcatcacactagtttcatcttctgcaccagaaaggaagaatctattttgcctggccaggcatggtggttcacacctgtaatcctatagcactttgagaggcagaggcaagaggattgcctgaggccaggagtccaggaccagcctgggtgacatagcaagatcctatgtccaaaaaaacaaaattcaaaaacataagccaggcagggtggtgtgcacctgcagtcccagatacttgggagcctgaggtgggaggttcacttgagcccatgaggttgaggttgcaatgagccgtgattgcactactgcagtccagcctcagtgacagaacaagaccctgtctctaaaataaaaagtaaaataaataaatattttgcttggaaaccgagttcaccatgagtttcttaacaaaaatatgaacttaactaatgagctgaccacatcgctattagatgaaatgagggtggcattatttactcagcactcccaggagtcaaggcagaatgtaattgcttccagacatattcaggggatattccacccaattatctaattttattcttcaaaggcggctgtatttggaaactcccattggtccagagagacagaacaatgagaagaaatcccctgtccagttgcctgcaggagtattccaacacttcatgggctagaggattccattgagatggggtttacgtcttgattttgaacacctgtcagcactgttctctgtttgcatggcaattctgacccttttatggcaacaacacccctgggacaacccagatttgtagattgagatccaaaggtagaatttccagacagtccaaccaaggtatcaagtgatgtttccagagtggaaggctctcaccgtgtcccaggatttctggggtttgtaagcagtactggccatttgtgaccctgttttttacctaatcattctgtctttttaggacatggttttacccgatccctggcaaaggatccagaattccaatagctgaaaaccctgttatagcttttctcctattctgccttacccaagacacacttgaacccctcagtaaggctatagagagggccatgagcaggggcagcctctcccttgtttctacagctccatgatgaggggttgactgaggccagcaatccttgtaggtgtgacagttgcaatataattaacagtttcaagatctagaggtaccttttgaaagaaccccttcagggatatctatccacagtagcctggagcagccaaggtgaacctgagattttgacccacacaataagggggggccattctttttcaaatattttggcttcagaatacacttcattacacatgcaaatattgagagattaacagaaattccagctcttatgcctaactgagaagagccactgcaagttgcagttaggtacccatgtgcagcagaggccagctgaatcccagagcttcccaaagtggacaccagcggggactattcctgatgtcccacccaagagaggaagatgagctgaggcgctgttgctctgcccaaatgcatcccatgtgcattcacgtgtcacccattcaaaataacatggcattcttggaaccttgtatctgacatgtaagaccagcctacacattggggtgggtgcaggggctcacacttgtaatcctagcactttggaaggctgaggtgggcagattgcttgagcacaggagttccagaccagcctgagcaacatggcgaaatcctgtctcttcaagaaataataataataataataattggctgggtgtggtggtacatgcctgtagtcccagctactcaggaggctgaggtgggaggattgcctgtgcccaggaggtcgaggctgcagtgagttgtaataaggccactgcactccagcctgggcaacagagtgagacccagtctcaaaaaaaaaaaagtctacaccgtcattggtcattgtctccttgggtcatctggcctgtattgtatttaggatcatttgtattaggagatagaaatcacagagtaatttgaataacttatacctttaattagagaagtgagggatcagcaaataaagataactataaagaaataggcaggtcaagaaaggggctggagtaaactggtgacattttgggctagccattgtgggagtgagagagaggaaactgcatgaggacaaacagagtaactgccaagcagcactgaggacctggatgaagtgagaaaaccagctctgatgagttgtagtaactcagatcagatcagcttttcatttgtctcacaaggctcagcgatcagcatgagagagcgagaaagccagatagctggggggtcctggcaagatgacgagtagaggcagtgctcaagcagtgagcatcaaaggatggggctaacctgcaggagtgtggttggaatgatgggacctggatgaagtaaagaagaaataagacgggccagtttctggactcagcaactgggaaaggtgtacaggtccaaagcctgatagggtctgaaagcaagcttatgacacaagggtgttgagggagtgagatgatggtcatcagatgcggattctacaagactggattttggatgggatcaactctatctaactctatgaggggaggtggcagttagaacccagaaggtgagaatatcaaatgggccattgttagctgggcgtgatggtgtgtacctgtaatcccagctacttaggagactgaggcaggagaattgcttgaacccagggggtggaggttgcagtgagccgagatcacgccactgcactctaacctgggcaacagagctagactttgtctcaaaaaacaaacaaaacaaaacaaaacaaaatcaaatgggccattgtcatggatgtccagcatggagacccactatgtgccaagtgcccacaaactattggatttgaggagcaacctggaggtcagtgggtgaccaaaatgaggaagggaatggctggaccacaccactgttggctagaaatggccgaggagtaattgtgaactttatagtgaacttgagtccaagctgctatttaactgtccaaaaaatgaacaagcatcatgagctgaaatagaatgtaaagaaaaataagaggcagaaatcagacttttatttcttctagtttaggctccaaagcttgagagaagtaatacagagggcttgatttttagaaaaccttagaaatgattaaataggtcaggcgcggtggctccggcctgtaatcccagcactttgggaggctgaggtgggcggatcaagaggtcaggagttcaagagcagcctggccaacatggtgaaactccatctttactaaaaatacaaaaattagccgggcatggtggcacatgcctgtaatcccagctactcgggaggctgacgcaggagaatcgcttgaacccaggaggcagagcctgcacaactgcattccagcctggtgatacagcaagactccatctccaaaaaaaaaaaataataataataataataatgcttaaatagatatgatcatattcagagctaaatttaaccagaatctaacattgttttccagatgaagagtttgagaaagccgactaactagcccagttgagtccctaggctagtgggtagcagagtggggacgtgtctgtgtcccgagcctcggcatgtccctgtgctgaagcccagggcctggttctgcactgtcaggttacccagatccagttacagaaaagaagccaaaacaacttgcggaaaataagtctacagaaaagataaataatagtactctaatgaatgaacagacttgtgacatctcttccctggggacagaacaggaggatacaggtttatatcccagcaatagggattctacattacaaggaaagtttctaactgggagatatgagatgagctacacaagaagaagccaaaacatttgcactcgtgctgcctttttatttttttgagatgggagtttcactcttgtcacccaggctggagtgcaatggcgcaatctcagctcaccgcaacctctgcctcccgtgttcaagcgattctcctctctcagcctcctgaatagctgggattacaggtgtgcactaccatgcccagctaatttttgtatttttagtagagatggggtttcaccatttggccagagctggtctcgaactcctgacctcaggtgatccatccacctcggcctcccaaagtgctgggattacaggcatgagccacccgccctggtgctggatttttgcttagtcctatcattttctgagtcccgagagttttcatatttggatgagtgaccagtctcaaagtcatttaagtcctgcctaacctccaggactgtctggcatcttccttctcttcttccttcccaggtggcttcaccctcacagtcccttatggtgtcaacttggtgccatcttaccaggttctccctaggctcccaaaccctcgctcctgcctgcttattctatatcaccatgttatttattttttaagtaactatgattatgttataggcttaattgtgatccccaccaaatttatatgttgaagtcctaactccaatacctcagaatgtgactgtatttaggaatagggtctctaaagaggtgagttaagatgatgccattagggtgggccctagtccaattcgactggtgactttataaaaagaggaaatttggacacacacacagacaccaagaatgcatgttcacagagaaaaggccatgtgaggacacagtgaaaaggtgaccatttataagccaaggagagaggcctcaggagaaaccaaacctgccaattctgtgatctgattttggatttcttttggtttttcatgcctgagttttgtattttttgtagagacggggttttgccatgttggccaggccagtctggaactcctgacctcaggtgatccatctgccttggccttccaaggtgctgagattacgggtgtgagccactgcgcccagcccttaacttggatttctagactccataaccaagagaaataaatttctgttgtttaagcaccacccccccacccaaaaaaaaagagaagaagaatataggccatgagcggtggcatgtgcctgcagtccaagctactcaggcagttgaggtggtaggatcacctgagcccaggagagattggtagaatgatttaatgaaaaggtggatgacagagccttgggaaatgtaaaaaaaataagtaaaataaaatacaacatgatccatccatatactgtctataagagactcactttagatacaaagaaacaaagagattgaaaacaaaagaatgaaaaaataaattccatgcaaaaagtaaccaaatgaggctgggcttggtggctcatgcctgggatgctgagacaggtggatcacctgaggtcaggagtttgagaccagcctgacaacatggaggaaccccgtctgtactaaaaatacaaaattggcggggcgcagtggctcacgcctgtaatcccaccactttgggaggccgaggcgggcggatcacaaggtcaggagatcgagaccatcctggctaacacggtgaaaccccgtctctactaaaaatacaaaaattagccaggcgtggtggcgggcacctgtaatcctaacactttgggacgccaaggggggcggatcagttgaggtcagaattcgaaaccagcctggccatcacggtgaaaccctgtctcgattaaaaatacaagaaaattagctgggcgtggtggtgggcgcctgcaattccagctacttgggaggctgaggtgggagaatcccttcaacctaggaggcaatgatccgagatcgcaccactgcactctagtatgggccacaaagcgagactcccccaccaaaaaaagacaaaaattaggcaacctgtccaaaaacacagcagcgataattagcaaagctgggattccaacccaggcctatctcacagccacagcatagtattttcttttttttcttgctgtgactgcaccttacgccatagatggcatccaggacgcagagcagtcagtatttaggtactgtttttcacattccttacatgggaatcacgtcaacaggattcaatttgtgactcaaccattaatactttgtgacactggctaatttattgcacttctgggtctcggttatgctttttgtggggggaggggagggcagggtctcgctctgctctgtcaccggagctggagtttagtggagggatctctgcagcctcaacttcctgggctatcaagcgatccttccaccgcagcctccccagtagctgggaccacaggtgcgcgccatcatgcctgggtgatttgtaaaatttgtttgtttattttaaacagagtctcgctctgtcgcccaggctggagtgcagtggtgcgatctgggctcactgcaagctccgcgtcccaggttcacgccattctcctgcttcagcctcccgagtagctgggactaccggcgcccgccaccacgcccagctaattttttgtattttttagaaaagacggggtccctgtgttagccaggatggtctcgatttcctgacctcgtgatccgcccgcctcggccttccagagtgctgagattacaggcgtgagccaccgcgcccagcaagtaaaatttcttttgtagagacagtgatcttgctttgtggcccaggctggtctcgaactcctggcctcaaggaatcctcctgcgtgggtcttctaaagattcagctgcttttggatcaaccgatcgccttaagaccctttaactcgaacaactgtcacatcctcggatccgcgaagggctgaaactcaaagagtttttgaagcgtccctcggcgcagtggctccgctccacctcccattcgcgctaccaccgcggtcgcagcgccaggatcgccagggggccagcgtcgctctcccgctgctgcgcgccggaagccggaagcagggactgagccacagactaggaaaggcaggcttctccggggctccccagtgccctagctttagcctggaggccgccctcttctatttgctcttagacgtcacgggggcaccccagtcccctcgaccctttggatccggctcacatttcctccggtgaagagccaaaggccccggaagtgacgtttgcacggcttgcgtatcgtgcgtgcgcaggccgcgccgggggcggggctagcaggagggtgtgtgtggggcgggagcggacaacggagaccagacctactgcagccacgcgggcgagcggctgtgtggatgtcggcgaagccgcgggcgaggtacggaacggacggactggtgtaagagcgtcgcggctctcagctacgggagcggggcggccgggcgtctcgggccgtgggcggcggggcggtcggtccgtgccctccgcgcggctggggcagttgcgcgtcggtgcctcccgctgtccttcgtcccacattccagccccgtcagctccgccttcccagttccaggccgccctcggctcccttaatcctcacagtgcgcggcttctccgtctaacgtgctcgttgccggcatctccagcgcccggacaagcccttgaaggcctgacgcggagcatttcccggccgcctccctcttcggcggctcccctcgtcccggctctcacttccccgtccaggacgctggctccgaagcaacatttgtggtcgcgcggggcccctcccatgacctctctggaacgcgcctagctgggacgctcggacccagaccacagctcttggccgcgacaggggcgccgggacttgatcccccgtcgccctggggggacagaagcgtcccggagttgggaggggatttgaagcctgtggtcctgacttccaccccgtggctgagggcgaggctgcagggctggggttaggagcagaagtccctacttccgaaccgtctgggaggagagccgagagatgtccatcacggcagtttagggagagagagggagggactctgccgctttggaggctaggtcataggcagctggcggtgtctcagcgcgggtgaccagtccttgcggttgggaaatgtgtcgtgggcgcccgtggactcgttttgcctttgagattaaataggaaattttcccaggacgagtttaccggagcaccttgggagttggtttttggcttggagagctactttccccccctaaacctagaactgctttgtttttctttattatattttttgagatgggatctcacaatgttacccatgcaggtgtcaaactcctggccttaagcgatcctcccgcctcggcctcccagagtgctgggattataggcgtcagctatcgcgcagctttaactgctgttaaagagtccgttccttaaaattgttgtaccaagaaacttgccagagatgcaagaaaatgtgattatattgttaatatttaatgataaataacattttgcttttaagagttactgattcatatctgcaggattaagaaatgttcaggatttgaatttttaatgaccttccaagcagtcatgtttctactctctagaagttagccagttgaggagaagggacagtcaagatactttcaaaacagtgtggtaaggagtgtgagctaagatggagcaccgaggagggagtcgggcatttaggccgtgctgtcgggcgtggagcctggaagggatcggggaatactttctgcatgtgtcttgaagaatgagtaacattcagactaacagggtggaatgaggggaatcaaaggagaggaggccagtaactacaaggaggtgcttatttatttatttattgagagagagggtctcactttgtcacccaggctggagtacagtgacacgatcacgagtcactgaagtctcaactgcctgtgctcaagggatcctcccacctcagcctcccaagttgctgagactgcagatgcgtgccaccacacccagctgatttttaaatattttgtaaagatggagtcttggtgtgttgcccaggctggtctcaaactcctggactcaagcaatcctcccgcctcaagtctcccaatgtgctgaaattacaggcatcagctactgagcctggagggtcgttattaaagtgaaaaagtgcaggacagagatctagaagcttaggctttaatctgatggtgacagaaccagggaagggtttttagctgggtccctgtgtggttaaaatgggtctctctggctgggcgtggtggctcatgcctgtaatcccagcactttgggaggccgaggcggtcggatcatgtggtcaggagtttgagaccagcctgagcaacatggtgaaaccgtgtctctactaaaaacagaaaaattagccggctgtgatggcacctgcttgtaatcccagttactcaggaggctgaggcaggagaattgcttgaacccgagagacagaggttgtggggagtcaagatcacgccattgcactccagcctgggcaacaagagtgaaactgcatctcaaaaaaaaaaaaaaaaaaaaagtaaccaaatgagaccaggagtggccacatgttaggcacaataggttttaagccaagaatggttatgagagacaagggaattctatactgataaaaagtttaatccaacaagaaaatataataatttaaaacatatgtgcctaacaacagagcatcaaaacatatgaagtaaaaaaggatagaattaaagggagaaatagagtttcaggatgatcattggagacctcactacctcaatgttaataatacagagaccagatcaataggaaagagagcacttgaacaacatgataatccaattagatctaatggtcatatgcagacaccaacccaacaacagcaaaatacacattcttttcaagagcgtgtgggatattgtccagagtatacagtgtattaggctgcaaaacaaatattaatgttttaaaagtttgaaagtatgcaaaatactaagtattttctaatcacgatggaatgaaactagaaatcagtaacaaggaaaacttgaaaactcacaaatatatggaaaataaacacactcttgatcactggttggagatgaaatcatacaggaaattagaaaacactttgagatgaatgaaaatgaaaacacaacataccagaacttatgggatgaagttaaagcagcgttcagagggaaatgtttagctgtaagcatctacctttaaaaataagaaagccagcagtggtggctcatgccaacatcccagtattttgggaggctgaagcgggaggatcccctgaggtcaggagttcaagaccagtctaaccaacatggcaaaagcccatcgctactaaaaatacaaaaattagccaggcatggtgatgcaggcctgtaatcccagctacttgggaggctggggcaggagaatcgcttgaacctgggagagggaggttgcagtgagccgagatagcaccactgcattccagcctgggtgacagagtgagactctatctcaaaaaaaatcaataaaaataaaaaataaaagtaagaaagatctcaaattagtcacctcactataccctctaaaggatctagaaaaagaagagctaaccccaacctagcagaataccagaaacaaagattagagtggaaataaataaaggaaattaagagaatagataaaattaaaagttttttttacagttcagcaaaattgacaaatttttagctagattgactaagaaacacaagaagactcaaatatccaaaatcagaaatgaaaatgaggccgttactgtgactttacaacaattaaggttatcgtaagagaatactataaacatatgtacaccagcaaattgaataaccaaatgaaatggcaaatctctagaaacacaaacctaccaagactgaatcacaaagaaataaaaaatatgggtaaaccaaccaggtgcagtggctcgtgcctgtaatcccagcactttgggaggccaaggtaggcggatcacctgagatcaggagttcaagaccagcctggccaacatggtgaaaccccttctctactaaaaatacaaaaatgagctgggtgtggtggcaggcgcctgtaatcacagcaactcaggaggctgaggcaggagaatcacttgaactgggaggcggaagttgcagtgagctgagatcgcaccattgtgctccagcctgggggacaagagtgagacttcgtctccaaaaaaaaaaaaaaaaaagaaaaagaaaatatgggtaaacgtataactagtaagaagattaaattaccaataaaatcttcccaacacagaaatacccttgactggatggctccaccagtgaattctaccagacatttaaaggaaaaattagtgccaatcctttgcaaactctttcaaaaacttgaagaggaggaaatactttcttttttttgtttgttttgagacagagtctcgctctgtcgcccacgctagagtgcagtggcgcgatcttggctcactgcaagctctggctcccgggttcacgccattctcctgcctcagcctcccgagtagctgggactacaggcgcccaccacaacgcccggctaattttttgtatttttagcggagacggggtttcactgtgttagccaggatgatctctatctcctgacctcatgatccgcctgccttggccttccaaaatgctgggattacaggcatgagccacccggtgcccggccgagaaggaaacactaactcattctatgaggacagcattgccttgttactagggccagacaaagacagtacaagaaaacaactgaccaatattgcttatgaacattgattaaaaaattctcaagaagacactgcctgctgggtgtggtggctcacgcctgtaatcccagcactttgggaggccaaggtgggtggatcacaaggtcaggagtttgagaccagcctggtcaagatggtgaaactctgtctctactaaaaataaagaaaattagctaggcatggtggtgggtgcctgtaaccccagctgcttgggaggctgtggcaggggaatcgcttgaacacgggaggcggaggtggctgtgagccgacattgcgccactgcgctccagcctgggcaacagagtgagactccatctcaaaaaaaaaaaaagaaaaaagaaaaaaaagaaaacactgcccaactggctggccgcagtggctcaggcgggtaatcccagcactttgggaggccaaggcaggtggatcacttgagttcaagagttcaagaccagcctggggaacgtagtgaaaccccacctctacctaaaatacaaaaatcagctggttgtggtgttaccctcctgtggttccagctacttgggaggctgaggtgggaggatcactggaaccaggaagttgaggctgcagtgagccgagattgcaccactgcataccagcctgcacgacagagtgagactccatctcaaaaaaaataaataaataaaaataaaaaataaaagaaagatctcaaatcagtcacctaactatacactttaaaggacctacaaaaagaagaactaaacccaagctagcagaataggggaaacaaagattagagtggaaataaataaagaaaaggaaaagaagagaatagataaaattaaaagtttttttacaggtcagcaaaattgacaaatttttagctagattgactaagaaaaaaaaaaagaagactcaaatatccaaaatcagaaatgaaaatgagggcattaagctgggcacagtggctcacgcctgtaatcccagcactttgggaggccaaggccggcggatcacgaggtcaggagatcgagaccatcctggctaacacggtgaaaccccatctctactaaaaatagaaaaaaatcagccgggtgtggtggcgggcgcctgtagtcctagctactcaggaggctgaggcaggagaatggtgtaaacccgtgaggctgagcttgcagtcagccaagattgtgccactacactccagcctgggtgacaaagcgagactccatctcaaaaaaaaaaaaaagaaagaaaaaagaaaatgagcacattactgtgattttacagcaattaaagtgattataagataataccacaaacataggtacaccagcaaattgaataaccaaatgaaatggcaaatctctagaaacacaaagcctaccaagactgaatcacaaacaaagaaaaaatatgggtaaaccagctgggcatggtggctcccgcctgtaatcccagcactttcggagtgcactccattgcactccagcctgggggacaagagcgagacttctcaaaaaaatagaaagtaggggtaaacctataactagtaagaacattaaattactaattaaaatcctttcaacaaagaaatacccctgactggatggttttaccagtcagttctaccagacatttaacgaaaattaatgccaatcctttgcaaactctttcaaaaacttgaagaggaggaaatactttctaactcattctatgaggccagcattgccttgatgctagggtcagacaaagacactacaagaaaacaactgaccaatattgcttatgaacattggttaaaaaattcttaggaaaacagtgccaaactggttgggcacagtggctcatgctggtaatcccagcactttgggagattaaggcaggtggatcacttgagctcaagttcaagaccagctgggcgtggtggcccatgcctgtaaccccagcactttgggaggccaaggcgggtggatcatgaggtcaggagatcgagaccacagtgaaaccccgtctctactaaaaaatacaaaaaaattagccaggcgcagtggcgggcacctgtagtcccagctactcaggaggctgaggcaggagaatggcgtaaacccaggaggctgagcttgcagtcagccgagatcgtgccactgcactccagcctgggtgacaaagtgagactccatctcaaaaaaaaaaaaaaaaaaatgagggcgttactgtgactttacagcaattaaagtgattataagataatactataaacataggtacactagcaaattgaataaccaaatgaaatggcaaatctctagaaacacaaagcctaccaagactgaatcacaaataaagaaaaaatatcggcaaaccagctgggcatggtggctcccagctgtaatcccagcacttttggagtgcactgcattgcactccagcctgggggccaagagcgagtcttctcaaaaaaaaagaaagtaggggtaaacctataactagtaagaacattaaattactaattaaaatcctttcaacaaagaaatacccctgactggatggttttaccagtcaattctaccagacatttaacgaaaattaatgccagtcctttgcaaactctttcaaaaacttgaagaggaggaaatactttctaactcattctatgaggccagcattgccttgatgctagggccagacaaaggcactacatgaaaacaactgaccaatattacttatgaacattggttaaaaaattcttaagaaaacactgccaaactgactgggcacagtggctcatgctggtaatcccagcactttgggaggttaaggcaggtggatcacttgagctcaagttcaagaccagctgggcgtggtggcccacgcctgtaatctcagcactttgggaggccgaggcgggtggatcacgaggtcaggagattgagaccacggtgaaaccccgtctctactaaaaagtataaaaaaattagccgggcacggtggcagacacctgtagtcccagctactcaggaggctgaggcaggagaatggcatgaacccgggaggggcagtttgcagtgagccaagatcgtaccactgcactcctgcctgggtgacagagcgagactccgtctcaaaaaaaaaaaaaaaaaattgagttcaagaccagcctgtgcaacatagcgaaaccccatctctacctaaaatacaaaaattagctgggtgtggtgttacacacctgtggttccagctacttgggaggctgaggtgaaaggatctgggaagttgaggctgcagtgagactggggtgatcaggctggataatcctctctccctgttcccctcatttggctgctccagaccctgagaaacttctacctgtcccatgccagctgagggtgtctgaggagctgacatcaaccccatggatctcctgaactgtgctggaaggtagagacaggcagggaggcttcccaatgggtcaggagaacctgaccccacaaatcaactgatcttcaagagacaggatggagggagggatcattctagagaaccctgctccttgttcctccctgtggcaaaatctggcgccaggaagagtttgagtgtgtaggcgtgtgtgtgcaggtgtaagtgtgcaggcacgtgtgtgcaggtgtgtatgtacagccgtgtgtgcacgcatgtgtgtgcaggtgtatgtgtgtaggtgtgcgtgtgcaggcatgtgtgtgtaggtgtgcatctgcaggtgtgtatgtacagacgtgtgtacaggcatgtgtgtgcaggtgtgcatgtgcaaggtgtgtgtttgcaggcatgcatgtgcaggtgtgcgtgtgcaggcatgtgtgtgcaggtgtgtatgttcataatggccctaacgcccaagctggaaagttgtggatttacgggaatgagggcaagaaacacctggcccgcccagggcggaaaaccgcttaaaggcattcttaagccacaaataataacatgagcgctctgtgtcttaagggcgtgttcctgctgcagttaactaacccaacctattcctttaattcagcccatcccttcgtttcccataagggatacttttagttagttgaatatctctagaaacaatgctaatgactggtttgctgttaataaatatgtgggtaaatctctgtttggggctctcagctctgaaggctgtgagatccctgatttcccacttcacgcctctatatttttgtgtgtgtgtctttaattcctatagtgccgctgggttagggtctccccaaccatgctggtctcagcactggtctctactgaaaataccataattggctgggcgtggtggtgggcgcctgtaatcccagccacttgggaggctgaggcaggagaatcacttgaacctgggaggtggaggttgaagtgagctgagatcacgccactgcactccagcctggcgacagagcaaaactccttctcacaaaaaaataaaactagtgtgggggaggggggagggatagcattgggagatatacctaatgctagatgacaagttagtgggtgcagcgcaccagcatggcacatgtatacatatgtaactaacctgcacattgtgcacatataccctaaaacttaaagtataataataaataaataaaaataaaaaaataaaaataaataaaactagtgtgaatcgctgggcatggtggctcacgcctgtaatcccagcactttgggaggccaaggtgagtggatcacctaagggcaggacttcaaaaccagcctgggcaacaatgtgaaacctcatctctactaaaactacaaaaattagccaggcatggtggtgtgcacctgtagtcccagctacttgggaagctgaggtgggagaattgcttgaacccgggaggtggaggttgcagtgagccaagattgtgctactgcactcgagcctgggtgacagtgagacttcgtctcaaaaagaaaaaaaaaaaaaaaaaagctaacatgaaatgctgcagcagttttgagtaaaataaggagtgaaaagagttcacaagattgatccacagaaaggtcatcggtgaacctgaagagttttggtggaatggggtgacagaaaccaggttggaggacatgaaggaggaaagtagtaagtgaaatgtgtaaacagtgaacacaggcaactcttaaaattactttgggccaggcgcagtgactgacacctgtaatcccagcactttgggaggccgaggcgggcagattacttgaggtcaggagttcaagaccagcctggacaatatagcaagacctcatctctacagaagttttttgtttttttttttttaattagtcaagggtagtggagtgcccctgtagtcccagctactcaggaggctgaggtgggaggattagcctcaaactccttgagcccaggaggttgaggctgcagtgagccatgattgtgccactacactgcagcccgggcaacagaacgagaccgtgtctcttaaatttaaattaaaatagagagtggctccctacagatggcaactgcagcccccgcctccccctgagccagggctttgggcccatctggctcccctctggaggccggcccatcacgcagccagtgctgacagattgggtgtctccggtgcgccggcggctgccgcttaagtagcttcctgtcagggagtcaggggtcacctcatccccgctctgttcaaaacagtactgacctcttcggggtgcctcccacgcctgtctactgcacgagcatgtgtttagtgtcaactctgcgatccagaccctgcctggtgactcttgggggagcagcttcaggagcccgtggcccccacggcaggtggcttctaggccagaggggcagggttcctgcgctcatgagctggcgagtctcgccatgtgcatccactgtatgccacacagacagggaccatgtatgtcccgagtgccggcttcttggttccactgtctagagtcaggcccctggctctgggcctcggctctgggcaagtccttgttctcagaattcttgtttttttttttaactagaatctcactgtgtcacccagactggagtgtagtggtgcaatctcggctaactgcaacctcaacctcccaggctcaagcaatcctctcacctcagcctccctagtagctgggactacaggtgcacaccactatgccgtgctaatttttttttttttgtagaggtggggtctccctatgttgcccaagctgatttcaaactcctgtactcaagcgatcttctcaccttggcttcccaaagtactgggatgacagacgtgagccactgcacctggcctagaatttttcttaacttcaagcagtgtgtcctgctgggggatgggatgagctagaaactgtggtcccatggggtcagcaaggtttggaaatgatcacaggggttcccaggccaacctcaccacctctgagctgagtgaccctgggcgagtcagttcccttccctgggactcagtcttctcctttgaagaaagggtacaagagaatctagaacatcgtaggacttcggcaaatgtcggtccctttcccccacactccaaaggtgacgttccctgagacatcttagtctgggcaagtgtgttgttgtagcttggggggtggcctggtcccttggcctgtcctgctcagccagcagcccttggctggctcagtatgggaggttcagacacggtctcagttcttgacaagctcctagccagaggaaaggcgatttcattccggtgtgatgagcactagtagaagagatgttagaacggagggactgcacggaccaggtggaggtcaaggaaggcttcttggaggtgacataggagctggcctgcgaggctgagtgggaatattttgggtggaaagaccacggaacaagcatttccgacagaggaagcagctattgaagagggaaggtggttgtgtgctggggaaacctatgtggttctccatggtcataacaggatgcctggggcgtggggggcagaatgtcagccggcaaagtggggaccggagtacccgggaagctgggatgaaggagcctcctctgcaggtagggacagggccctctgaagccggggaggggacggggaaatggggaagggaccaca

SEQ ID NO: 67 - DNA, 2878 bp, Homo sapiens
agactctctccggccctaaaaggcaattgtgctgagattttaactctaacttgggggttcgcccgattccctggagcaacgcttctctaaaaccacggagcaggccagtgttcggaactgcacaggtagttacgaaggaaggaaatgaagtccctcgttccaacagcttcgggtccagtcacaagtttctctctggcgagcacgcggccgcctcacctggggtgggggaggcgctgagaaagcgcagttctctttgggggaggagagatggcctctcagaggcgtccccacctgcctctggaacgcctctccctgcaggccccctcggttccctgcaattcgccgcccgctgggatactcccatggctcggaggcgcgctcccggaccctggtgaggagggtgaagagcgccccaaaatgggctgagaggaaaatgcgcccacactggcgcctctccatcctggctgctcgccccttccctcctcctttcccacacgcctcccatctccgtgcctgcacccccccacccccagcaccctgcaatggtcggaactgcagggagtggggagcaacgcgaaaggccgagagaagagcgctggggagaagtcccggaggtcctagactccttggggcggtctctgcggggcgctgggccaggacagctgccaaccctccaaatctgtgcgctcagaaggagctgccctttgcccgctcctcctcacaggcccaccctagacccacttggggatgatcccaggcgcagctctcccctgccggcccaagcctttgacaggagtcctgcggcgaggcagagaccccctgaactgagctctccgacgccctagttgcccgttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagctctgcgcggccgctcggcccagctccgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtcttgcgagacgcggaactggtgagactttgccaccatttggtccaggccaatgtcggccgccagcccaaaacgccgaagggagacggcggtgaaaacccaggcgtgcgagctgcgtccttgcccttccccctacccaggtcaatggtctggcctagaccaccgctctgcgggcgaaaggagtggagcagaatcacaggccacgctcccagtcgttcgagcctgcccacataacccccggcccctggcgcagtcaggcccgcagcgggcgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggcc

SEQ ID NO: 68 - DNA, 70398 bp, Homo sapiens
aaattaagaaatgaagaagcctagaaattctcactgttacagaaatctaatgccctcccctgtgacactgcaaatctaatgccctctcctgtgacactgcaaatctaacaccctcccccttgacactgcaaatctcataccctcccctgtgacactgcaaatctaacgccctcccctgtgacactgcaaatctaacaccctccccagtgacactgcaaatctatcaccctcacctgtgacactgcaaatctaacaccctccccaccgtgacactgcaaatctaacactctccccgaagacactgcaaatctaacgcccccccgtgacactgcaaatctaacgccctgccccatgacactgcaaatctgacaccctccccaccatgacactgcaaatcaaacaccctcccccatgacactgcaaatctaatgccctccccacagtgacactgcaaatctaacactctcccccacaacactgcaaatctaacgcccccccatgacactgcaaatctaacacccccccgtgacactgcaaatctaacaccctccccaccacgacactgcaaatctaacactctcccccgtgacactgcaaatctaacactctcccccgtgacactgcaaatctaacaccctccccaccacgacactgcaaatctaacactctcccccgtgacactgcaaatctaacaccctcccccgtgacactgcaaatctaacaccctcccccgtgacactgcaaatctaacaccctccccaccacgacactgcaaatctaacaccctccccaccacgacactgcaaatctaacactctcccccatgacactgcaaatctaacaccctccccaccatgacactgcaaatctaacaccctccccaccacgacactgcaaatctaacactctcccctgtgacactgcaaatctaacaccctccccaccacgacactgcaaatctgacaccctcccctgtgacactgcaaatctaacaccctctcaatcatgacactgcaaatctaacaccctcccccatgacactgcaaatctaacatcctccccaccatgacactgcaaatataaccccctcccccctccgtgacactgcaaatctaactccctcccccatgacactgcaagcgattcttcagtagacccaggtctctgggtacttgaaaccagagcagccacagcaagccactgtgtaagagttagcagagaggggctcctggccatctgtgcagggacatacgtccatgcatgtgtataaaagatctctgtaatttttatcagggctaggaccatcctgaaagtgcaggtctcccagagccagccacactccctatgctgggctctgcatggagtggggtcagcatgtggccagctgctgccaaggtctccctcccaatagccctcccagaggcctctgcccaccttcaccacctaatctccatgctcaagcctcactgtgtggccaggctgagtgcccatctcctcacaggacacagcgctctctgcaggacttttgctaagtggttggtcccctgcagcaacacacaggggtccacggcacaccctccacacacgggggtccccagcacaccttcaaatatgggggtccttagcacaccttcgcacacgggggtcctcggcccaccctccacacatgggggtctgcagtgcaccttcactcatgggagtccttggcctaccctccacacacgagggtcctcagcatgccttccacacgcacaggggtcctcggcccaccctccacacacaggggtcctcggcccaccctccacacacaggggtcctcggcccaccctccacacacgggagtcctcggcacgcctttccagaggaggtgatcttgaggcaccacaaaagcagcacctggcccctggccgctcccagctcagagcccacggtggggtcctcagccttcaccctagttttgctcccgcatctgagggctgcgtgtcacctcactgtgacttctgactgcacagcaggtgttggtgtggggagtcaggcagcctcagcgaatgtcctgaaaatgctcccacagaatgtttatatctttacagacacaaaatgctgctggggtaatactcttgggaagtatgcaaatgagttctttttcagatgtcaagcaggagcgatgatcagagaatcctctcattgagactgggagctggtggaatatgactccaccagctccagaccccaacttctccgcgttcacctgtacatcgcaagtgtctaaaaatgatgtgtatcccctcccagtccctcactgtctttccccagatcacacccccacaaccctgtgctcacggagaactgcccccaccttttctaggaaggagggcttggttatcagtcatcctcctgccatctctgatgacaggcagtggcaggggctcaaccttgtccttccttttcattcccactggtgccaccccagccaccttcatctgcgtagcctgaatcactgtggcctaactgggccctgggtctccatgcttcactcccaaagtcaaacacaccgtctcccatccctggcatttccatgccctcacttgacgaggatctgcaagagccgagctctgtgatgggcagcaggtgtgcacagcaggagggccgggcctggtgctcccagcatcttcaggcttaaaaatttggccccaggaagcctttgcattcataactgtagctaccactattcactgctccaaaattcaaaggaggagttctcgagacccaagaacacacaacacacattccactagcctcgaagccgcatcctcgcacatctcacagcctggggaagcgatgcagaatctcaccagaggataaacaggcaaagaactttggggctttgctaggaaaatgtcttactctgcggacccccagagggtctcagggacttcccatgccccctcccatgccccagacggtcctttctgaatggccgacttagacaaaggctacaccctttaaattcagtgacagccaacagaatcacttcctgcccttgaaatccaacaatgtctccacaggaagcatctgctggctcagcacagcaccagcttcagcccccacctccgccccatccctgctcctggacctgttggttccgaggaggccctggacaccaagacacccaccccagatgcccagactccctcaacatggaggatccccagactgagtcctccacaaatgctgaaaccccctcccaagatgccaaggaagccccccacccccaggatactgaagtcctccccagatgccaaagctcccagaggccaagcgctccctaccctgacgccaaggcccctctaggacaccgaagcccccgcctcctctgctgaggaagtgccattccatggaaggcccggctcagcctccctgggtcaagctcctgtctcctttcaggaagatggaagttcacagaggccgcaggtgtctaagggtcaagttgatcactacaccatccccttttagtgtttttgtatctgttttgactccctattatttttctggtagttcatctttttatgtgtttttaactaaatccattcagacaatcttgttcttcctctgccacttttctccacgttgtaagggttttaaaccaatgtttctaagggagcactgggcttcatttgacatttccagtaagtatcaaaagctgctatcacttcaattacagacactccgagcccaggacaggctccagatgcccggccttcatgcagcaaacaccttcacagggaaggaaggcggaactctctttccttgccacagaaaaggattctaacggcatttgacaaagattgagcatggttcgtcgcgaacgccagcctgcccccacggtcatgtccagcttaaccaacacacggcccagcagtctcggtcagtggagcccaccacccaagcgggggcggtaccactcccaccactgactgaaccttggaatcaatacaatgcagggtagagcaattcatttgaattaatgtgttaagtggcacaaatatgtgtttatcgagagaaacctaagtttgtgagaaaaggatctattggaaaattcttctttttaaaaaagtttcatggaaaaagcttcctgcaagcatccgcactgctgcaaatataataattgtttgaaagcataacatttaaatcagaagcatccctagacatgttgattagaaatagtcttaagagggtcaaactatgtccacagaggctggaacaccaaaatagaggcaaaagtcctgagaagggagttgtttttagtcaccaggccagtgaccactgtccagcaggtccacgtgcatggatgagagctgtgcccctctcttctctaagccaaggggctgttgggacaggcagccgcacctggccagctctgcccttgctcatcagctgggaagcagcatgcttcttggggggcaggcattgtctacaacacagactacacagtccacagtccacaactcctgaatcctgcctagtatttatacagtaaacagagactctgaaataaacaccgtgccgaatggagcctgtgcagctcccagtgctgtgaccccaccatgatcgctcatctgctccagctggagcactctgcctctctacccattttcctgctctcaccgagtcaggcctcggaccagcccctgtgtgagatggagatgtgtttagtgtgggaggaacacggtgagaggtcagagacagagcagggatccgtgcagggatgcggaggccccagtgctgggtgttcagggctgactcctccctccccaggcacctcctgccagagtgacctcatgagccctcatggtttcaaccccacccattcgcagcagccacatccccacctgcactgggttctccttccagactcacagcctccgcctgctagctgctcccggccaacccccatgggcacactgaccccgtgtgtcccgaagaccccccgcctgcctctgaaggcccttccatcctactgctcctccatcctggcgtctgacaaatcaatgtatctttccccgtggatgtttctccaacccattcactcttctcccgctcagtgacctggcccctgaacctgccgttcccaactcagacaaagccgtctccaactcggacaatggcgcctccaactcgaacaatgccacctccaacttggacaatgtcgcctccacctcagacaatggcgcctccagcttggacgatgccgcctccaagtcagacgatgccgcctccagcttggacgatgccgcctccagcttggacgatgtcacctccaacttggatgatgccacctccagcttggacaatgccacctccagcttggacaatgccgcctccagcttggacaatgccgccttcccacctccacaaagtctgcttcctaaagagcaagtccagccacaccacttcctggcttcagttgtcccatcagacgacgggtcaccaacagctggggcattctcaggagccaagctgggtgccttcccccttcctggacatccctaccctgcttgctgggcccagtccaggttctggaagattctgcctttctgttcagctgtcccacctctcagttccgacagtgtgagcctggtggctaaagattcctaatctggcccttgaagactcaggcaaacttagaagctcctggtttcaaacttctctttcccactttgcctcttgtcttgaggtggcagaaacagctgatggtgaggcaggataatacggtctggaggcaagaagcaaccacacttttctagtcttgtgaaacaaccaaagcaactgtctgaagcctcttcagctggcccatgcctcatgggagttttgtagctctttctgcgtttgagaagacactaaaaaaaaaaaagtaaaatccagctggtcctgagagacaagagtttcctcaatcctggaaattcagcaggaaaaatactgtttatgcactgaatgaaatcactgaggccaagaatagttatttgttcacaccatttcatggatgcctatttttgtcccaaaataaagactctgcatgtcaccatgttgatgcatctggaaacaagtgagaggctttgttatcagcatgcagcccagatgtgaaggcccacagcagctcctgagggcacgtaagcttgcaggaacaggatgatcctccaccggctgcctgggccatctgtgtaagggccctgtggactgagccatttacatcagttaggccagcagccacagggatggtgtcaccactgtgggattcaacactttgaagaattaaggcagaggttacttttgtccacaaaatcacatcctgcagtaaggatgtgggtacaagtaatttatttggaggatgatcccagaagccaagtgagagaacgggacagtaagcctgagaagggcggaagccatgaagtacatgcacaaaccaccagtgtggacggccggggcccgacactgccggagaccctctgagaggcatgtgggatgtgccttgaatcgtctgagggtcaaagaatcaggggtctctatccattgactcccatcccttgctctctgaagaggtgaactcctgagcagccctggcctgccctgggtgtgggctagtgtgctgcttagctcagacagaccaaggcaggtgcttaaggctggagccatcagcatagatgggagctgccctgcagagctgaagggaggcacagggtgggcaactgggatgtgggcaggatgcgaaaaggtctgtcaaaggggtacttcttccaagtgggccaaagactccatcaggtcgagtagtgacatggaaatcacagagcaggtggctccaaggatctgtccctccactgaagtaacaagtaagctgacaaaaatggacagaagtgactgttctgggattctgtagtctaattttaaaaatcagcagtaaccagggggtgctaaattgagaaagagaatgctaaattttggttaaaagacattctgtggtttttgcttgcccacctattattccccattccccagttcaacagcagctacaggattggtggcctaagttcctggtgagatgtggtggtaccagggggcagtatggatcttgttttcaaaaaactgtggctgtgtgttttgagctgtctggtggttccttgagaaaccagtgcaaagaggaaccctgttttagcacctttgggcgagactggctttccaggaggaagctgacgaaatcatgtatagagttatactgaccaatactatcccaaatttgatgaaagacatgaatatacatatccaagaagctcaactaactccaagtagaattgattcaaagagatccatgctgacatattatcatcaaaccatcaaaagccaaagacagaaatttgaaagcagcaagagagaggcaattcatcttgtacttgagatcgtcaataagatcaacagcagtttttcaccagaaaccatggaggcctgaaggcagtgggatgatgtatttaatgtgctgaaagaaaaataactgtcaaccaataattctgtatcaggcaaaactatcctttgaaaatgaagccaaaattaagacatccccttagaagcaaaagctgagggagtttgtcactagtagacaagctctgtaagaaatgctaaaggtgacaggctgaaatgcaggtcattgaggctgaaattctaaacagtaaccagaagccatacaagaaaataaagaacttcagtaaaattaactacataggtaaatataaaacccagtattgtagctttggtttgtatctcctccttttgtcttctatatgatttaaaagacaaatgcataaaacaataattataaatctatgttaacagcatacaatgtaggaagagataatttgtgacaataacaacataaagctgggaaggaagctattcagaagcagtttttgtgtgcttttgaagctaagttggtataaattcaaactacattgtgataaatgtggggtgttaattgtaattcccatggtaaccactaagaaaataacaaaaagaaatgtgcaggaaaagaaaatgagaagggaatcaaaacagtacactaaaaattaaatcaaagaaacaaaaaaaggcaatatttgaggaactgaggaggaaaaaaggtgtaagacatacagaaaccagcagcaaagtggcagaagtaaatccttccttaacagaaattactgtaaatgaaaagggatcaaactcaccaattaaaagagagactgacagaatacatttttaaaagtatgaccaactacgggttgaatatccctaatccaaaagtccaaaatctaaaatgctccaaaatctgaaaatttttgagtgcctacatgatgttcaaaataaatgcccattgaagtattttggatttcatatttttggattatggaagctcaactggtgagtccggttggccttaaaacaagatgtgtttgaatcatgcaggtccacttatatgcagatttttttcaaccaaatgtgaattgaaaatatagtactcgtgggattcaaaacccatgtatacggagagctgacttttataaatgtgggttctgcagggccaactttgagacttgagtatgcgtgaattttggtacacattgcagggggcgggtgtcttagaaccaatcatctgcatatatgagatgaccacaaatgttccaaaatttgaaaagatccaaaatctgaaatacctctgtcccaagcatttaagataaggtatactttgtatgtaagataagggatatatgctgtcggttagggactcacgtaggatccaaagttgaaagtaaaatgatgcattttgggatggtgaaaatgttacatacaggtggcagttgcacaatgttgtgaatgtaccaagtgccactgaattgttcatttttaagtggttaattttatgctatgttaattttatctcaattttttaaaaagactccctcaatttagttttgtttcattcatctattccctatttatttgcctctctagattataaaattgttgagaacatggacaggagtttattcctctttgtgctacccagcacagtgcctggaataataaatatttactgaaggcatcactaagcatggagttgaacatcattgaggggctcagacactggcggctgagtcaatgccatgcttgctgcaggacagcctgcccaggccatctcagtctcaggtatttcttcatagcagtatacgaatggactaatacaggcccatattccaagacccttaggaacaagtggtaattgtttactatctagacgggactctcctacttgataaaagtctcctgctctatagctccacaaacagtaaatttatttgaaatcaataaatgaatgattaagcactgtgactggagagggccgaacagggttccatttccagatgtttcccaggcactgatgattcacttcctggggccgggcaagttccgaggctcctcagggtctcctcaaacaattcaggcttctttaagcctccagcttgcaactatctgactcattaagttgaagttggcaggaaagttataaaggttgtacttgaatcacagtcctgagatcttgggttgagatgctttttatttagcttgtgcatcaccaacttgtaaaaaatatcttggtaaaaaaatttaaaataaaactttaaagtttgtgttatgacagattaaacatttaatgccacatggtgtgtatatctcaatggaaacactgttcttgtgtgttcagtatctgtgtgcatgttaatcttcctgtgagatcataaagctctgtaagggaaagggtccaattgtctcaccttgaaaattccaaacctagcaaacgcctggtgggaaatacaaacccgcaggcgtttctgagtgaacggaggttgtgccaggtcaaatgctcactgctggtcccgtcctgctctaaaatgttcagatgcataatgggttatttttgttggtatttgggtgggtcgaatgctcactgctggtcctgtcctgctctaaaatgttcagatatgtaatgggttatttttgttggtatttgggtgggtcaaatgctcactgctggtcttgtcctgctctaaaatgttcagatatgtaatgggttatttttgtcggtatttgggtggtatttttgctctatgacctcccatttctctgacgtctctagattcctttgttatttgtgatttctgcttctggtggtgacaacaaaatctgccattgctgtgcagccgcctcacccatggagcaggcttatcctctacaactattctacagaaaagacaagcaaggtctgcgtggagtgaaagcgccttctttccatatcggatgctggaagctgtgatgttggcaaacggctctttgcatgaagtactgtgtactgaaccaggaaagtgaggtgcagacgcggaagtcaggtgcagatgtgttgggcagatgagctatggtgatggcgggtggccattccctataagagagtggctcctctattattaacaaaataaaaattaaagaaggtttccattgagtttgctagttcttcactagcaatattcccagctggttgaccttcatttgttttagtttgatttcatccaacacagctttatcttacctgctgcccacaccctactcttgagagcacgtactcctggcaggaccccaacccaggaaaccctcccatgccccaggtgccgtcccctgaccaaccagcctcactctcagagacaaggatgaaacgcatatgaatatccactctaatacggttcagagaaggatgatctgttatctgaaacttttactgcaaaagctcttttaatcaaaaccttcagaaaatttgaattttactccttgcaaagattatttggttaaaaaaaaaggacactcacaacaattaacatatgactggggatgtgtaagaacagcgaagagaactggacaggctgtgtcctgggaacagcgcccggtgcacacacccctttccatcttccctattggcaccttcagtccccggaggcgctgctgatgctcataggaagggactaaggccttcacagtctgtcaacaggagggtcccatggggctccatcacggtctctgggaccccccttccactgcagcaaagtggacaggtgcactgcatcaacatctcaacaccgggtgaaaagggaaacgccttactaaacgatgttcccgtgatcagaatcacgggctaacgtccctccgcttccgcagtcttcaggcctcaggcactgccagtgacattagctgctgtgcgtccctcctgccggactgcaacaccgtctcaggatccacctcccaccatcttccctgaccatggccctgctccatctgatttgtttgtcctctgatcaggtggggcctgagtccggcagtggatgccagtgagtcagccatggttggcagggactggctggctgcccccctctcttcattggccccgcctgtctggcctgggcgcccactcactcctgctgcacctgccacaactgccggctgatcctgctgctctgatgccccctcacgtctccagcctgcgccccgcactgcgttcgctgcccatcttcctcccaagctcacagtctagctccaggtgcctgctctccttgttctgtgtctgtttctgcacaccctgcggggaggccaggctcacccaagaaaagagtcaaggctgcaccatgaagcctctcgggctgggcagggagtccaggccctgggagccccccagagccccccacagaatgtgcagctagcctcgccagacgcgggcgatggggccgaaccccgcaggacaacttaggaggagtgaagagtggaagagtgcccggtgcagggatgggtgggaggaacctggggtagtgtgcacgcctgagacagggtgggggacacgaagggagacaggcgagggtgggacaggcaagggtgggtagtgtgcatccctgagacggggtgggggacacggggggagacaggcgagggtgggtagtgtgcatgcctgagacggggtgggggacacagggagacaggcgagggtggggagggagacgctgactccgtggtggaacgtgggtaggtgataggctggctccctgagcagcccctcccctgtggtgcagagctgtgggtctaggggtgagggagccatcatctcatctcacgccatggagacacaggtgtggcttctgttcctgtatctctagtaaatgtttccttctgagaaactgggtctgtcagcctctttctcaggcctcttggttccctcagacttgggggtaggtgtgcacaggcctgcctgccaggggacaggaaccccaggggaaataaaggtgatgctcaaacccagaccaccgaatgctctgaacacacttgcttgctttcaggtggaaacattcacagtgtccctgggtacagcagacttcatatcacagagacttccctctccaggacgtgaagatgtccatcaccgagacgtcagcacggcaggtgggagaaagccatgcacacagtgaaggggacggcctccattggcccacagggtgagctatccagttccaggagccacctgaccacagggtgagctgtccagtgccaggaaccacctgaccacagggtgagccgtccagtgccaggaaccaccggacccacggggtgagccctctggctcgagaagtcctcagcgacatctgggggtcctgtgcatgcaccatgttgactgtacccgtgtgcagcttgcacagagtccccagcagctctggggagggctccgtgttcaatatgtgatgagctttcgggaaggacaggagagccgggtgtgagaagcctccttcctagggcctgtgtctctggagtgcacgaggcagatggatggagacgtgggagcaggggctggcagcactccccgagcacagtgggaactcaggagcaggggctggcggcactccccgggcacagagggaacggcctgggtggcatggagagtgtcctcccaggatacagcggagtgcccgtcaccacctgcccaccttcttcacaccatgaggctgctggcacgggtgcctttgctgccggctgctgtctgtgctgccctgcaacctggatccacatggctggaggtccggtgtccctaaagacttctatgacatcctgacactgccctgcttggacactctctggacaggagacacctcacccctcacagacatctcattttttcagagctgcatcatcagagcagttgggggacaggagggccaagtctgaggactcagacccggggcagctggtggaagctggggttaagagtggaatacatggccaaaggatccctcctgagggtgagggcgaccgagaaaggaatgagggcataagagcggtgctggagaaatgtaagcaaatccgcatttcgaagcagaaatcgctggtttaaatattctctcctttccctcaccatggaatgcacaaacgcttgaagatgcatgtgtgttagagtctcttccacagaactctctggaaaggccgttccaagagcttcaggtgttcaggttcgtatctgaggctgcaacaggcagagccacttccagtttcctgactaaaaagtgaaagttccagaagcattcctagatctgtggtgtgtgtggtgcacgtgtgctgtgtggtgtgtgtagtctctgtatgtgtgtccatgtgggtggtgcctgtgtactgtgtgtgctgtgtggtgtgtgtggtacatgtgtgctgtgtggtgtgtgtagtctctgcatgtgtgtccatgtgggtggtgcctgtgtactgtgtgtgctgtgtggtgtgtgtaatctctgcatgtgtgtctatgtgggtggtacccgtgtactgtgtgtgtgctgtgtggtgtgtgtggtgcacgtgtgctgtgtggtgtgtgtagtctctgcatgtgtgtctatgtgggtggtgcctgtgtactgtgtgtgctgtgtggtgtgtgtgtggtgcacgtgtgctgtgtggtgtgtgtagtctctgcatgtgtgtctatgtgggtggtgcctgtgtactgtgtgtggtgtgtgtgtgtggtgcacgtgtgctgtgtggtgtgtgtagtctctgcatgtgtgtctatgtgggtggtgcctgtgtactgtgtgtggtgtgtgtgtgtggtgtgggttgtggtgcctgtgtgagaggagtggtctcagccggggtgatattaaggcctgcagtacagctccagaccccagagcgaggccccgcctccctgccgagccccagaaacccccttttcaggggtggaagtgggggtggcctctcccatgcagttgagtgtcctgggagggaaagcacagaagttctttctggtatctttagaaccaaatcaggtgaggtgtttaagtatctcatatgttttttggtcatcatttctatttactcctgcaaaattattttttaagataaattaaaagaataataaaccgaaatactagacttaaaatttaaaaatttagaaattgctggcaatctttttgtttttacaaaatgccacttcctagtttgtttctgggtagtgtgggagtgaagcgggtggggtggagggtgctgggccagtgtgcctctcaccgtccccaaggagccccctggagatgcagtccagaaagacggatccaccggccatcccaggtaccaggagcagcacacacgaatgctggatttgtgcctcacactaaaaagcagcttggtgtagctgcgaattttctatccaggcacatctcttcactgctgattaagctacctctttttgccaaacatactctatatttgtgctggatcacaggtaatttggtggagaaaagcaattccaaggaacacaggggagggtaccatcatgtttgtgatgcatggaattccttgcagctgggagacctatctagaatgctgagccgggctcacatccccctgggtgggagctatttctaggtctcatcagcagccaggggagggcttaccagtaatttttaagccatttcaacttctctgaaggcaaaacctgggaaagcaccgcaggcccatcacagatcccctgagagaagcaactcctcaattctgcacctgcgtctgcttccagacagcacacagcaggagggttatccaagcatttgaagaaatgctctccaggatcaactctcttcttcagacaactcccaaccattgtggttttaagtggcagggcacagctcagaagagaaagacaaggagggcaaggcggcaccgcagctcagccccgcagggtgctagggcggacaccctgcggggtttgcctgggctctgcattcccatcccttcattagcccaggggtgtggaacagtttgcacccagctctgggtcttcatacgtggaggtcaggagagtctcaaatagtgcatctgagaaaacccccaaattggtgcgatttccaataatacgtagcctttgcatatttctaaagagagtcagaggttggaaggaacccaggagaccaagggagaaacccgcacattctgacaggtgcgttttctcatcaggatgtcagctgctgggacactgccccaggccattcgtgtgctgctgaaactaggatgtgtttctcttgtgtttggatgagattttattcttcctacgtgctggcatttagtacactgttgtttatggctgtttgatgagaaaagcctagggacggctggtttaaggtaagaacattcacagtgtgttatctgcatgcccagggctgtgagggagcagaagacacagggttggctccctgacgtgttggagacagcaagagacgtggagcacatctggagggggaggctgggctgctgctgtagccgtgatcgctccggtccacatctgggttcatttggtgtgtggacacaggtgtctaccgagagggttttacctaagttagactaaacaaggctgcgagccagtcccagtctgtgactctaccagaagaggctgggtccctggctgaagaaatgctgaaaaatcctcagacacaaatgaatctgttcgactcaatgtgcactcaacaattgactggctatccctagccctctttgggtctaccagttgctatttcttgcgtgggcatcagcctgcacacagtgaacaaaagcagctggttcagagctgccagtgctccccaggggaaggactgacagagtgatgccaagacagggctgccctcctccctagggaatgtccaatccatgcatggccaccagaatcaagggcccacagaggaatcaagtttcaggggtcatggtgggaacctcactttcccagaggataaactgttacacagaaggcctgactgcttttggtttcttagcctgtgagttggaattcatttgtgtgactaattcatgtttggaatttacaaaaagaagttgtttcaattgccaccaagtaaagggttcatttaaatctgcaaccttgctagaatgcctggctcatgccactatgaaaacctgcatctgagcccattctgttttgaatggtggacacctagagagtaagaaggaaaagggaaggaaaggtcctacccaacatcagaaccacatgagcgaatggccacttgggaaatggaaatacatttgacctccatggctcagagaggttcagaagggttaataaacagctcaagcacttgcacctgagagcccactgttactctagagcaggggacaagagtcacccaaggtgactataagtccccacaaattcatctgatgtgcacttcccagaatctgcagcaccctgtaccaacccccatcccctctccacagcaacagtgcatcctaactgtgagcttaggagacacgtatttttggcatctaggacttaagtattaatccctgggggggtgaattccataaattaaggaggggtacagtaagaggatgagatgtttaaagagaagcatatccatggaatcaaaatgcgatcagagcattatggccaaataatccctaagaaaaacactgatggtacacacaacagatacaagattcaaaataaatcatcaattaatacttttaaatagtattattgtattctttttatttatctattactattaataattattatttgatggtacaaagtgaaaaggattataagtgagtgtgatgagcatttgcacacctacaaacaggataacacaagaaatgggaaaattcctagaaatacgcaacctactgagactgagtcatgaagaactagaaaaccgaccccaccaggagtgagtaaggagactgaaaccgtagtcaaaaacctcccaaagaaaatcctgcagtcactggtttgatggataaattttaccaaacatttaaagaaggattagcaccactcctcctcaaacttttccaaaatattgaagaggaaacaatttctaactaatcctgtgagtccagcattactctgacacgaaagccagacagacactacaagcaaacaaaactaagaaccagtatcccttataaatactgatgcaaaaaatcttcgacaaaatactagtagacaaaattcggaagttcagaagcatattaaaacgattgctgtaccatgaccaagtgggatgtattcctagaatgcaagaatggttcaacacataaaaaataataaacgcaatacaccccactaacagaatgaaggaaaggacccatatcatcatctcaactgatccagaaaaagcatctgacaaaattcaaccctctttcatgataaaaacgctcaacaaactaggagtaacagaaaatcacctcaacataataaaggccatatatgaaaaatctgcagctaatgtaacactccagggtaaaagatggaagacttttcctttaagactaggaacaatatgaggaggcctgctttcaccactgttattcaagacagtattggaggtgccagccacaggaattaggcaagaaaaataagtaaaaggcatctaaatgagaaaagaagacataaaattgtttctgttcacttatgatatgatcctataggtagaaaatcataaagattttacacaagagatctgttagaacttaatagaatttattaacaaatttagtaaagttgcagggtataaaatcaatatacagaaatcatttgtacttctatacactaaaataaacaatgccaaaaggacatttaaaaagcaattccatgtacaatagcatcgaaagaataaaatatttagggtaggcttaactaaggaggtgaaggacatgtacactgaaaactacaaagtgttgttaaatgaaagaagacacaaataagtggaaagacatcccatcttcacgtattataaggctcattattgttagcttttaatactacccaaagtgatctacagattcaacataatctctaccaaaaatattgatattttttcagagatagaacaacccatccaaaaatttatatggaatctcatgggaacccaaacaaccaaagcagtcttaaagaaaactggaagacttgctgatttaaacttacaacaaagctatagtaatcaaaacagcatggtcctggcagaaaggcagacatatagaccaatggactataaaacggagcccagaagtaaacccttttgtgtacaaatgctttttgacaattgtgccaagaccattcaatgaggaaaagaataggcttttcaacaaatggttctcagacaacttgcaaaagaataaagctggacctgtaacttacatcatatacaaaacttaaaactgatcaaatatctgaatttacaagatgaaactataaagctctaggaagacttagggggaagcttcatgacactggatttggcactgatttctcagtatgacactaaaggcacaggcaacaaagaaaaataaacaaattgcactttattgcactttatcaaaattaaaaccttctgtgtattaaaaaacattatctaaacagttaaaaagtaacccaaagaatgagagaaaacatttgaaaattacatatctgattaggagtatctagaacatatgtaagactcctacacccaacaacaaagaagcaaggattggaatagacatttctccaaagacgacgtgcagatggagagtgagcccatggtgagctgttcaacatcaccagccattaggcaaaagcaaacaggagccatgagatgccacttcacactcctcaggacggccatcctcagaaaaccagaaaacaagggctcatgagggtgtaaagagactgaaactcgtgtgtactcctagtgggaatgtaaaatggttcagccacactgggaaatagcttgagaattcctcaaaaaattaaacatagaattaccatttgaccccacaattccacgtgaggtaaacactcaagtaatgcaaaagcaggaacttgaatggatatttctacactgacatgtatagcagcactattcccaacagccagaaggtggaagcaagctgagtgcccatcaggggaagaacagataaaaaacatgtggtctatacacggcggggtattattcagccctaaaagtgaaggacattcatccaagctacaacacgggtaaaccttgaggatattatgttaagggaaatgagttgtatatataagaggacaaatattatgatcccacttctctgaggtccctagggtcatcagatccataaagacagaaagtggaacggtgggtaccaggggccgggggaggggttgaggagttcttgtttagtgaatacagagtttcagtttgagaaaatgaacaagttttggagatggatggtggagatggttgcatgacactgtgaatgtacttaatgccactgaattgtacaggtgaaaatagttaaaatggtaaattttactttatgtatattttaccataacaaaaacatcattgcaaaagaagcatgggaagaatcataatcaggtgctgttttaaactgtaaatcaataaaacctttctgaaaaaggagttgggtggcacatgtcaagaacagataaaatatagatacattttaaccatctaatttcaattttaaaaatacatctttaattctttccatttaaaaaatgtgcagtaaacattagatatagaaataaaagctctaagaatagggaaatagctaagtaaatatattttcatggatgaaaaattattcatccgttaaaatgatattacaaatgttgaaaagaccaagatatttttatgatacaatgataaatgaaaaacaaaaacaaaaacaaaaaaacatggtcaggcatggtggcttacgcctgtaatcccagcactctgggaggctgaggcgggtggatcacctgaggtcagaagttcgagaccagcctggccaacacagcaaaaccccgtctctactaaaaatacaaaaatcagccaggcatggtgatgggcgcctgtaatcccagctactctggaggctgaggcaggagaatcacttgaacacaggacggggaggttgcagtgagccaagaacatgccactgcactccagcctgggtgacagagcgagactccgtctcaaaaacaaaaacaaaacaaaaccaaaacaaaacaaaaaacaagcaaaaaccaaaaccatggaagtgaaattctcaattatattaaaatatgtatctgtaacactcttgaaggaaatatgccaaaatattcacagtagttatagtttattagagagattatgaagaaatatttttctttcctcttttgattttttccaaaaatttcacaatggcacacaatatagatattaagaattattataaggtcaggcgtggtagctcatgcctgtaatcccagcacgtcgggaggctgtggcaggtggatcacttgaggccaggagttcgagaccagcctggccaacagggtgaagacccatctctactgaaaatcaaaaaaattagctgggcatggtggtacacacctgtaatcccagctacatggaaggctgaggcaggagaattgcttgaacccgggaggtggaggttgcagtgagttgagattgtgccactgcactccagcctggatgacagagacagactctgtctcaaaaaaaaaaaaaattataaaaagtcgattaaaacaacaacaattttaaaaagagggcaggaaagtggtctagtgcccaagagacctgtctcagcattaaagcatccatttaataacggtgtaatcttggctttgttatttagtttctctattcttcagtttcctgatttgtaaaatgaaattttcaggtgactgcctttcagcactcacactcgaaggcacttagtaaattcggcactcatattctaaggcactaaacacatgtgtctacttatgggagcccgaacatgagcctctgtcaggtttatggaggatgagttccagtgggaaagaggcttcctgagtcacagtgagcccaggagacccggcggcggccgcaccgggacccggggtgtgtggagacccggcggccacacctggacccggggtgtgtgggaggctctggaagagccactctgtgtcccaccctctcactttccctcctgctgaagaggcctcagtgcccggcgggtgcacacaagcggcgcagtccctactctggcgggaaacacaggatgtgaaagtattttatgaaacagtttcagtgaagaagaaagtgggtcattttctaatttgaaaaatccagagtcttctatttttctttgaaatttaaggagaagcaaagtgcttttaaaatgtttgcgtattagcataaacgattacaaatatttgtgtgtttcctggtcgatgaaaacacgccgctgccagcaggatgagatccgaatgtgaatggccacacttcagcaggagtgttattccaccagcgggagcgttattcccccagcgggagcgttattccccttcccgtttcctgttccttggtgttgactttaatgcatatgttcagatacacagaggaatagaattgtcaaactcggtcaccagcaggtctctcattattagaggacaccctgatccaggacagcagaccaagggtgcttagtttttacactatttaatacacagattattttcatcaatgttaagactacagcttcctgaagtcagaccccaggccttttattggtacctacacacccggggtcaggtgcagcctgcacatggcaggtacttgaggaacacctgtggacaagctggaagagtccggtgggaagggttttcagtgacaagcataggaagggttcgtgacacctgttcctattacagacatggggaggttcaaagtgaaccagtcaggaataatctcagcctcaccccagaaggaatttacaaatgaggaccatatatggcatggactagagggtcatatcaacccacagactgtggcattcttggttccattccccactatttggataaccttgagcaaggtagtctttgagccctgaaatggtgaggaacatgcccttagccatgggatgctggcaggtcattgatactgtcctatctatgaacggggttttcctgtctttaaatggggtgatgaggccacctcgcaaggcagcatgcagagaagcaagtccacacggcagacactcagccagcgcagcgcccagcacagacgtgctcagcagacgcacactctcagctctgacagccacggtgcaagtcagatgcaagcctgcaggctgagccgggcagtctcctggcctcaggtggacctgcagtcagagacagtccctcccttctgcggcatcctttccttcctgtgtgcacgctgtagaatagcgggctgggggtgtttaagaccagaagcagaaaactgacaactttgttgcctggaaaaaataaggtggacaatactggaactaatggcagaaacaaggttttggagcaatctacaatttattgaaagcagccctgagtcccaggactaaaataactaagaattggtttggttttattatttcttgttaagcaccatgtctgaggttaagacccagttcttaaaagtaatcacatagatacgtgttacacacatcagttcagttgctaaccagcccatcagcttggatgtaattacttcacacgttctctgagaatgtgttccacacataaagaatttccataatggccaggcagccttgagtggaaacaggccacagttcgggcctgggagagaagtctgcaggggggagatctgtggtcatgccctcaccccatccccagggcagacgatgccgcttctcagtgaggtccccttggcttcctgtcacagcacctcggtgctagtccacccgggagatgccagaacagggctaactcgttcatctttccagtccaatggccggggttgctacatttctcaaacttaatttctatcattaaatccttttgttttgttttatttttggacagacgagttctccctatgttgctcaggctggtctcaaactcctggccttggcctcccaaagtgctgggatttataggtatgagccactgcacccagtcattaagtcctaattacatgttatttgccctgttcaagttcaagcagtattttttttaataaagattattcccaatagatcttagtcttcatctgtaagaggctgttgagggcacgaccacctcgcagtgacctccctctgtgtgggacccccgttcccactggcacaccatggggacagctgggtggggtagtgttgagttctggtcctggtcccaccgacctgggctggagctcccagatgctccacacacccacgtctacagaaacactaggccagactggggtccgccccacacgcacagaggatcactgggggcgatgtagagatgtggaagctggaccccaccccccaggctaattcatcagcaagatgttggcaactgctgggctggatggttattagcatattaggatgacatttgaccctaacattccagttttgtgctaccaaaaaaaaaaaaatcacctgaatgagtcaagacagttaaacttgagggtgatttgggaatgaggggaattcatccatttgaggttaaatgtttgccaatctaatttggtcaaaacagttcatccacaaccccgtgcaggccacaacacaggagcaggtgcagcagggcccttgagtctgtctcacgccattaacaccctgtgatggccttacttggcgtgtggagctgtgaccaccagggccaacctgaggcagcatcatggacttgaccgactcacctcagagcttggcactgggtgctctgattcccttcctcaagcttcccacttgaaggttggtgtgaaaccccaccccactcaaccctggctgatccccatggcctgttctttcgacgatcctcctcttgccccaatttctccaccgcacagactcgccagggctttggtttgtgagtgccctgcactctgtcagttgggccatggtataatttatgttcaacagagacctttgggagtgagtgtcagtgccgtagcggaacacagggatctgaggcacaaggcagggctgtcccaggcaaacagggacaccggccccttcatcagtaggtgacatgctttcattcaataggaaattccagaacaccaagaaagggatctccagacagggacctgaaaacaggatatggaggtagatttgtgggagagagttggaaagggagctagcactctttgagtacccactttgtgctaaatacttagtttttgactccatatgtatgaagattaccatatttcatcaatttcaagacgaaccctttttcacagtgtaacccctctgaagtcaagatgcctcttatgaacactggcaagagagtttagctggagcatagccctttcctgatagcacataaagagacggtgcccctcaccagggttcctggcttggactggacagacgacagcaccgcaagcatctcaccatcgagagactgagccttcccaacaccatttggcattcccagcttacacagctgagggggtgaagcaaggttcaaatcaaagtcagcactaataaaaatttctaggtttccaaccctacacacccatttgggtcccactcaaacatcaccacagggtggctctccccagtcacccctcaggcctggcccagtgccatgagaactgggacctcaggagggtcagagccccagcaggttccagctctcagatcaaggtgttcttttcttatcatcttctttcttctctttcccctctcctaaatcactgctcactctctgccccacacccaactcaacatttagatgctcagatagcatttcagagtcttattttatgactttctgaagaattgtgctgcttcaaaaataagagccccctcattaccaaaaacttaacccaaaagtgcacttcccaaaatgcctccaaataagtgtgggaaatccaggaagccctcgagagccactgaacgcctctgtgcccagcactttgaccagcaccgtggaatcagcttcccaaagcatgcatggggcactggaatcccagtttcacagacacagagacacagaaagcttgattcacaggcaggtgccaggagaactgcagttttatccctgtaaagtctaattccaacaggagtactcagccacattgaacttcttctcactaagaaaagttatctcggtggcctataaactctttggaaattgctttgaaaacatgttctaggctggtgttttattatttatgaagcaacactgctgtcctggtttaactgccttcctgtgaaagaaaaggcttcctgttttgtttcctgagactcctctttctccttcatgtcatcaccatcaccaccatcatcttcattaccaccatcatcttcaccaccaccatcattttcattatcaacatcttcatcaccatcattaccatcatcttcatcactatcaccatcatcgccatctttatcatcacctttatctttattatcaccatcaacatcttcatcaccatcatcatctttatcatcacaatccccattatcaccatcatcaccatcatcttcatcaccaccatcatcttcattatcaccatcacaattatcactatcatcatcaccatcatcttcatcattaccatcactactatcaccatcaccatcatcatctttatgatcaccattatcttcattatcaccatcaacatcttcatcaccatcatcatctttatcatcacaatccccatcatcttcatcaccaccatcatcttcatcaccaccatcgtcttcattatcaccattaccattatcaccatcacaatgatcactatcatcaccatcatcttcatcaccaccatcatcttcattatcaccatcaccattatcaccatcatcacaatggtcactatcatcagcaccatcactgtcatcaccatcatcatcaccatcatcttcatcaccactctcatcatcatttttaaaaaggattgcattctaaaaagttctgtgtttgaaagtatatttgttttctttggctgctgttgtaacaaatcaccacaaacttagtggcttaaaaaacccacaggctggctgggtgcagtggctcatgcccataatcccaacactttgtgaggctgagacaggaggattgcttgagaccaggagtttgagaaccacctgggcaacatattgagatcctatctctattaaattttttttaaaaattagccagatgtggtggctcacacttacagtcccagctacttgggaggaccccttaagcctaggaggtcgaggctgcagtgcactgtgattgtgccactgcactccagcctgggcgacagagtgagaccctatctcttcagaacaaacagacaaacttattgttctgcaggttagaagtccagcccgggtctcactgggctgaagtcaaggtgtcggctgagctgcactcctttctgaatgcggatgacggtaaatgggatggaaggtgcaggtagagactctgtgtggcaggttctatctcatttacgtggctgggagttgtaaatgccatgagtttcttctgtttgttggaccgtaaagcaatggaggagtgggtgaaatctgactgtgggctgagagggctgtgtgtccccgtcctcactcagaggcagacaaatactccatgacatggggaaaaggagaacgatgctgacccattccacaagtcatcaactcgcacaagttatgtatgtgcagtttactgagagtcagtcatacctaaaaagagaaaaactcaacaaacaggagggtggacattgaaaagtatctggctgaccctctgtgagtgaagatgtatttaccttgggatgaatgatcaggaaaaataaaggctgaatccagggagaaggggtctgggcagccacaaagctatgggacacaagtccatggaggtccaatgagctcatctcatgcacggttctctttttgtgatgaacaccagtgtgaccagtgtaaatacaatattagttggatcatttgttagtaacatacctttggacactggcttcattcttcagtatcttccctttatagacttggctttctgggagctggatgtttacccagtaccacctagcactagtaaattactacagcggagggcaggggaggacccactactccaggatcatttgtgggggtggcacctgactcaatattaaaaaaattcacatggtgttttatggtttacaaggcagccttgaacatctgacaccatgtaacaagcggtaactgtgagaagtggggatacaggaccaggccttctctccaaaccttgaggttacctttcctaggaatgcagagctttcagaatggtgtccattccactcactgcatttcagcctctgtggccttgggcagcacctgtgatgcctgtgctgactggcatcgtctgcagtaagtgaggagggcacagagccttccatcaatctgttcagggcatgatttgctgcaaagtgagttgtgaaaactttcggttttcaagagtttctgggtctcggggttgtgtgaatggatgtgaaccagcctccttctgtttttccaggggatctaacaaggctcgaacgctggagccgcatgtctgcgaccactcagcaggtgccggctggggctgggctcctcagacctgaaacactgacttctctatttggcacatctccagggtcatccttgcagatgaagaatccagcctgggtgtctcctgacccatcatacagcctagaagggtttgtgttttgttttttccaagtaaattcctgctatcattttacttattttattgctgtgtgtagagtgaagaagatgctgaaaaaaaagagtgagagaaaaaaatcccgttgatcctggtagatgggatatatgggaactaattttatatccatgcatgagttaaaacgagcagtaggcacatttcccatgggcgatggaagtgacctctgtcggctcagtggaaggtgccgaagaaacagcaagagacctccttgtccaggtagccacaaaggaatttccttttgaaatgtatactcgttgaaatttttaatccaggataaattatgagagtctgtactgcacatgtcagatgctgcacatgaagggttaacatcttgcaatatccatggcatcaatgtttccttttttttttcatcttgctctgtcactcaggctggagtgcaatggtacaaccatagctcactgcagccaccacttcccaggctaaagcgatctgcctgcctcaacctcccaggtagctgggaccacaggtgcataccaccatgcccagcttatttctgtattctttgtagagacgggatctcaccatgttgcccaggctggtctcaaactcctaagctcaagtgatccacccacctcagcctcccaatgtgctgggattacaggcatgagccactgtgcctggctgccagtatttcctctttgcacacatcctgcacttgtcagtggccacttgcccacctctgatttctcaagtgaaatcatcatgagaagggcatgagtggggagctgggaggtggtggcaggctgggtgctgcctgggtttcatcagaacctcctgaggtgggggccaggggtagccatggagttgggagttgtggaggaggcgagatgcttggaaggaagctgtggacagggtctgaatgggggtggctgagcctgaagctggagttgagtcctggtgggagcagaaaccttgggcacctgggagtttggcttagacagattgggctgtgcatggtggagaaaggcccaagcagaaaagctcctgaacaggcctggagcttgcacaggagaaaggctggagtcacagacctggatgttgactctcctgatctcctaagggagagaggagaggaagaaatgaacggagggtcttgggggaaattccccaagaaataagtgagtagcaaaaacaaacactgccagactcctgaggccaacgggatccctgaaggtgcagggacttaacacagccaccaagaaaatgcaggtgagaggatgagtccaggaaaaacatcactgggctggcctggggaaattggtggccctggcaaggaagttgcagaggctcagttccaggaacacacagggaaaggtaaaagacatttgtttcccacagggccagggctctaccagctcagttttgtattagacactggggccacactgttggaaataataatttagggataactgcacaatatacttgccacctttgccctatgaactccccaagagctcaggacacacattgagaaacaccagcacacaagtacccaaggtcatctgcaggcaaatagaaagcatcgtggaagcaatgctcattagacccacacactgtcccaggtgctctgctcagcagaaccgggggacagagacagcatcccaactagcagggaggtgacaatcccaggggaagaaagaaggggaaagtctctattccagcacaagggtctgaagtcatgaaaatagagcagagcagggagtgaagctgtgccagagccacgctgatggcgtcctcaccattggtgcgggtgggtggccagatgcagctgcgcagatggcaggggcatgtttcctcctctcactgtaactggcagcagtgtgcttcattgtcacgctcagagcggacccccccccccacaggttgcccaccccagggcaagacctagatcctggtgagccttggtgggacctgtgcccagcacaacacacatggacagcccagcaggggtagctgtgcagccagtggagtggcttctgtgcccagcatgccctctctggggctcattctcgtgtttcctaccctaattctaagctcattcttcagagctcacagtgcccctgacactccctggtccccctctctgcccagtgaccaaagctggcttgtccctgcacgcacgaggcaccactccatcacatgacttccatctgcctggcaaatctgcaccatttttggaagcagctgaaatcccatttacccagtaaagtcagctgaaataatcctagagaaagttcaccacctcttcctctgcctgtgcctctatcacagatttaataacacacccttgtaattcatcttgcttatgtgggtgttttctccatgagttcttcaagaaaagagctggattctgttcatctttgttcttacccctgagtatccaactcagagctttgtacatactaaatatttgtacttgtactgaatattttttggaatgaataaatgcatttttgaagcatcagaccttcaataaaaaaggttatttttttcttatccatcacgaatccgtatttgaagatttctggaagaaaaatgaatcagaaaattcagaatatccaggtgagtctggggatattccaccccagtgcagcatagacacacctcaggacagagaaattgaagttggtggggtttcttaaagctcttgctgtaatgagcgccacttggaagtaatggcttaatcgttattaatttctttggtatttcctatgataacattaatcacagcaaactcatttgatgtaatggagaccaggaacccccctggaacgttccccagcaattccgtgctaattaactgaagcatcttgtaaaactgccaccctgttttacgattaagtgcatttcttgcacactttgattaagacacaaatcccaagccaataaaaaaaaaagtgggaaagaaagaaagaaaaaaaacccaccgttttagaatgcagtaatgagagcattggtaaagtaacagagacttcactgccagaggcgacaatagctactacttgaagtgaagcaaaaagaactccccagggatggtgtagactgagaaaccttcttctgtaccttaatttatccactgcatatgtacagaagcaattttaaaatgcatattaaacactccagtgaaagaaaagagaataattcacaaagatgtcagttctgcatacccaagtgagaactatgaaagcagagagtcctatgcaaacttatatcaaggtatggaaaacaccttttaccacttaaggtaaatgttcaatttccagagggcaaatcgtgcgctgcctcattcagcagcagaatttttctccccaatgattggcatttggctatcaaggcagaagaaaatggagcatatcacaagattgcacagcttggaagtgtaaaaggcgttcactagaacaggttctctggcacccagcatgccaaggtcctaacgaaaatcgtgtcaaaactcacgtcagtcattctgtgttttttctccactggttcaaatgcacatcattctaaggatgacagacacatgcagaggcacctggaatgaggcaaatgggacctcgggtcttaaaggatgaaaccagagcacatgggcattaacctgctgactgacagcagctcaggacgagagaatgcctatgtcacccaagagaagggggtccaggccctgtgggagagaccacaggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggcactccacaccacgagagcagggcttcagagaccacgggcactccacaccacgagagcagggcttcagagaccatgggaactccacaccatgagaacagggcttcagagaccgcagaaactccacaccacgagaacagggcttcagagaccgcagaaactccacaccacgagaacagggcttcagagaccagagtaactccacaccgtgagaacagggcttcagagaccacaggaactccacaccacgagagcaggcttcagagaccgtaggaattcacaccacgagaacaggacttcagagactgcaggaactccacaccacaagaacaggcttcagagacctcaggaattccacactgtgatagcagggccccactgaagccaggggtgacataagcctgcactctgggctgcagcggcctcactggcctgcaggagaggccccatgagatgccctggagcagcagtgggtgggaggaggttgtgcaggggccttcgagggatgaagcagctttgctggcagttttggggaagacagccctacttggcctgcctttagttcatgggctgataggacagacacaggatttaaaggccaaatagaaccacataaaacctgcagatgtaaaataacaaatagcatgctgtggggaggaatggggaaagggtggggggaaataacagggggtaggctcttcaatatttaaaagttccagacatccacagacttcttatgtcattttcctgatgggagggaaatgaatttccaatatttatatacaccatttaaataattttgctaaataatcagaggtcttagagaaagatgtgcatagagccaaacaagctgtctacatgagacacagccacagccgggtggggcttaccctgtaaagaatatccttctgcacagcagaggatggcctcactggattagatggctctccttgaatcaaagccctaattttcaggtaatggccaagatataagatgtaaagcactgttgtaagatttttaaaatctgtactattttttgtaatggcaatgtaaaatttaaaaagatgaaagcatagcaacaaagataaaataaatagcatgcttttagaagaccacgcggcatggaaagcagtctctagcgctgtctttcttccgttagggtggactggaaccacagggtatgaaaagtggcctctcgcgctgtcctccttctgttggggggactggaaacacatttctccattcattgtcagtggtgttacaagccattggtgagcttccttccagagtgaatgccaaatgatacatttatattagatctctctgaccactgctgttgacgttggcggggtagcaggtgtggccataacatggagcacaggctgagctgcctgacttgcactgctggacggtgggttggcggtgttgacgctgcacaggtcatgagcgccggccctgcggatccggcgatgatcattgtggaaagaatggacagcaccctggttgatgtgcagagtgaccctgcagtcaagtctgtttgcctcccactagcattttctcatctccagcacggtgtcaatggtgccactccagccgggccaccctgcccacaaggtcttccacggggctcctccccagctcacggggaaatcccctttaatttcaaacagggcccttccacctgcccttgattccctgtggcaccttgggagcatggggctgccctactgtggagttagtgggtccacttcgagaagacagagacagagtgaagcctcaagaacagtgttcactggcagtgggaaccgtcggtcctgccatgggacgatgtgactgggggctcgtccatgccttgtcgtggacatctctggtctcagccggcaggggtgggtgggacctcagacctcagcgggtgatggcagtgggagcctgggcaggggcgggcagggctctgtggtaagacacagagggcaggggctggggtgggcagggctccatgggaagacacaggtagcgggtcaggtgctggggaggtgttgctgggcatggtggatttgcaaatttccagggcggtggggggtctggcaagtgtagacacagggcagaagtgggcgcagtgtctgtgggtgaagagctgtgcgggcgggcactgagaagaggtgcccacgtccatccccagcccctcaggcatgttcaccatcatggcgcacatgtctgggagtgagcagaggaccagggtatggaacaagccctagtcagaaatgcctcctgacgcctgtgacctctgggcagggctagtgaggggctggggagagcagagggtgtttctggataagaactcacactaaaggcctggcccggaccctgcctccatcagcagggtgcagcccaggcccagcacattctcctcctcctgggacctcgatcttggcttcccctaggcctttctggggccccccagttcctgccaacactgctgtccacgctggggccctccagttcctgccaacactgctgtccactctcttgtccaccccatgattccaaccactggatccgagcatctgcaccctgtatccgtttctctaacccagatttccttcaagtttcaatcctgtactttcggataaggactggatgccagcccctgtctcctcatgtctgagagcctctccatctccagacaccccaatctcctcgtccctgtgatgtcggctcaggtcaccattgtgtcctcttgctctcctgggtcaggcacctaggagtccctgaatgcaggcaaatcattcctcagctgtcagctattcatattcccacggccccacgaggagacgtgcttcattctacacaaacttgggcgagctccctagacccgaactgtgcttttcagtgagtgtcacagatgtcacatgggtgtcagattcaaggatgaggccagcccttggtgccaggcttggcataaatcagccccaccagcccctgcctgccctccgtgtctggtattcatgttcaaaggagtctaaaacctcactgtcttttccatgtgaatttacctttttttttttccattgcatgtcctttaaataaccaccaggtacctactgtgtgccctgggcactggggatgcagagggtcccaaccacaatgcctgtctgcaggagttcccagggtggaggtccagctgctctgagcctggtccaaggacagccacaaactagagataggctttggacaaagcagtgtggccgaggtggggtgttgtaccccatgcgatgtggagagagggaacttctgtcgaggatggcagagcagagctgggcagcagcccagcacagggccctccctcacctgagtgctcaccatccaagtccttgtagcacaaggtgagctggaagcaaaagccaccccagctcagatgtcctggtgaaacgccgggaaaggggcctcagccagggccatggcagcttagggctggttcccatcgcgttatcagcaaacgaatcttcccagaatcaagctctgatctttcttctctgatgtgaggtgctcggcgattcccaggaggcgctgatgagttgctcagcctggcagccgagttccagcagagttgagacccagcggctcctctggctgttcctgtgttgggcattctcctgctcctagcaccggctggcactctcctctgtggcctctgttctctttattgttcagttatgaggcttcttcctcagttccatgggttaaaatccagatgcaagccccccccaccaattaccccttcattctacagagttcccaggttctcgcccactctgcccagcaccttactggagcctccaccatgaggcctcccgtgctgcctcctgggatagtcacgcatgtgcctgtgcggctgccctaccagaccctggggcctccaagatcgcaaactggtccatccctctccctgcctccagcgtctgccgaccatgcttgcacgtagccgtggacttgtgccgcagattggggtaaataatcctagagcagataactaaggtacactcttcaaactgtaattcatcacaaaactaagtaatattttgtttttaaatgtacctaagcccatgttgtcttgttgatattaaactgtgggggtatagaggtgtggtagcattttactaagtcacagaggatataaacacttctgcttaagctcccaaatcgtcaaagccaggcatagtggaagagaagttgaatcaaatcgaagtttattaacaaagatagctgtcatgccaggaatcgttatagatttcgtcaaatttcagaggtatatgtaattatgaaaagccataaacacagtagtttccatgaaaaactatgagtaggtatggaaaataaaacagatgcaagggtaggaaccacagctaatagtccatgaatctaataattagttaactgattaacgaaatgcatattcattaagcacacctgtagagagcctattgcgtacaggtgccgttccagcaccggggactccctggtgtgacccacaggtagggtggctgtgccccatgaagcttgcatggaactcaccatctgtggtggcactgatccaaattcaatgaacaaggtgatttctgatcagggctctgagctctgcgtcaagtgggaggggttaatgtgctctggagtgacaggggtgggaggggtttatcagagatctgggagccaggaaaggtctcctgaggggatactcaagctgatgcctgaatgccaagagccacctgggcaaatgtgggattgtgcctggcaggtggagggcccagagcgtgcaaggccccaggtgggatgacgtgagtgtgttcatggagtagtgtacaaggccccaggtgggatgacgtgagaaggccccaggtgggatgacgtgagtgtgttcatggagtagtgtacaaggccccaggtgggatgaattgagcatgttcagggagcagagagaatgctgctctgtccagtacctgtgagcaggggaggtgggggcgggaggaagtgagaggtaggatctggtaccatctcgagaggctgcagcagggacacttgaagatctagtgacacctaagagctccctgttgctgctgctgggggagcaggaagggggatcaccctgacaagactggtggcagctgggacaagagtcgtggctgaggaggagggaaggaggtcagcttcccgatgtgtctgtgggccggcaggactcaccgccgcaggcagcaggctcaggcacctttggtaactaggcccacaacagatcctgaactccctgtacgtcgcatgcacatctacagactaaataccaaggagttttctaaaaaggccaatgacaggtcaggtggacctgaattgttaccactaattaggataaaagaggtttacagatgccttgggccagggcagtttcccggaaagtctgaaaccagctctcaggtgtgttttgtggaagacacggctcctctggcacagggctgtgaaactagctctcagacatcggtgaaactctgcctgatctgcttctcaaacagctcccgtgtggtgctgccgccatctccgccgtcaggagtggctttgcaaagacgtcttatgctgaccgcatgtcttttggcctttcttttcaagagccaaacacttcctcctagacaagacacagcaagatactatggcttcacgtccttcctaagcaaagccagggaccattcgggaaattgtttagcaatgctctgagtcttttactcttttgaaagcttttgagctcaagacagtttctggcaaggcaagtccattcattcacacctaaagctacagcatttgtgaaaataatgaaaaggtcttaatgctggcatctttaacaaacccttcaaagtcacaaacactcatgaaagcagaagccagaactagactttgctcagaggtgagcagctgatccagctcaggggtccccagtgatgattctttctgaacaagagtcctcagctcccccacttccctctgggactgcacactttctgttcccttcctcaagggaagccttttcccctgattttctgtcacagtgaggttgcattcgtggtgaagtcggtcctggttttggggccaacctcactgctcgtggggctgacagacgagaccccaggaagcatagcgccatgatgggagaaagacatcccctgggccttcctggcgactcacaaggctggatgttcttgtctacgacacctgcccagcggaaggcccagaggggggtggctctctggagttgactctgcagagcactggcaaggccaggatccagagctgcatacaccaagggccgccctcccccaggcctactgcacctgcttggccttgcctacctgccatctcccatcgcccccgcggccctggcaggagggattgtttctctttctgtgtacaaccagaacctactacagggcccagtccacagcagatggctaatgaatgtctgctgaatggatagaaaaaaaaagaaaaatgttttaaatgttcaaaatacctgaaggagatgagaggacattgcttaagttatcagggaatgaaattcccaatagaaagacatgctaactctcagtttagaaaatattatcctttaatccatggttttctctggaaaaaccaccaaagttaagaacattccacatctgagaaaacacttcacgtcgctgtggctgcagcagcaatggtggtgatgacggtgacactggcaactgcacgttgctgagtgtccgctatgcactggtcatgattctaagttctcacatcacatttaacacatgacagtcctctaatgcagacactatgggagcccacattttgcagatagggaaactgaggcagctggtccagatgacttggtcactacacagaagagccatgcagcccggctccagagcgacgctgcctccggttcctttatctacctctggtgctcccggtggctgacaacgcctgcttatgtattctgctctctgcagggggtgccgctgaatgccggtccttggaggtatgggctggactttatgactcgcatccgttgcatagaatacagtgcgtgatgcacaggcataagaggtccctcagcttcctgctcaatcgcagcccaggccagcaagccaaccataccctcatgtgagtcccagagccagagcccccgactgggcagctgggggatctgtgacaacaggaacgaagctggtgagttcggggtagtgtgttgtatagcatcagataactaatagagtctatttcctcagcaatacaaggatcccccaaaagcctcataaagataatcactgaggactccttagtctttgaaatgtaatcctcatttcattaagtttcagtgaccatcacattttgatgacttggtaaaaattcagtactgatggaaatcatgaccatattattacatcactgaggtttctctgcaaaacaggaacttgttgatcagggtattcattttatgcaggctgagatgcaaacttcataggcaggctgcacaccagagggtaattcagtatctctgcatctgagtaagaaagttcttaaaccactgtctctttttatgtcaacttacagggaagaacattctccaaatatcttagaaattcagtcaagtgtttcaaagccaaactaaattactccagctatttgtcggagttggaaaagaaacttctaggactgagcagccataagatacagccatagataccctgtgattggccgggcacggtggctcacacctgtcatcccagcactttgggaggccgaggtggggagtcacttgaggtcaggacttcgagaccagcctggccaacatggcaaaaccccgtctctactaaaactataaaaattagctgggcatggtggcacgtgcctgtagtcccagctacttgggagactgaggcaggagaatcacttgaacctggctgggcggaggttgcaagtgagccgagatcatgccactgcactccagcctgagcaacagagcaagactccatctcaaaaaaataaataaataaaagatactacgtgattgtattagcatcacatctgcccacagccttggaaagtaggcagacgctcctccctttaagcctgaggaaacccaggcttaaagaagtgacatgatcagccagttcccaccaagccccacctcccacacgggcactggggacaggggagggataagtagccagttcccaccaaaccccgcctcccacacgggctctggggacaggtggggggtaagtagccagttcccacggagccccgcctcccacacgggcactggtgatgccctgcgcactctggctgtgttgtcaggcactcacacagttagatcagtaacttgcagaaaggctcctcatataccaaagttgagtggataaacagccttttaccctaagagtgacctcagagtttgcaagaacccacacatttcttggtccttatacaaattcagaggaactgcagacagtggtgtcaccagaaccatttagacaataatgtgtgtggacgagacatggagaaggcttccatagtcggtgatgctattccaggacaggtgaaactgctcaaactcctgctattccaggacaggtgaaactgctcaaactcctgctattccgggacgggtgaaactgctcaaactcctgctattccaggacagatgaaactcaacttcaactaaaccaatcaatatattcaacacaccaacacacacacaaatttgactccagtcattgataaaatagtaaaaacaatagtttctttcctgttttaaaaggagcttttccctttcattcagttaatttaacagggagtgattccatttttttttgtagtaattcagtttactttattttaaaaaataactcagtgtaccaaatgatttaatgacttcaatgtatcaaaattttattggctcataacctacatctatttcataaaataaggtttgatctaaaatgacccttgggcgtttccaagttaattaattagcaatacttcggaaaggcacaagctatgatgtgaaggctttgagttaatataacaccagttccctatcatatcagcccattcttcaagggctttgcaaagcagcagttctccaaatgcagcccttacgccaggtgccacctggaggttgttagaatttgtagaatgtggggtccccccaaacccctgagtcataaagatgaggaggggaatgcagagtgcagggtaccgcccagaacccctgagtcatagagacaaggaggggaatgcagagtgtggggttcccccccaaaccccaaatcatagagatgaggaggggaatgcagagtgcagggtcccctctaaaccccgagtcacagagacaaggaggggaatgcagagtgcagcgtcccccataaaccccgagtcacagagatgaggaggggaatgcagagtgcagggtcccccctaaaccccgagtcacagagatgaggaggggaatgcagagtgcggggtccccccaaaccccgagtcatagagccaaggaggggaatgcagagtgcagggtccccccaaaccctgagtcatagagccaaggaggggaatgcagagtgcagggtccccccaaaccctgagtcacagagacgaggaggggaatgcagagtgcagggtcccccctaaaccccaagtcaaagagacgaggaggggaatgcagagtgcagggtccccccaaaccctgagtcatagagatgaggaggggaatgcagagtgcagggtccccccaaaccctgagtcatagagacgaggaggggaatgcagagtgcagggtccccccaaaccctgagtcatagagacgagtaggggaatgcagagtgcagggtcccccctaaaccccgagtcacagagacgaggagggggatgcagagtgcagagtccccccaaaccccgagtcacagagatggaggggaatgcagagtaccgggttcccccctaaaccccgagtcacagagacgaggaggggaatgcagagtgcagggtcccccccaaaccccgagtcacagagacgaggaggggaatgcagagtgcagggtcccccctaaaccccgagtcacagagatgaggaggggaatgcagagtaccgggttcccccctaaaccccgagtcacagagatgaggagggaatgcagagtaccaggttccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggagaatgcagtgcagggtcccccctaaaccccgagtcatagagatgaggaggggaatgcagagtactgggttcccccctaaaccccgagtcatagagatgaggaggggaatgcagagtgcggggtctcccccaaaaccccgagtcacagagacgaagagggtgctgatcacatcccaccccagcttccaggtgcttctgacacagctgaaacctgaacccatgactttcagggctgtggcctcccccgcccccgcccacatgtgtccaccagccctgggagtgagtctgaggcagggattctcagggacgctgcctgcatgccccggaggagtagcgtgtgtgtgtgcacacgtgagcttgtgagtgtaggcttgagaccgtgctgccgacccagtccctggaatccctgtgctgagttgttctcatgtggctgctggcccagggaggagcgttacggacaactgttaagtggaaattgtctggacgtaatgcagttcatcagctcaaaagctgtgggtctggctgtgtgagccaacagcgctagtgtcctggtgcctggacacacggatgttctggggctgttgctgaaactgcggcacagtaagccctgcagcctccctggaatccctgaggaggagccggctcacccagcgccgcgagcatctcttcctgactcgcagggggcccgtgagatggagaatctgcctgacagggtgcacttgcacagccaagcaccaagaaggaaaatggcatttcattagccatggagacagccgggaacccagcagccttctttattctggctcatattttctcatcattctcagggagttgtccaggtaacaatgaccttgtgtaaaccagcgtccctgcctgagtcctcttcacctgaaaccaccgccccacgccaggctccacctccccacgccaggctccaccccccacgccaggctccaccccatcccacgccaggctccaccccatcccacgccaggctccaccccatcccacgccaggctccacccaatcccacgccaggctccaccccccacgccaggctccacccccccacgccaggctccaccccatcccacgccaggctccacgccaggctccaccccccccacgccaggctccaccccatcccacgccaggctccacccaagccagcggcaccggttctggctggaaggttcccaaacctaggccagggtgtgaatgccaggggccctgtgagtggtgagtgatggttgctgggtgctgggggctggcgctgttcccgccgcgccctccatgaagctgactctcagtcctgctctctgacaccgggctgtgctcagcagccacgagctgaccacgcggtgaggctgttcacttttctccctgactccagctctccccacatgcagctcatccccgacatgggctcttatcccaccaaccgcttctaaagacctgcagaagctccctagtcacaggacgtggcgagcccaatactcacgtctgcccctgacttctgcactaggccctgcctcagccactggcctcctgcccctcactgtcggcctcaggcccaggctctctgtgtagaggcctcctggcttccccaccccgtgctgctccccacccggtgctactcccctggctgagcgcccacacttctttccccttttccaaatcccacctgcaggtggtggtctctagcactcctcttggttcatgggccttgactgacagctttctcctgcagccatcctctccacaattctgggagcgtcgactgtgctcactcaacactccctttaacaaagtgacatcagatgtttgggccctacttgcatttaagccatccagtgcattccacataaaaagcgtgcacctggaggaaactaaataatcacaaccaatcactctttttttagaaaaaagcagcagctctctcaatgtagaccaatttatcggtctaaactagagagaccgggcaagccacttccatcttgcgagtttagcatatttgcctgttgacacctacacttggaggaagccattctgtgtgtgtggtgtgccttcacaagtaatttctatggaaaacagccgtcagacagtcatcctggcccaaggtgacctcattaccagaatttgttctagttgtcattagacatatcacactatgtcactcaaaatgggaaagaaagagaagatactgacatgccgccccagtgattagagatgaaaatgtagttataccatatatgatccctgcttggagactatacggatagggtttaagattcaggcccccctcagatccatcactgtggtcctgaagcctctgtccttcttctgttcttttaaacttctctgtgtagatacagcaagtgtgttttctactcactgcacagccagcgctgctcttgaacaaactcctgagggaggtgcacggaaaccatgcatccaaatccggagagcagggagaccagccggatagcccacctggctgacgagacccggcctcgctcagaaagctcctccaagatgccaccgcgtgtgaaatgcttggggttgaatctcgagagcagggagaccagccagacagcccacctggctgacgagacccggcctcgcttagaaagctcctccaagatgccaccgcatgtgaaatgcttggggttgaaatgtaacgaatctctcactactgacaagagaaaggccagaacacaaacacacttcctgcttccagatggatggaggtgggaggagggaggggttctgaccatcttctctggtgctcagtgaggcaatagcatgagatagataccctcatctacagccccgctctcgtatgtccgggggaagctatggagagggtgctgcaaagctgccagcaagtatgtctgcctctgacgagtcactgttggatgtgaggcaacgtgaaggctccaccactaggacccaggcaagactgccaagcggatgaggcttcgctttaggaccatggactctggcggcagataatggcctgagaggtcagctagtccaattgcttccttgtagacacgcagaaactgacgcccagagaggcagggcaccccgtgtgtggtcaccgtggtcagtggcagaggtggggctggaggtcagaactggctgcatccgtctccatctccccaagcacaggccatgcctgcctctcccaggtggcatctcctctctgtggtcctttccctcctgcctgcctttctgcgacatctgcactattcagacatcacgcttcctttcgtcctcactcaaaattcccattcactcagcattaccacggtttgatattaggactgcttgattcaagccaatagtgctaaattagaaataatgaaggcttcactcttccacggggttctgcccttggaagaactaatgaaacccaaggaccatccagttggcaggactggaagtaactgggcagaggagacattttggagcaggtggtcggtgcccacccactgacaggagctgccggtttctgacccactccacccctcctccaggaccctccagagtgaatctggagcgagggggcccagtgactttggggtcatttgcacggtatcagctatagccgcagtgagagggaggctgctggacacgctggggttcacctgtgtcccaggagaaccccgctttaggatataacgggttcatgcactggagtagctgccggtacacatctagggagtgatgatccccctccaccagccagtggggaatgagcccgtgaaggtcacagccagccatgaaacagctgcactgccccagcacgccgcccacgcttggtcggcaacacagagattccatttcttcctgggattaggaagcacgaagtgtccagatctgcttctgaaatctcttcctcccttaaggtaaggtgctgtgtggagcttactggaacctaaacgggggcaagatgaccggtcactaaagggggcgaggttaccagtcactaaagggaaagggggcgtgatgaccagtcactagtgggggtgagacaaccggtcactaacgggggcaatatgacccctcactaatggggtgatcggtcactaaacggggtgagatgacaggtcattaatgggggcgtagtgtccggtcactaatagggtgtgatgacctgtcagtcattatctcttgcataagagacttcccaggggcagagcagacccggtggacagcaggagctgcctggtcccactgctgagttttatgtctggatgctgaatagctggaggaagcggcctgctggttttgttcacactgggtgaacagttggaatacaggttcctcgggcctgtcctaaatgctatcagtctttctctagagatggggcagttattatgcagtgtgggatccacagttacagagcggatgggggactaagaacatccattctgcagaaagtgggacattcagggcaatagggaatctgcttttcaatgcagcatcccagtggggtggccccatcacttctgacacctccatcactgatgcccccagctctccccacacctgccattccccacgttaatgcagcagggatccagagaagggtctccggacatcactgatgcccccagctctccccacacctgccattccctgcgttactgcagcagggatccagagaacactgtccggacatgcaggggaccggagtcctcaccactcccccttttgtcttctccaagccagggtcaaagctgcctcatgcagacggagaggagaagctgcgttccctgcctttcccgaattgtttgtggactgtgagtgatgcatgtcctgtggcaccatgggagcaccagggaacaccatgctgtctctccccggagcccccactggcgtcctggccatttccagcttgtctcccaaagacaggcttctttgtgctttggtcacacggagaattatcagtgcagtctctgtctctctctctcatttccccctaaattgccacatgttgcaactcccaggcgtgcccccagctctcctgaggctggtttgcagtggccgggcccagctaaagcaactgaacctccagagcagaggacagtgtcctgcctgcacgtcttgacatggccccacaggagggttccctgtctttcacgtgctgatagaccaaacacaccaaacgcattcccgggcaggtgtgtacatcagaacagtgatgaatcagggacccttcttagtgctactataagtaacaacagtgagtcagacgggtgcaaaccctttggaagactcagtctgcaagccccagggagcacaggggggctggagggaaccgggggagggatgcacaggcgagaaatgcccatgacccggtccacaggtcatgcacgtccacactttctaaaaaaccacctacaagaaaggggttgtttcctggcccccagtggggtgcagaatgtcagtgctgggctgcaccctgggcagggctgctctgggcagcatcgccacacccgtgtcccattcttggggtgcatccccttctcacatctgtgtctaaagccaggaatgggcagtgtgacctgaggaaaatcagggacaccctctgtgtcctcatatgcaaacatgtctctttcatgccagttaaatgaagaaaaaggcaagacctaaatcctgaactcctaccgctataacacattcctctgcgctaaggaactgacattctaaaggtgcagatacccccgggctggaggctgaatgggcaagaagatcccggcacagctcaggctgagtcgaaagaccgtggtttttggccaggcacagtggttcatgcctgtaatcccagcactttgggaggctgaggcaggcagatcacttaagcccaggagtttgagaccagcctgggcaacatggtgaaactctgtctctactaaaaatataaaagttaagctaggcgtggtggcgcatgcctgcagtcccagctactcgagaggctgaggtgggaggatcgcctgagcccaggaggtctaagctgcagtgagccgagattgcactactgcactccagcctgggtgacagagcaagaccacaccttagaaaaaagaaaagaaaagagaaaaagaaaagaaagaaagacagcggttttcataagggggtaagactcagagggcagaagaaagcggagtcttgtggggggcaccatctgtggctgggtcggagggacgagggctgctgtagccctttcctttctgcaccgctctgaccaagtgcgtctaaggggtggagggatgaggggggtgggtgccttcgtggctgcttagccatgattctgctggacaccatggtctgggggaggcagcgggggcgggtgccacctcaccttcgggtacctgacgggccggaatgacacatccttgtcatgtccaccccacttcacagatgggaaaccggggctcaggtaactcaagggaagcagcattgagaggtcagggcaggccttctgcccaatcccccgcctgctggctgtgttccttccacactcggccaaggtctctgcccccgcatcccaccccgccctgcccagggctgcgctgacctgccttctccccctcctcctcattagctgcaaagaaaactcttctgggggctgccaaatgcagagctgcttcgtgtcccttctttgacagtaaaagttgttttcttggaaataaatcaaatttgtatttctcaacaaaacctgccctccatccctctatgaagaaaaatgcaagttgctcttctgcgctccaaatacaccgagacgaaaacaagcccaggtgaagctgcagctggggacacgagttaatgtgagtgcgagcccagggcagagcgggcccagataaataattcatgagcgccaccggggaagaccgggcactcgtggagttcaacagatcataagcaggatccagggtcgtgtagcgacacagcttcccaagcaggcgagtgacctggagcacagaggggagggacggggacaggtgcagcagagattgggcacgggccaggaatgcatcacggcacctgcgcacaggggtggcctccaggggctccaagtcctctgggatccaggttctccttccttcagggcacccccacccaccctctccccaaggcttgggccacactccatgccaccatgcccaacggtccccgccctgcacccacctctggcaagttctgggcagggggagagcgacacaaggcaagggaggagacatcggtggatgggggagcagggcaggctgggggtcagggctcagggcggtgctgacagtaggacatgctggtccccttcccagtgaagtcccaggaaacagcctctcatgttgctgggccggtgctcaggagctggggctgcctggggcacaaagcacgtggactaggacactggaatgtcaccgagcttccctccgatacagtgggagggaggacttggcgcacagtgggtgagtgaatggacaggcaggagtgaccagcccagtcccagcgcttaccgaggaggactggggaggggggccgagtctccagtcaggcagagagagctgctggtgtcaaccctgccagcaagatgtgccccagatccccagagtccagcgaacttccctggccctggccagagtccacgtctgactctgaaggtgtgcggggtgtggacatgagggcactgctcatctccactgccaggctttggggtgtggatgcaggggcactgctatctccactgccagggctgctggatatgctccagcctgtcacaagccaaggcgaccgagcttccctgagaggcacccagcctgatgcagcacagggcaacaggctggggcatgacgggctctgctgtttctcagtctccctgtgatgggagtcgcaatcccatcctcggagggtggctaaggggatccccaagaaagtacccggacaattcctgccacagagacactttaaaaagggcaatggccggcatttctgaggtttccttttcctaaccaggaacagattctctttgacaaatgggtcttgccacttgttatgaacccaatgccgtgggcccggcctgcacttcctggtggagtcctggccccacccagctcctctacacgtcctcttcactgaaggaaactcacagagccctggtggcaccgggtgctgcccgtgcagggcacagaaactcagggccggtttccctctggctgagggagggtgagggagggcgagggagggcggacctgtttcctgttaaaccctggagctagcacagacttgcagcctgcctgggacccagtgaggatctgtggagatgggctacagggagtgttggggtgagagctgcacggggctgttctcagcagatcccagcaagtgacacacccaaggctggggacccaggacaaggccaagggcacctaagcaccaagcaagagtgagattagaccctcccagaagtgatgcacccaaggctggggacccaggacgaggccaagggcacctaagcgctgagcaggagtgagatcagaccctcccggggctcaaaaaaggctcccagcatcggtcacagcccgtgcccctcgcaggcctgcatgacagtcagggcctccatcaccatcaggccagcacaggcacagcccagacatgcaggaggctccagccagtatttgagaacagacgcctgagtgccgggactcggcccacagcccattcgcccagggagactggtggtccccatgtgccacccgagctgtcaggcactcagtatgtttttaaagcctcactttttaattatatcatctaatacatggaaaattgtgtatcactactgtaaatgaaaagcagaatcattgctgtgagaaggccaccctaaaggtgagttccatgaaaacaaaacacccaaattttgttcatttaaacgtgatcaaagactgcatggcgacacgttctctggaaagaggggctgctcatggccccgagtctctcgctctccaggatgagttgggagtggaatcgccatggccacggagtcccttgcagcctctgagcttctgcctgtgggaagagctggcaggttgggggaccggccacacggtctgtactgagtgggtctctcagcaccacctcattctaacaggagggctcctgaaatcagcgccttatggtgctaaggttttaataacacattagaatacacagaactaaataaaaataaaacaaaacaaaataaaacacaaaagctgtagaggattttctgctctggaaaacaccagtgcacacaagcctttatctgggggtcccctggaggggttggggtggcccaacagagagcagggagcagaggcagatgtggggggtcacactccaccaggagcccccaggcaccgtggccacaggacagccgagcttgtggactgtcctccagagtccagctggaatcactgcccacgcctaaatctaagaagaagtatgcgatgggaagaccttttggctccttctgctcaggaagcatagacagtatcttcagttttgcccacgcaggccccttgaaggggacacacagacgccaggagacagacgcgtggcggccgggtcactcccagtggggagctgtggtttgggcgcctgagcctggagcccccgtcttactgggaggtgttcccttatgacggagcccacggggtctgcccaggtcacagtcccctcccacaggccacgcttcaggaggatcatcgcaggtgggtggcctctattgaggtgtgagctgcaactttccattttctgatcacgagctctaactcattttcccacaacatattatgggcggctcataagattttctatcaaaacgtaaatagattcggatttctctgaagagcaggtttcctatatcggtgcgtacctgtccgtgttcacattaagaccaaggacaaaagaggaaaatagattttttcctaggttgtatgactttatgaaattaaaaaaaaaaaccacctaagcagccctgagcctccgcaaaaaaagaccccacggggacatcccgtacctggtcagagccaggacataccccatgtgcttttttttcctcccctttcagaaatgtaatttccatgacgcgtccacccagggccaggaaccacagaagagaaagagcagtgggaagcttccagaaactcccatgagggctcaggaaacatggggaggtggcgatcggaatcatctgccaggcctggagagccagaggtcggccagccgggaggtgtcctgtccctgagtccccgccctggctccactttcatgcaagagaggggcagggtgggccacagagctaggtcctggagagccacccccaacccagcacgggtccaggacagcaggaagaacccatcctaggtcggaagttcaaatctctgatttgagatgagtgttgaccctacgggggttgaaggcctctctggagagcgtcgattgagcagacaggcccagagctggacgatctctccctaaaatgccaatggcctcggaagacaaaacccaaggggggtcagtggccccccatgcactgagctcactgggtctccctgcgcccgtgtctggagtcatacacaatgctgttattttactgcctaatttcaaaatgcacggctgcagtttacaccctgagctgtggcttgaataatttatcgcaaagtccctgtgtcagtgaccagtgtgttgggtgttgctttgaaacccacagagaagacctaatgtatcacgttgttttcctcctctttaaatattattgacacagcgatacttcactacaggccattaatactggtctgcttctagaggagaaaataccgatgcaggtcagggcaggtgactcgctctgagccacttaacactgggtggcaatggtaacccgccactgcttcctttttaatttaatccacgaagcagcacagcaaagtttcctcatatttctcctcttaaagctgacagaaaataaccagcagaaaacaaacaacacatcttagggaagggaatttagacaaggacagagaccagggagcgagaggaagatgcctgtgtttcccacagtcattgggatgaatctgaggcagcgttagagcgagcgccttccactttggcccacagctccttgttcctaaaatcagcaccgcatccccagcttacagctccttgttcctaaaatcagcaccgcgtccccagcttacaactccttgttcctaaatcaatgccgcgtccccagcttacaactcctggttcctaaaatcaacgccgtgtccccagcttacagctccttgttcctaaaatcaacgccgcgtccccagcttacagctccttgttcctaaaatcaacgccgtgtccccagcttacaactccttgttcctaaatcaacgctgcgtccccagcttacaactccttgttcctaaatcaacgccgtgtccccagcttacagctccttgttcctaaaatcaacgccgcgtccccagcttacagctccttgttcctaaaatcaacgccgtgtccccagcttacaactccttgttcctaaatcaacgctgcgtccccagcttacaactccttgttcctaaatcaacgccgtgtccccagcttacaactcctggttcctaaaatcaacgccgtgtccccagcttacagctccttgttcctaaaattcaacgccgtgtccccagcttacagctcctttgttcctaaaatcaatgccacgtccccagcttacaactccttgttcctaaatcaacgctgcgtccccagcttacaactccttgttcctaaatcaacgccacgtccccagcttacaactccttgttctaaaatcaacgctgtgtccacagcttacaactccttgttcctaaatcaacgctgcatccccagcttacaactccttgttcctaaaatcaacgccgcatccccagcttatagctccttgttcctaaatcaatgccacgtccccagcttacagctccttgttcctaaatcaacactgtgtccccagcttacaaacgctgtgtcacactctacggtttctatctggttttattttcatccaactctctccaggcctgcctgtcactcagggagagatctcaccagtccagccacatctgggagataaaaatgcccaattcaatgagcatttgttaaacacaccccaaggtttgttgccatgaattgtaaattcctggaaggcagcaaacctgcagtcttagagtaggatggggcctttcagcccctgaacgtgcatctgggtgtggaccaagggcttgccagccccgcaaagggcatgggcagcctgctttgcctcagcgtccacatgagcaggcggcgtagcacctcctgtcagaggggaggatccacgtgtgcatgtggaggtgcagaaggaggggtcatccatggaaatctgacttctacggcaaactcaagtttaagcaaaagtagactacccttcggaaatgcacactggaacgatagcaaaacatgaaatcgacgtaagtgtccatcagtggatgaatggataaagaaaacgtggtgtgtccacacaatggaatactactcagctatgaaaaaggatgaagttctgtctgttgcgcacaatggaatactattcagccataaaaaaggatgaagtcctgtctgttgcacacaatggaatactattcagccataaaaaaggatgaagtcctgtcttttgcacacaatggaatactattcagccataaaaaaggatgaaatcctgtcttttgcagcaacatggatggaactggagccattatcttgagtgaaacaatgcagaatcagaaagtcaaatactgcacattcacacatttaagtgggagccaaattacatgcgtgcatggatgtagcacatgggacaatggacgctgcagacccgggacgctgggaagggagaggagggtgagaattcgccgctcgggcccatctatgttattcagtgatggctacactcaaagcccagacttcaccactacacaacagatccacgtagtaagaccgcacttggaccccaaacattcatacagtaacaaatattactaagagaacctactggtcagatagatctttgctttcctgccagtcagtgccaggggagctttggtctctcacacggcttagagcccttccttccaaggcgggcagctcctgcgtgcacatgggggctcccaccaccccgagggccggtcccccatgcctgttggagggtggtgtgggtttgctctggctggtgtggacaagcccttaactgagaacagggtcaggggaccttctagctttcttctctagctttcttcgtctctagcttttctttttttaaggcatttattgctcctgaaaataatctgtgcttgcaaagaaaaaaagtcattttgtttcaaatccagtgataaagaatggatcttttcttctcctagcaaaccattttcccttgccccaggggaccatgtatgacctgagccatcttcccccacgccaggccctcaggagacccaacctccctgacacatcctaggcccggggcgggtgtggggaggcacgagcttctctggaaaccagcagctgtcgcctgcttgcccatctgtcaccaagctctaagtcctgctgtctgctcaacaggcatgaggagcagtcccacagtgcaatgaggccggcacgggggcccagggagggctcggccccaggtcccctgacgtggggtgtctgccctccccaggaggacggggttgggggcacatctgatggggcctgggtcatgcctgccagttctgcacagagctgcctcctgagtgcccacgtgccctgcggggctgcctggcggctccatttgctctgtgtctgtggagcaactgcgcccctgggcccgcctggcctgggctcccactgaggtcacagcacctgggtcattcagctccaaggatggggcaggccccacagggcaggaccccctccagcagttcctgcctgtcctgggaaggccacggagacagacccttgacttcaggacagggggctgctctttccataaatccccctggctggcgcctggagcccaggttcctcccacacagccagtcattcctgccatccacactggccctgcaagggctggaagggccacaggtgggcctcactcaagagggaaggaccagggaggagaagggagccacattagcctggctgggtgggcaaagccacgtcagcagccagaatgtccctgcagataaacgtggggggaggcatgacagaaagccgggtttctacagaaagaggaggccagggaggggcagagcctggggggaggagtgcagggaggggcaggcagagaccagtgggtcatagggaccctgtggagcccccagaccagcccctgcacagaggagaggaatgtggggccggaggaatggagtgcaggggagatgagtgcacgggagaggagtgcaggggagtggagtgcagggctgggggagagtagtgcaggggagagtagtgcagggcagggggagaggagtgtggggctgggggagaggagtgcaggggagaggagtgcagggaggtggggagaggagtgtggggctgggggagaggagtgcaggggagaggagtgcagaggagaggagtgcagggtggggggagaggagtgcagggtggggggagaggagtgcagggtggggggagaggagtgcaggggagaggagtacagggcgagggggagaggagtgtggggctgggggagaggaatgcagggcccgggaaaaggactgcagggccaagggagaggcccagggcccgggctgcagcctggcttcagcttttacccggcagcctcagagctctacttttaattaagtgccttaccaaataattaatttgtactcctctgtggaataggaaaagagccatgaaataattaaagaattaaaacactagctcagagccaggagcagcagtcagggctggcccggaggctcctgggctctgaccacgccatccatccgctgaggacagcagaccacctgcgtgagacgcggaggagcagcagctctgccgtgagaggagcccgtgtccagcctccaacgtagatgctgtgttggacagagtctaaatgtagaccgaataagctacctcacatttcaagctcagtaaatgtaatgtttaatcacacctgtaatcccagcactttaggaggccgaggcaagtggatcacctgaagtcaggagatcgagaccatcctggccaacatggtgaaaccccatctctactaaaaatacaaaaattagctgggtgtgttggcaggcacctgcaatcccagctactcgggatgctgtggcaggcaaatacttgaatctgggaggtggagcttgcagtgagcagagattgcaccactgcactctagcctgggtgacagatactccatctcaaaaaaaaaaaaaaaaaaaactctacttcaagttgtaattctgagattttgaagcacgtttggctggactccatccttcatgccccacgtaagagggttgtgttctgggtagagaagtcatctttgtgcggggtgcgaggcatccgggggccaggggactgtgagctgcagcaacagtgacccctacagtgctgacagtgtggggcggtcccgggtccgatcctggctgttcctccgagcggccgtaggggtccgccctggcccctacactatgcccaccaagaggacctcctgtaaacgtgagcctcatgccagagaacccacagccagcccctcacacccctgcactgaccggcttttatttccagcctaaaagaagagaaggcagatttagttgcctgaacacaaaccctccttctccctcgctcaagccatcagggggttctagtcggcttgtccactctcatctcctttaaataaacagcaaaaccgttttcacaactcagctcccaatgtgaaattagtttcatggtgactgagcaccgtgtgctgcccgaatttctcaccaacctcagacgctctcgttttcacgtgccacggagctacacaaagataaagcagcccaataaagacccggctgaaggcttttgtgttctctcactcttgcccacttaccctgcgttttccaccaacacaggcaggggaaagcttggcctgggaacctgagttctgggacctgctccctggctggacttgctggcacccaccggagatgaggcctccaggaaacctgtcatcgggagactcgtccacacgacgagaccagggggaagaggtgctgtctgcagctgttctccgcgagtccctggcccacctgataacgagttccgtaactggaaacatcaaggtgggggtgtgggtctgagacttcactgcactttattaaatctcagccactcaaaggtggggtgcagactggggttcgcagctccgacataccacacttgatctcagatgtttacctgatgaactttggcctctggtttttatttttactttttttttttatttttcattattattttttgagtcagagtctcactgtgtcacccaggctggagtgcaatggcaggatctcagctcactgcaacctccacctcccaggttcaagtgattctgatgcctcagcctcgcgagaagctgggattacaggtgagtgccaccatgcccggctaatttctgtatttttagtagggatggggcttcaccatgttggccaggctggtcttgaactcctgacctcaaatgatccacccgccttggcctcccgaagtgctgggattacaggcatgagtcaccttgcccaacctagtttttatttttttaattaactgcttgcctcactaataaaacttctcttttgccaaaggatgcttctcaggttgcattccccagtcaggggaataaccagaggattaaaacaaaaggttaaagtgatcacttcaaaaacaattgccaaggcccgtaagagaagggtttaaaagccccagggccatgcttggtttcaggccagagggttctcagctggaatcacccaacacgtgaaagccgtggagaggccgggatgaaagcacctggtcaccactaacgccctgcacacctttccttcttcctcctcctctttatttcttaacaggaagctgcctgacatttcggctttgaggtctactgggaagcatgactgaagttggggtgcagggtgggggctggtgtccggccgcaggtggggagcagggtggggctggggtcgggccgcaggtggggagcagggtgggggctggtgtccggccgcaggtggggtgcagggtgggggctggggtttggccgcaggtggggtgcagggtgggggctggggtttggccgcaggtggggagcagggtggggctggtgtctggccgcaggtggggtgcagggtgggggctggggtttggccgcaggtggggtgcagggtgggggctggggtttggccgcaggtggggagcagggtggggctggtgtctggccgcaagtggggtgcagggtgggggctggggtttggccgcaggtggggtgcagggtgggggctggggtttggccgcaggtggggagcagggtggggctggtgtctggccacaggtggggtgcagggtggggggtggggtttggccgcaggtggggtgcatggtgggggctggggtttgaccgcaggtggggagcagggtggggctggtgtctggccgcaggtggggtgcagggtgggggctggggtttggccgcaggtggggtgcaaggtggggctggggtttggccgcaggtctggtgcaacgtggggctggggtcgggccgcaggcggggtgaagggtgggggctgggatctggccgtaggtggggtacagggtggggctgaggttcggccacaggtagagagcagagggccttctcccacaggcctgctcttggctgtgcatgtcacagaggggaccacactccacactcacagcaacccagaggtagagttcacgtgcaaagaatgggaagctggagccttaaataatttgcctaagttcaggcagcagcaaaagccagagccagaatctggaagcaggtacagctgattccaaacctacctcctatacccatgacccctcaggaccacagggcctgagtccacggctggggacgtgcacagcagggggacctgaggaccgggagggcggcacttcagcctcacgggcgctcccaccatgcagacagacgcaggcagtgtagtagatggtaaaacggccgaaaaccatcagcagcctcaggaccgccctgtcatgatgccaactcccaatccgtgctgagagcccggcactgcctcagggagattagcaaacacttttcatctgtttatacacaaacagcaggcatgggcccgctggccttccaggaacatgagtctgcgtgactggctgttgtgccctcacccggaaccgtgccaggcaccgaggaggtgctcagtaaactatggggttgcatcgtatttgaggtcatccggaggcacccgctgctgcactgggactcctggagatcctcctccagccggaagctggccaagctgtctccaggtcctgggatcacgttgtttcagtggagacgatggccgccagcttcagattcagaaatggcacttagtgcctcttcccttggagtcacctcgggtgacatggggtggcccccatggccagcactgaccagctctgccccccaccgaggcgggagccacatctcaccaccaaatgcccttttatgggaactgaggtgcaaagcgggggcttgaggcaagcagcccccgcgggaaacacggcgtggtcatcaggcgagtgctgccttagagacccgccccctgcagaggctgtgctctggatggtcactcactcacccctttattaagagttggttctacggaggatgagagaggcagggacgtgttttgggagaaggtcatatgaaaaattagtgccacagagtttcggcccctaaaaagcttccagtttcacggtgaggggaaatgttgtaaactaaaacctctggtggggagagtcacttttgttgcccgaatccccagtacagtggacggcgcctcgtgagccggatggcaacctggccagcatgcagtgaaggaacaacggggccaaatgccgcaggtgtggatgagggagaaaacaaaagctcccactgcgcccctccctccctggagcttagggttcatctgaggggtgaagaggaggatgtgaaggacaccacgggggtcagggagcctgggaaatgtccaggaatcctggggccggggcctgctccctggaagcagatctgaggacgtttcgggcaggtcagctgcagcgagagaaatggacttgccggggaggaactcccggctgcctcaaagctcagcaggtccacggagcaggagccacacaaggctcttcaacaagccccgtgaggtggggagctggcctggaccaccctggcgtggacacggctgggctggatctcatctgtggaactcctggcaggagatggagtgccctggtcctggccggggtttggcagcacaagtgggggtctgctacaggccgcttggatccaggggaggaggaaagagcacaggagagggcaggagatgtttggcttctgtcatgagctgacctgtgtcccccaaaatccacaggggaagccctgaaccctcatgtgactgtacttggggacagggcctctaaagaggtaaaggtaaggccgggcgcggtggctcacgcctgtaatcccagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaaaaaatgaggtcctgagggggccccaatccaataggacctgtgttcttcaggaagaggaagagacacacagcctgcatctacacagaaggacagcccctgaggacgtggccacgacgcagccaccgtgagccagggaatgcggccccaggaacaagccctgcccacaggcgtcccagacccaggccttggggactgcagaggatggatgtctgccccacctgtggggcttcaccgtggccacccgagctgactgacaggggtggggaagcacgccatccgggctccagccctgcggttggcgggatccaggtttcttggtggtggcgagcttctcacatgggcttggcggcacctcccaacacgccaaggccagtggtaaaacgggcctctgctttttttaaagaatagcttgtctaatgactctgagagcatctattaatttcatcactgttgccgacttaatcagcaaacttcatttacaattccacaagctacgaaaaatcatttgctactgtcatagcagtataggaaacgtgtcagcaccttgggagcctggccagtgtttcatttcactgagttccagaagactccggctctcggatgggagcagcccccatggctgcttttcggctcctcgtttggaaaacttggtgactctctaaggtgataggaaaagcaaaaattgctctgttaatgcttccagtgcccaatttgggagtaaagaatgggttttatcaccaaaaagaagacttcacatgatgtttctgcctgagagaagtaggcagggtctaggggccatcctagcctcctcccatcccagaggatgagagagggaaccgcccacttcctgtgtggccccaggactcagagctaccctcaatggcacccgaattttattcctaacccctcccagatgcttcctgtgtgtccacagctgggtggtggttctagttttaggttttttatatttaaaaaaccagcagattaaaaaattaaccagcatctatttttaaagaactgcatgcattcctttgctataaataacaccttagtggactctaaaaaaagtaattcaaaacaatcctttttcactgggtttgctgcttgtttacattatatttctctgagataacagaaagaggcacatcttatcactttcctgacagtttcattttcaggatctgataatgctatgtgtgcttatatggaaaatattgatcccactatactctgctcttcctaaatttttcattttttaaaaaattcatgacagtatttgattcccagaggttttacaaaccatctccttcaagcaaatgcatgtaaatttcacttctgtgactctgagttcatttttaaagaatggttttagaaaatcttcttctactttgccaaatttcatctttaaaatgcttgtttctgttcctctcatgataatggtaatgtttatgatggctgattttaaaacctcttagggtatgaagtgtgttgtagaaatgctaaatgctaatagatacataaacagtaagatggaagcgggagaaacacacacctccccctttcctcacaagcctcagcatttccggcttgagaaaatcggcctggcacccatgaagtacctgcggtctgagctgtgtggccactatttttttttttttttcgagacggagtcttgctcttgttgcccaggctggagtgcaatggtgtgatctcggctcaccacaacctccacctcctggattcaagcaattctcctgcctcagtctgccgagtagctgggattacaggcgtgagccaccacacttggcgaattttgtatttttagtagagatggggtttctccatgttggtcaggctggtctcgaactcccgacctcatgtgatccgctcaactcagcctcccaaagtgctgggattacaggcgtgagccaccgcacccagtcgtggtcactcttaaggtgggtgcagcttatggtggcgaatatggaaaggttactattggctttcgctgatttctttaaaaaaaaatgcaaagagaaaggtcactaagcaaaagacctaagctggtttggaattcactaatctaacactggctagagtttaaaaagtaggggctagtaaagcccacttgatatgcacaaaataagattagctgcagcgttttgctgtccacgttgtcttagagagctggaagatggggtgcagggggaggtgcagggcaggaagcatctgcggtgaggcctctggtcagtcactgcacagctggagaaggctcaggtggtgctcgtggcccacgaggggttctccccagaagagacaggaagggcccaccgtggtttcccacagcaatgtcctcatgcacgctgaggcacacatcttacgtggatgctgttagtattcagtacactgcgtctaaaatgcacgtgtgtgcaaatgcgtgtctctagtgcactcagagtgggaagtctgcacggctccttttaactctatgggatcatgaaggaaagtaaaaccttagaggctgaggggtttctgcctgcatctgaatttctttggaatgctcatgtcaaatctgatggaaaggtggtactagcagcagccactgcccaaataaacatgttcaaagctccttttcaccaaggcttctgctgtgaacctctcccttcttggggcacctgctgccccttcctcctgcctctcctggggcagcacaggcacctgcaaccaacttacggagttttgcagatgtgacaccctaagaaagcagccaacactgtgttcctcgtggaattactgagttcacatcccttttcctttttagagagacagatcctataggcagcatgaatggaaatgcaaagactccatcgatttttaccaacttttccaaggaaagtccaaatcatgtttgctcctccatggtggtacagttcagtgccagcctggtctggccctggagccttcttttggcatccagaacatctccctgacaacccagaaacacagctgacctcctgccatcctgagcctcacaagcttgctggacacctgcggtgagtcccagcaagggtgagtcccagcgccaggcaaagatctggcgagggaagagccgcccgggatgcagacacacttatcactcacttgccatttccacaacctcatttctttgcagctgtggacggcaatggcttccttaagggccatcccacccctatggagatagatgccagggcttgggagccacctggtgtggctgtgcacgctgagtgtccttgtcactcagaggaaggtaggcccagggtcccttaggccaagagacttgtttgggtctgactggggccaccctggctgtacccacatttccaaaagtaaacctgtaacgcatcatgtctcaaagacaggaaaccccatggacaccccagctccatcatgcggtcatgacattttggaccaggagggcctcctgtgtggtcctctggcgggaagcctgctagtctccctagggctgccctaacaagcctcacagcctgagcggctcaaacaacagaaatgtactccgtcacagttctgggggctgaagtctgaggtccgggcttcggtttctcctgagactgcgcaggctggcgggcggccgtctcctcctgtgtcctcacgtggcttcttctccagtgtctcttctttcaaggacaccagtcctgctggagccaggcccaccccacgacctcacataacctcaatcgcctcctgaaagacactttctccaaatacagtcgccttatgcggccccgggtgttggcgcttcccaggtgaacttggggaacacacgtcagcccatcccaggtggagctgcggcagtgcggggtgtggctggtgctgggggtgggcaggaagggtaagcaggggacgagggatcagaggcaggaggtgtcctggccctaacatttcctttgcttctcgtaaacctcacctgagcccacccaacaccaaggccacatcaaggagagaggacaaggggagagtgatcacagggtgtgacagtgatggaggggacccagacgcagggactacggagggcagtggggcctcacagggcacctcccacagggagcagagagcggacgatggccggtggtgatgagatgtggccctgctgtggaggaagcgccaggtgcatctgatgaaggcatgaagacacagaaggggacaggaaggggctagaaagaaaagtatcacagtcagcctggtccctatgctgtgtgcacgtgcatgtgtgtgtatgtatctgggtgtgtgcattgcatgtgtgtgagggtgtgtgtggctgtgctatgtgtgagggtgtgctgtgtgtggctgtgtgtgggtgggtgtgctgtatgtgtgtgggtatatacatgtgggggtgtgtgggtgtgtgtgtgctgcatgtgtgtggatgcatgcatgtgcacgtgtgtgtatgtatctggttgtgtgcattgcacgtgtgtgagggtgtgtgtggctgtgctgtgtgtgggggtgtgggtgtgtaggtgggtgtgctttgtgtatatgtggggtatgtacttgtgcacgtgtgagtgtgtgtgctgtgtgtgggggtgtgggtgtgtgtggaggtgtgctgtgtgtgggtgtgctgtgtgtgggtgtgggtgtgctgtgtgtgggggtgtgctgtgtgtgtgggtgtgtacatgtacacatgtgtgagtgtgtgtgggtgtgctgtgtgtggggtgtgcattgcacgtgtatgtgtgtgggcatgtgcatacacactgcctgatgggttctgaggaatgaacggatccatgaatcaatgattacacccaccaaaatttctactgattgcatgatgggaaaatatggaataattgcccattcttattttcattttcaggagaaagaaaacaggagtgagacaccaaaacgcagggctttgtttacagagaaggccgcgggggctccccgccaggtctgtgcatttcaactcagttctgtccttcctcataaacagatgaacctgtcccgcgcgcgtggtggcggcttacacggcggaaacaccctcaggtgctttctcactatcaaagagcagcttagcatttatttcatatttttgtcttccactgattcttatttattttacaaattgcacctgaacaataaaggaagtcattccaaaagcagcagcctgccccccaccagcaggcagcagtgacgtgtctccatggggccttaaaccttcagggccacgttgtgatttatcttcacacagcgcttggcgcatgcgggcctctaacgaatgtttagaatttcagtgactctagtatcaccgttttctttctatcttctcttccacgcacgtgtctgtctttctcatggtctagtcattgtaagtttgttttttaaaaagttttactaagtacatatgctactaaatgtggtgagtaaatgtttactgttcaattttatcacgttgatatactcagacttcttctgaaatgagacacaggctttctcctttcacctttgtttccaagatgctcttcctgcctctagctccccgcactccctgcacttccccgaggtcactgcactcacagagcttcctatgtgatcagttccaccaggcatagcaggaattcttctcatttgtccaaacgaacagagccccaggaggccccacctggtgcccgtgaccgaccccctcagtgaacctgcaaaggttcccatgcacaaggcgacgcttcagacatttcaccatctcactctccaggtcggacttgaaaacgctctgatcaatgatcaaatctgcttccacccaattcaaatgcaagcagttctgaggcacgattatacacaatacgtgctatttattaaccgtcaccactcagctaggttctttgccaagaatttcccaaaagaagtcttcattctacatagcaacttgttcttatccatgggaaagatagtgtcttattttaaatgcaaatgaagccgattcagcatgtacaagcagaacccgcaaatgagagaaatgttggtatatgtgatttgtaaataacagcatattaaaaatataatagataaaatgtttccaatgataaggccaggattcttaataattggataatcttaatcaaaaatcttagatgagtaaaattttcccacttaatataaaaaccacgacatcaagctgagtataaggacacatttaaattctggccaaaaagcaaagcttatcctgggagttccaaacctccttcctgcctgggcacagctctttctgggtatatagcacatgataaagagatcaatctttgagctttgttggaaacagcacacgaggtaacaccaaccaagcatttaaatttctgatttggatctatgagcattgctaatgacacactcactgcacacttgaaactcttggatttccacactcatcatcactgatctacgccacgccattcccagaattccccatgccatcctgccccaccatgggcaccagccaaacccactgagtaggcactgtctcccgcccatccttcaagaccaggctggcctttgcctgccccagaccctccaccctcacttccagccatgcccctgcaggaccccgtagagcacttcatcttgtccctgtccttgtggaggaggcaggggcctgtgtgaactgccctgcttactccggcatccccagcagccctcagcaagctcagcacaaggtaaagcctcaacacgggaggacggagttcattttcctccactaccacgagatcctggggggccaggatcctccaggtccgtcctttccttcctctgctcacccatccaccagctcagcacctacttcaggcctcagacgttgtaggtgctacagagacatctagagagtgaacccacagacacacaaataacctgtgtttaaaagtgtgttaacagcattgggtggttcccagtggggtacacactacatcatttctacacttgaaaaagtaagaattccaagatggatggatttactcaaaacctcagaaacaccactgaccagctacttctacaaacatcagttctgttttgtcctgcccactgtgcatttaggctaacaggcaatgaagaaatcttgaaactatgagaaactatggaaaaaaattcaagttttaaggaagatacagtagcaccccatttatatagcaccagtaaaagttattccaaataaatatattttcagggtaacttaaacttacccacataacaccagtatgagaagtttatatactttaaaaagtctattttttaaaaaagtattgtttatttctctgctgccttacacacagtaaaca

SEQ ID NO: 69 - DNA, 24488 bp, Homo sapiens
gtcaaagagaaacaaaagaaggatacctactttccaaacacatcatccatcaacatgcatgcagctgtttactggaatttgctttttcgttacttaagctaatgaggtcatttggaagatatttatgaaaataaaacataagaggatgaacctgccccatccatttggttaacaggaaaacatctcgcagatgtaacagccatggctgacttccagaactgtcaccatccgcctgcctcaaagtcactggcacgtgtgtggtttgctgctcctggacccgctctctcaggggcatcatcatgaggcctctgcagagccagaggaaagaaaatcatctgaagaagaggattccgtgaccactcttattttatctccacagtactgtttcttgcctaatttgtgccgaacatttacgatgacaaagacgatgatccgaaaacagcaggcagaacaaggttgcactatggcgaggagaactgggatgcggagagaaaggggcagccccgggcacacaaagcggccgcgtgcaccagctggtgtttccctctcagtgagtgtattttttttttttttttgaggcagtgtttccctcttgttgcccaggctggagtgcaatggcatgttctctgctcaccgcaacctctgcctcctgggttcaagtgattctcctgcctcagtctcccgagtagctgggattacaggcacgtgccaccatgcctggctaatttttttattttcagtagagatggggtttctccatgttggtcaggctagtctcaaactcccaacctcaggtgatcagcccgcctcagcctcccaaagtgctgggattacaagcgtgagccaccatgcccagccgtgcgaatgtaatttttaaaatccagcatctcaacatcaggaagaactttacagaccagtttcccttctcactcaatttggctgcatcacccactgctcccaatgggaggcgagtcccaggggctttttccacctcattccatgctcgcctttctacatcatctgttacatgctcaaggcttccccatcggcctctgcaatccctcttcccagttccttcctgtttccctactctccatcctcctctcctgattcctttccttggcttgttttcacccacgtgccactgaaataccagcgtctaccaaattttcactatcgacacctcccacgcttcatcctctgtctggtcgtctctccacagccatggctgtagtcaggaatgattcctaaatacgtttccacactttttccaagagttccaccttcatagtccagtctttctggacgttgtaacctctatcacacaaacatttcatacttgatactctaaggctgagccccttttcactgtccccctccccacctaccatgatatccacagacacgctggtgattgcacctcacagaagcctctctgggcttctccccacgccccggccgcctggccatctcttgcctcaaaggcctcctaaggagtctccatagcattaagtaatttaccttccaattcattctcctctctcctacaattaaaagtgaatcattccagccagcgcagtggctcacacacctgtaatcccagggctttggaaggctgaggtggaaggatcacttgagcccaggagttagagaccagcctgggcaacaaagtgagaccctgtttctaaaaaacacataatttaaattttaaaaaataaatgaaaatcctccaataacatgcagcctcttctgtatgaagccaaaacttccttacaaggcacaaaggtgctttccccttgttccttcccatgccctcaactccccagccccctcccagcctgccttgcacccagccctaggcagccacattcttggtgctttctgcctattgttcttggtgctgttcttggtgcttctgcctatagttcttggtgctgttcttggtgctcctgcctattgttcttcgtgctgttcttggtgctcctgcctattgttcctggtgctgttcttggtgctcctgcctattgttcttggtgctgttcttggtgctcctgcctattgttcctggtgctgttcttggtgcttctgccttttgttcctggtgctgttcttggtgcttctgccttttgttcctggtactgttcttggtgctcctgcctattgctcttggtgcttttcttggtgctcttgcctattgttcttggtgccgttcttggtgcttctgcctattgttcttggtgctgttcttggtgcttctgcctattgttcctggtgctgttcttggtgtttctgctattcctgtaacctgcaaggcttttctccacactacaccatggaaagtcctctctagtaaaccgtagcccagcagaaccactcgtgagtcctgtgattccttccaaaccactagacctggggcaccttgggccccagcatggtgcctcactgattttggactgggcacaacacgattcatccaaacaccacttgacaaaggccagcaggacagaacagtacaacgctggttccacagtgtggtcctcactgaagacagggcgggtggcattgacccccattcctgtcccacagttgagggctgccccacaggcttcctcctcacttcgggggtgcaagcctgcaagaccaaacagcccacagccttggaggaggcagagtgcgggcagcgccccctcacagaaccgcagcaacgacacctatcaccgcccaccacaggcgcactgtgggctgatggggtgggccacatatggggaattccagaacgtgaccctgtacctaaatccctgcagttcccaagtctccctcagtccttcccagacatctcttaaggggcctgactctgcctcagccccaccgccccccagcctgagccccgttccacctcctcactggcctcgctgcccctctgcaatctcctccaacagccgccaggatcatctttacaaaatgcaaaggtcatattgctcctgagctgcaatgccctcaggcagtcccctgcctttagggtggagtccaagccagcctcatggacagcgtctccagactcttccccaccatagccaggcaggcctccaggcgcttccagactcatccccaccatagccaggcaggcctccagatgcctccagactcatccccaccacagccaggcaggcctccccaggcacctccatccccttcgtcacacatcccacacaccccggtttgttcccaccaggccttcactaacatgccactgcagaaaaaccttccctcccccccagtctgactagagtccactcatttttcaggtaccaagttgcaccttgcttcctccaagagggctccctaattcctgaccgggcggggcacccctgcaacattctcccagctccctggactctccctggcccagctctcgccaactgcattgtgattacttaagaacttgctcctcccttaaaagaaaatagactccaggagggcaagagtgggtttatctcagttactgccatggtgtctataaaatagttagagcccaatagttcttactgaatcaatctatcaattaattaatagagacgatacggatttcatggggtgggaggatatgaacattaatagagacgatatggatttcacagggtgggagaaggatatgaacattaatagagacgatacggatttcacggggtgggagaaggatatgaacattaatagagatgatacggatttcacggggtgggagaaggatatgaacacacagggacatcagcgcttgtcctttctggacttagcaaaggccatactcagtagctcaggtgccaagtaagccagaagtgaagaaaatgcacagccaagccgggccagaacgtccacagaggctaaaggatacggctcaagctccacctttaaaagagggtaggactgagatcaacagaggatataaacagattaccaggacggcatgaccatagaggaaggacccacttgaggaggccacagcaggacaagagggaaggacgaaccttccccaaggctaagggtcaaacattcgagctgattaaaaatgttacttgaggccaggcgcggtggttcatgcctgtaatcccagcactttgggaggctgaaacaggtgaattgcttgagctcaggagttcaagaccagcctgggcaacatggcgaaaccccgtctctataaaaagtacaaaaattagctgggcatgttgctgggtgcctgtaatcccaggtactcgggaggctgaggcaggagaatcacttgaatctgggaggtggaggttgcagtgagctgagattacgccactgcactccagcctgggtgacaaagcaaaacaactctgtctctaaacaaacaaacaaaaaaacaatacttgggctccaggatgcccatcatcctgcagcagtttgcactgagctccctttatgccaacaggctcaggatccccaaagcactgcagcagagaacagccgtgcagcatctcaggccacacagtacacaggcgtcgtcactgtttccaagaacttccttggctgaaaagtcatttcaaactttggggctattttggcatctaagtgggaagagggagaaaacattaaaagaagtcccttagtgctgacactgtcctgccagccagcacatctcctcattttatgaagtcggactcatcccagctatctgtgtgagacactcagttggccatgacagttaaattactttttcataccgagaacagaattagtctataaataagtaaagaggtgctagggctgagtcagaagtgccgattccacctcaagctccttccctgcccgatctgcaggtggctctcagggcatgggggaccaagctgtgtttgagcctttgctttgcatgggtggctctgaaggtgatggaatgggctggcattctccagcactctctggcattttctgacattctccagcactctcctgcactctccatgttgatctgggtgactctggaccttcattctaaagatactcaagaatctagtggccatacaacatccccaagggagaaaggggccctttttctccaatgctgctgatgctgtttcccatcatataaggactttctcccatcccaagcagccaagggaaagaagtgactcacctcagaaagaagaaaaagggaagaagggttacccaatgcctcccccatggcatggaaattctccattttccccacaacgccagcacggtcacactctgcaagcaacacccatctgttctccttacattttccaactttactatcattagcctgaaaccaagctttcctgttcagtgcaatgactactctgccaaacacacaagttctgaacaggacatgtgccatgggaaacatttcgatttaatgagcttttccagtgcaacacagaatgattttttaaatcccagggatgtcccccactcaaacttgtcatttcttttaacaaaacaacggcaatgccaagaaaggaaagcattttctggccacagagtgggcccttcagctccccttccaagagggagccctgacacggaggcagaaggacttccatcccctaagaaaaacagagtttgggatcttgaacaaggtgcattggcagcctgggtctcacaccgtcccttctagagcaggaaggtgtggaaaggagagtaaaattccactattgtgaaattcccccttcagcaatgaaacggactctgagaacttatttttcctgaaaattattatttatgtccatctagatggtgtttctatgtttactgccactacaatttaaaacagttcatgcccttcggtagacagtttctagacgagtctttcctggatgtttgaagcaggttctccaccttcagctcagctcgaggcccctggagaaacactccccagagcaggatctccagagaaggctcccttccgtcaggagcaacagtggctccaaccccgacttccaagctctgggcggccttccactgttttgtgggtggtgataattccatttaaagtagcacttacatggttttttagaaaagactataactcctggatttttttcaaccatattaccaatagaaacaaacatacgaagaacgatcgggtggctgcttatcagaaaatcctaatccctgcctcagccatgcccagccaggtcacagtgagcacgtcctggtttccatgtctgagcaccagatcggtaaccccagcctcttcactctcatgagggtgcagcaaagattcagcaggaggatacacatggatacgctgggcaaaccacaggcaccctgcaggccatgagggcctggccgagatctcagccagccaaggaacaggagatttcagccacgtccctcttatctctcccacagcaggattccaagtgctgcagccaggaccttattccatgacttccctctgtgcgaggcgctcagtcctgcagacgcagtgacttcctgccccagctggaatgctgtctgcgtagtcatactataattttatttgtattatttttattgttgtattgttattttatatttttttccccagtactttcaatcctctgttggtcgactcaggcagaacctgagggtatgcagggctggctgtattcttgcccaaagggacctgagaaaacatctagaccaacgcacaggactgtgtgattcacccgaaaccacacagttagttgctgagttagagacagtactaggtgtctggcttcccaacagggtgaattatttctggaaattgttttttctccctgcatctaaatttaacaatgaggaaatctattagtaatcagcaagatgctgaagcagtaactccaaaatcagttgacgaatgatttctcaggagcagcacgctgggtgctggctcaggaggaaggtccgcatcggaatggtggactgtccaggtactggctcaggggggaggtccacgtcacaatggtggactgtccaggtagtggctcaggagggaggtccacgtcacaatggtggactgtccaggtgctggctcgggagggaggtccacgtcacaatggtggactgtccaggtagtggctcaggagggaggtccacgtcacaatggtggactgtccgggtagtggctcgggagggaggtccacgtcacaatggtggactgtccaggtgctggctcgggagggaggtccacgtcacaatggtggactgtccgggtagtggctcgggagggaggtccacgtcacaatggtggactgtccaggtactggctcaggagggaggtccacgtcacaatggtggactgtccgggtactggctcgggagggaggtccacgtcacaatggtggactgtccgggtgctggctcgggagggaggtccacgtcacaatggtggactgtccgggtagtggctcaggggggaggtccacgtcacaatggtggactgtccaggtgctggctcaggagggaggtccacgtcacaatggtggactgtccaggtgctggctcaggagggaggtccacgtcacaatggtggactgtccgggtactggctcgggagggaggtccacgtcacaatggtggactgtccaggtagtggctcaggagggaggtccacgtcacaatggtggactgtccaggtgctggctcgggagggaggtccacgtcacaatggtggactgtccgggtagtggctcgggagggaggtccacgtcacaatggtggactgtccaggtgctggctcgggagggaggtccacgtcacaatggtggactgtccaggtgctggctcagggggaaggtccacatcggaatggtagactgtttaggagaaaggtccacgtcagaatggtggactgttttaagaggaaggtccacgtcagaatggactgtccaggatggtgcatgtgcagggtgtgttctggcaccactgtgtgtgtacagcgaatcgctctctgtaacctggcccctggtgaccagatgcacttacaacatgcaccttgctgcggctagatgcagtctgtggacacagattaaggtgaagtgagggcatcagcatggtctggagtccgtgaggcactcggaccaccggagccagcccaggggttggcacagtctgcagggctcagcgtctcccctggttctcacgtggacattggctttccttgtcttgagagcagctcaccatcacgagttcttccaacagcccaagtcttcatttccacacacttgcttctgtgtgtggcagatgtggagctggagagaacagacctgccgtgagaagggagagggcagcaaagatcacccagaacttgctgggactgagatgaacaaaagttacccaaaaatgggaatttcaagaatagccaagggcttcaacagaggatgagctgacacttagatttagggattgtcagcatcaccgtggctgctgacatcttgaaaactggaaaatggggtctcagaagaacaagataagagcgcaggaggccagggtgtgactcttggggtccaggaggggacatcacaggaagcacaagttggaggggccagacgggttgcagccaggttggggtctggggagccccagtgtgaccaggggcgggggtggtgggtgagcctcagcagccagagtggtgcagacacgtcccacggtgagggctggtgcggacaagagattagccaaaggagcagccaccatgctgccgacagcgagtctgccctgaagtggagtctgccctggagtggagtcgtctgccctggagcggagtcatctgccctggagcggagtctgccctgaagcggagtctgccctggagcggagtcgtctgccctggagtggagtcctctgccctggagtggagtcgtctgccctggagtggagtcgtctgccctggagcagagtctgccctggaatggagtcctctgccctggagtggagtcgtctgccctggagtggagtcatctgccctggagcagagtctgccctggagtggagtcatctgccctggagcggagtctgccctggagtggagtcgtctgccctggagcggagtcgtctgccctggagtggagtcgtctgccctggagtggagtctgccctggagtggagtcgtctgccctggagtggagtcgtctaccctggagtggagtctgccctggagtggagtcgtctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcgtctgccctggagtggagtctgccctggagtggagtcgtctgccctggagtggagtcatctaccctggagtggagtcgtctaccctggagtggagtctgccctggagtggagtcatctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcatctgccctggagtggagtctgccctggagtggagtcgtctgccctggagcggagtctgccctggagtggagtcgtctaccctggagcggagtctgccctggagcggagtctgccctggagcggagtctgccctggagtggagtcgtctgccctggagtggagtctgccctggagtggagtctgccctggagtggagggaagtgaagccagatcgctgaggagtgcgaggaaagctgttggttgttatggtcaagccccagaactcgtagatggatgtccccagcccagtgcctcagaaggtgactgcgtttggaaatcaggtttttgcaggaaaaattggcgttaaccctcagcatggagtggggattggtcccaggacccccacttacgccaaaatcttcacacactgaagtcctgcagctgccccacggaatctgcatacacaaaaagtcagcttctgtacacttggctttcacagccctcaaatactgcatttttgatccatatttggttggaaagatccatgaataaatgagttcagacccatgttgtcccagggcccactgtagttccgatgaggccactgggggctcctccagcacagccaacaccacctgtgccagcatcactgcccttcgaagtgtggccccagcagcggtctcctgcaccctccgaaaagacagcccttggaagactgtggctcaggatgcaaggctctgactgaaccctcaagctggccctccatgcgaagaaatgctgcgtcccaggccctgcacagtgctggacttcccagctccaggctctggagccggctgcagagcacagcgtgaggcaggccctgaccgctctggaaggaaaagcacctctggcaagtagtccagaggtgaaagtttctctattttggaaactgggcatctgccaaggagaacacacggccccctaatgtgcaacaaaaccgtgagacccgagcagaagctgcagcagaaggtagcacgggcaggatgctaggccccaggggccatgggctacgcacgggccaggtttccagcctgccagccccatccagacttaaggacggaaagtgggaccaaggctgagccgctccgcacccctcgctctacagctggacacaggctctgcagaaatcctgagctggggccaccccagcctccctggcccagaacaggcgctcactgtatctcctcccttcctcctgagaggtcctacgggatggagtattaatagtgccgtgtttaattattattcagcataatcacacatattacggggatttttaaagatcctttcatgcacaatgagtatttatctaatgtgccctcctcattcccaagcagccctcgggggcagatgcccccatctcccaggacatctctgctggtctctctccacggcacctgctccacagccacctctctctgctgtgctcacacagtgtggaagctcccgcttcagcaagaggaaagccccgatgatacagggtgaagacgcctcccctcacagacctcagacctgtcccagagccctgacaggaagacccaagctctcctgaagccttagggtctcaacatcccaagccgacaatgcccccccattgactcggctctctgcagacctgcagacctgcagcccagcccctactctcccctctggctggcattgtgcagtccttccttcctcagcagcgctgtgtgggaagggggactatctgcccagtccctgaggagatgatgacttcctacagcttctgaaagggcccgctctggggggagccacatcaggcagacacacggctcctggtgttggcagggtgccggcggaatccagggcaggattcacttgtgtggcgaaggggtcacccctcgtgcaggctcaggccctccctgcccacctgtggcggcgaagggaactgacaccactccttcccggtgagctcggcagggctgcatctctcccgtgggacgctgcagagataaccaggtagagccacgctcacgagaaccaccagccactctgagctaggacggggcacaggcaaccacgttcccacaaacacagggtctggaggtctctccgctggtcacggcctcggaattccgacatgctggactgtggcttgggaaactgactcggttgttctccattcctgatcccatttcctgtttgtgggtgtgatggctgagttgtgcaccccaaagttcatacactgaagtcctgacccccaggacctcagaatgggactgtatttggagatgggtcttgaaagaggtgatttcagtaaaacgaggtcgccggatgggcccggatccaggctgactgggtccttatggaggaggaggtgaggacacagacacgcacagatggacaaccctgtggggcacagggaggagacggcatctgccagccaaggggagaggcctctgggggaacctgccctgccgtgctctcatcttggactttcggcctccaggactcagaaatgtctgttgtttgctaagccgcctggtttgtgggggtttgttagggagactgagccaattcatacagtggattccgccactttctttctaacacaatgaagatagagttggtgacctcctcaaaccttcataaaggcataacttgtaacaacacaagttatggtttgtgacaaatatcaccagaagccccaagcagagtcgagacgtgcgcagaaactgcacaagccaacctggctcaggcctgggagagcatccctccgaggagcatccctccgaggatcccccacagccttcccgtcctcggagcaaatgcagctgtgtccttcccgcaccgtgggcctggccctcacctccccccaccccacacccagcttctccaccagctccccaggcctcctccccacaaggcgcgtcctgggcctccctgaccccggccatgccccccgccaccggagccacttcactgccttccctggccacagctccctgaagacagggccagcctgcgtctccgtgtccagtccttggacgtgctaaatcctcagcgagtgtctgccaagacacatgtgatgagcaggtgaaggaacatgtctgacctcctgcttcagtgccatggaggcctcaccagccccaggccatgggctggcctctccatttcctccttctgagaataccgtggagttgggattgtgtttgcctgtttacagggactacggtcagtgtccctcccaggccgctggtccttcctaacacctggcggcccactgctcagccatgtgggggttgtgcacagggcagggctccgaggtgtgggctccactctgtgggggggtctcacagcagccacacagagctggccattccctcaccgtgacctctgcagagagtagaattgtctgtgtacatggggctggggccaggctgtcctccgccagctctcaccccaggctcccctggtcttcctgccccgtatcccagattcatcagcaccagccacatctcacctgccccacaagctgcgcctcggtgctgctgtctcaaccaccttcctgtgtagcagggaccacctacctgtgttgcttgtgctatgtctgttggtttaaagcccatctctgatcccgcccgacacacagcagggactcagcaggacactcagtctaaacgacagggtagggggcaggcagggacagccgaggagctgctcctgggtgttcctgtgttgtgtgagcacatggaggaagttggtgtgtactaagcagtgaagctgctagcaactggctgtgtaacagctgccaagtaacacatcatgtttccacagagctccagaggcatcagcctaaacaagaggctcccgagaaggtgcactcatacagtgtggtgggggtacccgtgcttgggtgcaggacaggcgggggcacccgcctgggcagcctccagatgctgctgaggtttgccatggggtatgaacgccaggtgacgtcccaaaacaggccactcaatcactccccagagccggtcagccgtctcttgccctgtgaaatgcacatttacaaagcgtcacctggtgtatcaggaacaggttcacttgctgtctcagacctgtgaatgcctacatttcagctgatttagaaccacgcatgctgggccaggctcggtggctcacacctgtaatcccagcactttgggaggctgagggggacggatcaagaggtcaggagattgagaccatcctggctaacacggtgaaaccccgtctctactaaaaatacaaaaaaaaaaaaaattagccaggtgtggtggcgggtgcctgtacttccagctactcgggaggctgaggcaggagagtggcatgaacatgggaggcggagcttccagtaagccgagatcacaccactgcactgcactccagcctgggcaacagagcaaaactccgtctcaaaaacggaaaaaaaaaaaaaaagaactgtgcacgatggacactggcctcggtgagtccacaacaggaagcaaacaaggattaaagtgcccggaattggaagacacaacatttcctacacagcctgagtctaaggtgatgaggggtggaaacaccagctcctcagggggccagccctgtgagggaaacgtgtgctcacgaaagtcagcctggccttcgagcccaccaaggggctttgggatcacacagccaggggcaaatctcagctctgcagcctgagaaaagtcacccaaatgcctcaatccccttctcagacaggcagacagacaataataacaatgatgcctgggacacaggacattagaatgcccgcagcactcacacagcacctggtgggcactaagcacccgtcgctgttggtcctggggctaacgctgatgggaggagcagctgcgtgcatatttacttctgaatattttcacattttaaaatcatctccattttgctttggaatgcgtggcatctctgctgtgcaggtgctgacacgccccagagcaagcattggctgtgtcggcagaggaaggtgggaaggcccaggggaggccagcaggaggacggactcaccaggacacccccaaggacagggaaggtgctgctgaccacggccagcaacgacgagccatggtgacagctcacacacagctgcaaactcacatcgctgcctctggaaccacagagtgctctgtattagatattttgtgcatttttgaccaaaatgagtcaaatgtggggagagtggcaactgtgtgagtctgggctccaatcagcagcgaagatgcagtgtgggaatgacagcagcttccctctgcggacacagcacacactcaccacacctgggctgtgtccaccagccccaggggctgtggggaggggcggtcaccagaaggggccaggcgggagcaggaccagctcacagtctccccaggcctccccagccagcatgagttctcagcatctcctctacacacatggacaaacaccacacacacgtgtacatcacacatgccacacaccacacatatgcacaccacacacgtgccacacacagcacacatatgcacgctaccacacacatgcacacatgtatctcacataccacacacaagcatgcacgccacacatgccatacacaccacacgcatgccacatgcacacccctaacttaaggcctagctccaagtttctgtcacaaccaagagggaaaacagagagaatgcaaaagaagtgagatccattcctaggacaggctgaccccaaaaataagtagaattacgtcagatatttagaacatggaattagtgatttggttccctggctagtccatcaaagcctgtcgatccaaaatacaatttaaatgccacatgcttgcaataaaaagcaatggaaagcaaggtctttacagtaataattaagtgaagcaatgaaattgaatccaaaattattttttgtttctcttcaatactgatgctggtacatgaggaaaacagaacaagcataattggactgaatgagggaaggtggcaatttgcggaggctctgcaggagctcctgggaatgctggggacctggacatcccacgccggcctccccgtgtgccacagactcagctctgctccctggagcaggtttcatgcactgggacagggagctctggtaccccacgacttaaacacatagagcaaggcggggggggttccatgtgggcaaggtgaagagaaagcccacgatggaaccagctacagcacacgtgtgagagcgtgtgcctgtgagcacccatgtgtgcatatatgtgtgcccatgtgaggtgtatgtgtgcaggtttacactaacatatgaaacagagtgagtgctggggttgcaaagacccagaccacaaagagctggtggcaaaggaaaagaaacatgcacactcccaagatctgtttcacagcagaacccactccttcctgctcctgaggggcgaggcaagaggtgtcgggccatgtgggtcccatgcaggttccaggaaggacgttcactcagcagagcaggggaatggcaggctggggggagctagtgatcaagtgccctcaaaacatacacgtgtgtgtgtgtaagcatgtgtacggatgtatctgtatgcggatgtgtgtggccacatgtatgtatatgagcatgtgcatgggggtgtgtgtgtgaacatgtgcatgggcgtgggtgagcatgtgcacacaaacaaaaacaaaccacaacagactgtgttcaaagcgagaggatccctaagctgcgatgagggaactgaatttaatgtcctaggttacagcccggccaacagctgccccaaaccatgcctgacacagcaaatttacagacacatcaccctacagcgctcaggtaacggcttcccagccacgccccattacccacgtcccatgctgccatccaagaaacgctccagggaagggaagccaaggctgtcagttcacatctccctctccagagtcgagctcaagcccgcggctgccaccctccatgaactgatggggaagggggccacaggaaggccccaaccccatccagatccaggcctgcgagcccaggggtggcacagaaacagcaggtgttccctgagagaacgacccagggctgtggcaaagccccctccaggctcagctcatcccacctgtggggaaggcaccatgaggcctcctcacgaggcagacgggtgtttgctgtggtggacagatgcccacatctcacgcgcagcctcctggaaggcagcagatgcaaacaccccagctgagaggaggaggctgaagcaagtgcaggaaagaacaaaaccaatgcaccactggaccatcacctttagagaaaaaggttaagaaatctgtatcacataaaacaacctccaaacaccaggctcgacgccctcacccaccacctgccctctgctcatagaaagaacgtggtgaacaggagcatattttacacaaacacatgcctcctcccagccacgctggctccaacctactaggcacctggaagctgaacgcatcactgcactcacacgtgcctaaacacttaggtgcgccgagaagcccaggcatttggggtttccactgacaaggacacggaaggcaaaaaacccaaagcaacgtgggtccttccctctgaagggtcagataaaccggcttattttattcttagaataggtttttgccacagtgaaaactgaataaacaacaaagtcagaaaggggcgtgtccatccacagactttaatcctgcattaacagaggctccctaaagaagggggtgccggagggaggtgcagaccgcttcagggttggcccagcacctgggtggtgcccatgcccccagtgtaaaaagatcctcagctcgtcgggcacgaccttgctttgttatctgctcttggcctctgtccattctcaagccacgtcacgtctctatgaccaggctcttagatgcccaaaagcgacattgggagaggaaactgtcagcccccagcgtggctcctgtggcttctgagaagccccagatgtcaaacaggcatcagagcattccagtcacgtgccccacagagtcatcacggagacagcagagacagccatgagatttgctcagactttcagcaaacccccaccgatgcctccacactggaagttggagcgtggtggaccgtgcgttataataaagttgctattgtatgtgactttgatcctacaaagaggaaaaaacatgggtaaaaagtaagaaaagaccaaaaacgtcactaaacttcaaaaacccgggacatgatgtgattagaggaacagcatggaacatggcaaaaaatacataacaaaacaacaaaaaccagcaacaggcgcttcctccagacacaccacggcacacttcaacctgttccttacaagactacattgagcgtgctggtgttaaatgcgtgcaggcttccgtgcaggagccctctgcacatggcagagagaatgtggcccgtgctgcactctgacgcgcagaccatcttgatggctcagggacggccaggctccaccacacctgctccctcctgactggcctctctctaccaagccagggacaaggcctcatccccagaaccaccaaaggattaacttaaagcaaaacaaacacaagcaaacagaacagaaatgacttgggttcctgtcactttgtgctcccaagccattccaagagaccagcaattaataactcgcaaagaattagctcacctccaacaaccacgggagcttgaaaaccacttccttccctagttttgttacttgcagaatgaactgattctcaaatccctggagatactgggctgagtgcatttgtcctaattacagcaacatcatcttcctcagtgcaccctcgctcacagggcagcgcccaagatctgcactcaccaaagtgagcctctcacagatggaatctgtgcaaactttaagtcccaacaaaactttgccaaactcacttgttgagcaagaagctcagaaatggagatttctaggaccctccgcatctggctgcaaatcccagacacaaaccatccaaggagatcgcacctttgccttccactgagtggcccaacgtggagtgctaggaagccatcaggagccagacagacctatgtccactcccggaggcaccgccaggaccctgtcctgcgtgatgggtctccctgcaacacacgaggagtccctatcccaggggccagaggggacgtcccgcagagaccgtcctgaccccagccctctgcattgcaccaggtggacaccacagaagctctagcctgaggcaccgagccgtcaatcttccatcaatcgatgaagctctcacctataacggacatcctttcgccaccacacagcatttaccaagctttccagggtgccctgatggacatgctcacaatgcctcggggatttcctctgaagatgtggatgcagaatgaacaccatgaaaacacagctcccactccgggtacatcccaaagtcgcacgtcaggccctccgtgccgccgtcacagctgctctctccccagccaccactgcctttgctggggatgccttgcctgaagatgcaggggctaccctccctgggcctccactggccagtgcaggttgtgaccacccaccccccgggctccatcagggatggctgtgggtgcaggttgtggccacccatgccccgggctccatcagggatggctgtgggtgcaggttgtgaccacccacgccctgggctccgtcagggatggctgtgggtgcaggttgtgaccacccacaccccgggctccgtcagggatggctgtgggtgcaggttgtgaccacccaccccccgggctccatcagggatggctgtgggtgcaggttgtgaccacccacgccccgggctccgtcagggatggctgtgggtgcaggttgtgaccacccacgccccgggctccgtcagggatggctgtgggtgcaggttgtggccacccacgccctgggctccgtcagggatggctgtgggtgcaggttgtgaccacccatgccctgggctctgtcagggatggctgtgggtgcaggttgtgaccacccatgccacaggcttcatcagggacagctgtgtgctgctcttcatttcccaaacgcagtgggatcaggcctggctggatgtctgaactgcgactctgccccaactgctgccctcattgccgtaccccaagagcctccatccatcttgcaatggagctgccactcagcttgtccaccacagtccctcctgaagacacatctctgcgaagctccccccatcacccaggccaaagctagcctaccacgtcacacagtggccatctgcccgggcatgtttcacctcggctgtgcagaccctctgaagacgagacattctccatatgtttcttggctccaggcagctcatcgacagataacatcctgctagatcagcagagacgacgcctgcacgttgggcagcctgcacagccagggagggcggggtgggaaacgcagcgggagacagtgaggtgggggtctggaagtcctgcctcgagcctcgtcagcaggcaggcgtttcagtgttccccagaactacacctcagtatgccctcgcagaaaggagcacttcacacaacatctttagagaccagccacctccaaagcctctgttcctcctgcattgcctcccaaatgatctcccagcctgggaatgtcagattctcagattccatggggtattcttttctgtggctgttactcatgtaatctaaggaagtgttgaagttctgagttaccctgtagcaaaggcatatcttgttccttccacaatctggtcgaagaaaacagcagctttgatctcagatactcttaactactcagtaccaagggaagttgtgggctttgagccaaccacacctaatgtcaatgctcactccctccccattcagctgcgtgaattcgggtaagtttcttacatgagctgagccttgtttttcctttctgtaaattggggatttaaaatgcccacctcactgggtcatggtaagaacctgcaatgggagggtacctgcatttaatctgtgctgttttcgttctcctgatacagaactgtgtcagaatcctgctttctgcggctggactatttgtcaactgcctgttagagcacctggggagcggctggggctttctctggggtcagaccatggcactgaggacttcttgtagcattcaggtggctattgaaatcatacaaaaacaattaataggcaaccattagaaattaggcaataaagttttttcagttagttggtcaactgtgtacacaacacaaagcagaatacagagtgtgtatatgtcctcaaccatgattgtttttacataaagtgtttaaaaaaaaagactggaaggaaacacagtaaatcttaatatagcggctatacttgattatatttgggattttttctttcattttctataaaatgtctaagttttccatccagtttatttttaaaatctgcaaaagtacttcaaaaatgagtaatctaaaagtctggttccatactagataagatgaagaaaaataaaatttcagttcacatccaaaaggttgggaccttactaaccagaaccccacacataaccacacaaaacactcaaaacaaccacacaaagcaaccacaactccagcccataccttccatttagttttgttgtggatgttggcgatgcaatgccccaaatctcattaagcccatcaattaaaattcaaaaatataaaacatgaaaactaaaataaagaaggtctgaaatgccctttaaattttgctgaaaatcatcacctcctcctctgggtccagacagggctagacagaggcttgcctaatgaaagtgattgtcttagatttgaaactttgcctggtttcataaacttgatgatgttttcaagaaaataaacaataagaagttaagtaagtgctgccctgccttgtctattgtgcaccaggcacacatgaagacacaagggccttcccagcccactataacccagatgggactcaggaagaccccacaagggcctttccagcccgccattgacaagatgagactcaggaagacacaagggccttcccagcccaccatcaacaagacgggactcaggaagacacaaggaccctcccagcccaccatcaccgagacgggactcaggaaaacacaagggccttcccaggcagccatcaccaggatgtgactcaggaagacacaagggccttcccagcccaccattgacaaaacaagactcaggaagacacaagggccttcccagcccaccattgacgagatgagactcaggaagacacaagggccttcccagtccaccatcgacaagacgagactcaggaagacacaatgaccttcccagcctgccatcactgagacaagactcaggaagacacaagggccttcccagcccaccatcaataagacgggactcaggaaaacaactgagcaaacatctgtcagtaggacacgggtggagacagactgtgccccggactgaatgtgtgagtcctcccaaaactcctacgtgatggtgttaggagggccctctgggacatgactgggccatcagggtggagcctcaggatgggattagtgcccttataggaagagactcaggagcccaccctctgctcgcccctgtgaggtcccagtgagaagacaggcctctgcaaaccagaagcaggcgctcccagacaccaagtctgctggcaccttgaccccacacttccagcctccagaaatgtgaaaaataaacatccattgtttaagcccgaggctgcagcatatttgttatagcatcctgagcggactatgatgaatagcatagccaaattaggataactggagagggatggcttacaagggcaagggtcaggcataaggaaccacaggaagaggctctctagttcagcagtaatgtcgtcgttagcacccaaggcccaaacgaggaagcagagtcatgcatgagagtcaactgtcaggaaacagtgagctgcagcccaaggacaggccagcgggggctgtcgccagggaggaagtgcagtccacatgccgtctctatccaagctccagctccctctgccattctcctgcctcagaacagggaaaaggtgctctgaagctgcgctcccttccactcagccagagaagaccagcagaccaggggccagaggcaggtgagtcaggacagaggtcaaaggacccacagacctgtgggacacagagcaggacgtggagggtgggcaccccgcagagcacccggcctcatctgccagcccagcaacgagcctggactgtgctgcaaactcgattccttgcatataaatgtgaacattaggctaaatgacccttacattaccagtttatctcaccagcgctttcagcctatttcttatttaggtctctgataaatgacttcatctttatttatgaatgttcctttccctgtaatatttgctagcttcaccttgacctcataaatgtaatttgttgtttcaaattctagtagcagaactgcattttaaaatgctgaaaagccatcactttagagctggtgagagaaaacattactttttttcattactcatttcttctagatttggaagcaaaatctggctttccaagcacggaaggagtagaccaccacagggacagagggtccccctgtggagctctcttccggacgctggcggaaaagagcacagctcgtgcacctttagaatcagtgcccctttttaggggccccctgtaagtggctttgtttctggaaaatgtggggacacttttcatactcgacgtagcccacagccaggtctgtgcaccgcatctcggaaagtgtttcgagacctgctcgtccggtgactggcgcacgctgcgctccctcacaaacactaaccccagtggttctcctcccagcactgcccctcacccctgcgcggcgtgtccctctgggaatccactcgcaggcgacctccagcgtgtgtctacttgctgcttctgtccctgttaccaccaaggctatggctgcaagtttccaaggaaaaagcgcagcctccgtgggtcgtgatttctgtggcttctataatgcgtgtgtgcctctcccagccgtcacacatggcgtctcaagtgccccagcccacccatgggacctgcagagacgcatcccagcgccctaggcactgagaataggtgggcgctcacctgacagtggcctcccatcctccactgccttgagccctttcccatgcactgcactacggacaccccagccactacctcatcccaaaagcaggcggcaccacggggcgggaagaggaactcaggtccgtgaacacctgcctcgtgcagggccctgactccagtgattctcgcagcctcgtaaccccaacaacaggccccggagctcagctttttattcccacttcacagatgagggaacgaagacacgacccacccaaactcacaggtgggcagggggtggtctgactcccagcccagtcccaggacctgctggaagtgaggcagcacgaaccccccagggctcagctctccaaatccaaaatggaggggtttcccttcacccctcagcgctctggagggaacgacaactgcagattccaaggtgtttcagggaaaagccatgccccccgtgtcagccagcacagcctgcaacgaccac

SEQ ID NO: 70 - DNA, 22258 bp, Homo sapiens
acaaacatcacataacataaaaaaacacaaaaataaacacataaaaacacacaaaatacaaagaaacatacattgaaaacatatggctcttttcaatcttctttttctttcttgtgtttcatatatatcaagaaatttatcttttccttgtgcattttgttcttcagttgaatttacagttttatgatcttaaagacacataagtgttctttttttttgagtcggagtctcgctctgtcacccaggctggagtgcagtggcacgatctcggctcactgcaagctcagcctcccaggttcacgccattctgctgcctcggcctcccgagtagctgggactacaggcacccaccaccacgcccggctaattttttgtatttttagtagagacggggtttcaccgtgttaaccaggatggtcttgatctcctgaccctgtgatccacccacctcggcctcccaaagtgctgggattacaggcgtgagccaccatgcccggccacacgtaagtgttttgattagtaaatccaggtagaagttgtatgtgtgaactgtaaataatgttgacaactcttaagaattgtctgttttaattaaaccaagaaacttaaactagctttctatttactaaagattatctcagatcacgtgaccttgaaaaacatttagatgggctccagtttttctaagaaaatgctccatttatggaagcaattcttttctttcttttaaccaaatctttgcataggtaccaaataacacatttgtttaggatgagagctgcccactgcccccgccaaaaaaaagtacttttatatacaaaagtccaaatttccaaaggtatatgtactttaattgtgacttgaactcaaggtaaataaattaaataattaataaattaaccttagcttactggacggccaccatcttatatgctgttcccttgactgaaatgttgtggggtaaatgactatatatgaaatgggacttattggaggaattaatgcatctgataatggaggttgagaagttccacaacaggccatctgcacagcagagaccctgaaatgctggaagcaggacttaatccagcccaaaaacctaagacccagggaagccgatggtgtaattcttagttcaaggccaaaatccttagatccttcgggaggccactggtgtatgccctggagtccaagggctagaaatcctagactctgatgtccacaggcagaagagtgtcccagctccaggagatcagatggatttgcttttccttttttttttgttttcttctatcttgctccccagtctgtcggacggtgcccccccaaattaagggtaggtcttttccactcagtccacccgatcgcatgccaatcccctctggaaacaccctcgaagacatgcccagaaataatgtcccagaaataatgccttaccagtgttctaggtgttccttaatccattcaaattaacacctccaattgaccaccatgataaggaaacacacggaggccagctcaggggagaaccagattttcctttggcatgtgagcctcagtcgggcaataattctttcaagtttattttattttatcttgagacagagtcttgctctgtgtcccaggctggagtgcagtggtgcaatctcagctcactgcctcgtgggttcaagtgattctcctgcctcagcctcccgagtagccgagaatatatgcacacaccatcacatccagttaatttttgtatttttttgtaaagacggcatttcacgatgttggtcaggctggtcttgaacttctgacctcaagtgatccacccgcctcagcctcccaaagtgctgggattacaggcatgagccactacacctggctaagaatttactttgtatacatgttaaaaaaaaaaaaaacctaatatgtattaactcctaacacctaagaggaaacctctggtaaaaagagtctttcactccaaggacacggcagagcctgtgccatcttctaagtagatgaactttccagagtccaccaagaggtcctgaatcttctctcttgcatgtctctcttccatcctctccaaggcatccagcagggtgtggatcgaggcgttccgtccagttttgttgacccatttcatcagcattgcatacaaggcatcccctgggcctgctgtaccagctctgaccacatcgatctcatttttcgtgaggtccagctgcctcatgagctggtcccaggagtcaaagggcacgatgtttgcaaacttgtcaaagaacagcatcagagctgggtggagaaagccacagagacagccagatgagttgggactcagttcagaaggggcagaggatcccacatcaggcccagaacccaaggagagaacctggagagccccctgcatgggcaaacctgttgctccattgcccacccacctcccatccacagagagcccacccacactgcctggcctctgtggcccccaaggcgctgacgggcgtcaaggtcaccagagaatctgccctcagagagggctgagaacccacctggggaggatggattgaccctacggaggcagaaagcaaagtgggtgagagcccgagggagggagggagagtggctgcagcgggagctcagaggatgcgggctgcctgggctgcgcttgtcatgggagcatgtcccagggtggccacttctgcatctgtggaaagtgcagggtctggggcaggggacctctgccctccctgaggctggggcagagctaggtgggggcaagcaggccctgaccaagaagcaaacctgaagacagagcaaacctgcccagatctcaggactaccagggattgaatgaaatgagatgtgtgtgcaaagcactgcacaccaccatccacagggatagaaggggccaggagtaccaagctatgttttctaacagcctcatttaaagaacataaaaagaaaaaagtgacattcattttaatgtgtggtactgaatatgtgtaaaatataatttaatatgcaatgagtatacaaaaactgaaactgacccaattgtcccatagaaaggtttttttgataaacagaaattgacccttctggtccttaacgactggaaacttaacatttgttttatctgagttacttcctcaggaaagacctgcaagcatctcaaaaaaagtagcaaagaactgaaactcaccagatcactacatccagaccatgatgggatgtgggacccctcattcatcttgattgtttccttgccccattctagctcctactttcttacacattgttacatttcttgcctcctatataaacccttagttttagttggtcagggagatacagttgagactgagctcccatctcttccactgcagcaccctattaaagccttcttggcaatactcatcatctcagtgactggctttctgtgcagcgagcagcgggacctagaccaaacccctgaggttttggtaacaggttttggttccctggctgggaaagtgttgctcatggctctgctgccatgggccaggagactcagaagccctcccaagcagttgccccgctaactttggctggaggtgagtttcagtctctctcaggtcccactgcagccggccccaaccacattcctgattacttccgaagaactgcctttgaaatttgacatttgcatccagacaggtgattgtcctttgtgggcccagacagcaggatctgctcttctcagtttgagaaatttttaaaggaatttccatttgcaggttgaacaggcccaagtgactgtgagagggaagcactctgcctttcagtctggacactcttggaggcttgtttgtaattgtgtgttgtttcagggcaagtgagtgtcttttgtgggtaccaggcagcacgactggctcctctcaatttgagaaatttgaaagcaatttttgttggcaggttgatcaaacctaaccaatggagagaggaagcaccctgcctgtttcagtctggacactcttggagcttgtttgttgctgcagcagttgtattatgttttggtgattatttctatgtgtttgctagagtcatgggaaattggaattcagtaaacttggtattcttttgtaatactgtttggctccaatattgcttggaaactgaagtttgctgctgaatgagaaagtaggatggagttcctgtatccaggcttttatgttgctgttctaagcagcattgggcctgattagttggttctaggtggtgttctctgcgatgctgtttggagtctgcagaggtttggcctttaaaaatcaaactgccatggaaactgctttacctaaaatttgggttcacaaccttcactgaattatctattggagctaacaaatttcagccatgtgaacatatttgtagactggtgagtttgtattactgtctcatggagagagttcaaaggtaaaagctattggatctttgtgtgtgcatataggtctagatgtgtttatgtgtatgtacatttattattaagttacatgttgtgtctaccaaattgacttataagtaaaagagtactcataaataaagtaaataattccaagcaattttcaagttcatgtgacttaagtaaatccttactaaacaagtcagctttaaaattattggtaaaataagaaaacagaagtgtcttcagaattgtcagcatacatttttgtctgggcttatatttgtctttgctagatattttgagatatcagtttggcacaaaaacttaagactacaagcccaaccaaaacaaaatgatctttgagtcaagcttttgataagtaagattaaattaatgttgttggtttaatgaaaacagctgagtcttctgacttattggtgaaaatatctatatatttaactttgaagctcttaggtgagcacctgatgttcactggctattaaaaaaatggctgacaaagaaattaactaactttaaatgatggtgtctaatatctcaattttcagaagcaatctggataaacttaaaaatgaaagaattgagtaaatgtaaatgggatgttttaagtaaatttttcatataattaaaaattgttgtcattggattacagagaaaacttccagtgcagtaactgaaagaccaatgtgtggccaggcgcattggctcatgtctgtaatcccagcactttgggaggccaaggcaggcgaatgtctatcacttgaggccaggagtttgagaccagactggccaacgtggcaaaaccctgtctctactaaaaatacaaaaagtacccagatgtggtggtgcacacctgtggtcccagctactcaggaggctgaggcgtgagaattgctagaacccaggaggtggaggttgcagtgagatgagattgcaccactgcactccagcgtgggtgacagagtgagactctgtctcaaaacaaaaaaagaagaaagactgatgtgttcataaagattgtgattgttaaccaaacatgaagctgggcaggagctgattgagtggactgaactaatagaggactgaaataattcgtatggcttttgttggtttgaaatattgctgattcttttggttttgttttccagtctggagaacttttttcttctttgctatttatagcctttaagtatactttaagtatattgagtatacttttgtaaacagaatttgaggcatatttctctctctgcctaatttctctagaatttttaaattatttgtgactattaattcatggcaatgtgtttgcttacatatggttaataacaacgttttcttttacaatggaacacagttggataaaatggttattttctcagggctttgattgcaatggcctcgtgagaggttccagcaaagccaacttaggagagcctatgtggacagtgatttttgctgcactttgtgtgggtaatcaggccacgtatatggaactaaacttattttgcaggtacattggtcctgctataatttgtctttggtggaagtggggccgagagagagagattgtgtttcagaagaaacacaatcttttagtattaaattaacctttgattcctgggtggccatgaggtcacccatggtatgtgaagcttcccatgatgcccctcctcaaccatgaagcagccagaaagatccaggaccagactctctgtgactgtgggattgataaatagaaagggagaactgaaatcaacccaatatgtccatcaaaaggtttttttgttgttgttgttgttttgataaacatagaaattgacccttctgttcttaaagctcaaatcttacatttgttttatctgagttcctttttcaggaaatgaccttcaggcctctcaaagtatcaaagaactgaaacttacaaatcactacatccaatgggatgctggacccctcattcatcttgattgcttccttacccctccctagttcctgttttcttacacattgttacttttttgtttttttgagacagagtcttgctctgtcacccaggctggagtgcagtagcgctatcttggctcactgcaagctctgcctcccgggttcatgccattctcctgcctcagcctcccgaatagctgggactacaggcgcccgccaatacgcctggctaatttttttttgtatttttagtacagaaggggtttcaccatgttagccaggatggtctcgatctcctgaccttgtgattcgcccgcctcggcctcccaaagtactgggattacaggcataagccaccgtgcccggcccacattgttacattttatccctactatataaacccctagttttagtccatcaggggacatgaattggagactgagctcccatctccttgcctacagcactcaatgaaagtattcttccttgtcaatactaattgtctcagtgattggccctctgtgcagtgagcaccaagacctagacccaacacctggtgtttcggtaacaaaataatgagtggaatattttccattctttcttgcattaagtctttggaatcagtatgtagtttatacaacagctctgcaaattgggcttaggcacagataaagagctattagcccactgaagtcagtggtgccatgcaggacagggcagcccctcagggctgttgttctcctgaacaacaaaggagaagagaggaggtggagaagaggatagacagagtggctagtgtcattaatagggtgcagaaaggatgaggtagagtgggaagaagagatgggagaagacaatttagggtcttgatggtctatagcataggacccccagtttctggcatggaatgctctggaagagcactctcagcaatggggacaccagttaggacaccgtccctattcccaccatttctgctgcatctccaggagcaaaacacttactctcagtggggtcagcaccatttgctggaaccagcagcctcctcctctgagacccttcagcttctgccggtccctgtaacacacagtggggaatgccttggtctgagtcaggggtcctgcagtctagtactgactctgaccatcagccagcccggaaacctgcagcacatcactttcccccttgggtcaccatggagatggtgaaaaacctctggtcccacatagctcacagccactccccattgctggcattaccacctcagctccacccggtcagatcagtggcaacattagattcttataggagtgcaaaccctattgtgaactgtgcacgtcagggatctgggttgcatactccttatgagaatcttatgcctgattatctgtcaccgtctcccatcaccctcagataggaccatctcgttgcaggaaaacaagctcagggctcccactgactctacattatgataagttgtataattatttcattatatattataatgtgataagaatagaaataaagtacacaataaacgtaatgtgcttgaatcatccccaaaccatcttcacctcccagtccatagaaaaattgtcttccacaaaactggtccctggtgccaaaaggttggggaccattcgttaataatataatgtcttttgtatacacatacactgatgcatagatttggacaaagaatcacaagaaatgatatctcatagttacttgaggaaaaagacccagggcactgcagagtggaggatgctctctttacttactgagtaccttttgatagtttaaattttctcattttaaatatataaactatttgttcatgtcaaagcaccttatcaagctggagattattgacctttttaatgtttgccttcttttttttttaattacatttttggttagaataaatgggtactaatgcaagaaaggaactgaatggaacagtctaggtggaaggagatcattgtctagatgagcatttaacctgtgattaaggagggacccaaagcagagggaaatgggagaatcggcagctcaaaggggttggaaaaaccagacagtgactagaacaattcagggagtgcctcgctttgcactgaaacacaaaacaagttccatttagattataaagttatatgcaaaaatcacatcattgaaaaaaatatctccataagaagttagaggagttcgtcttgtgttggcaaaaggtctttctacagtagtgagcaatgaaaaggtaaaagtatctacagatttcactggttaaaaattaaagcttctacacctgaaaatattagaacaaaaaggggcaagaagaaattaggaatctactgtctgaatgtgagaaaaagcatgagtaggagagcaggccttctcataaagactctgagagacaagacactgatcttacgcaaaaacagtgaaaacaaagaaatgttcgtttaaaacaatgttttcctaaatagcaaaaaaaagaaaaaaaaagaaaagaaaaagcccttcaatgtcaaatcaaaatacatgaactggtacaaaccaacactagggggctgtgtgcatgtgtgtacctgtatgtgtgggtacgtgcatgtgtgtgtgcatgtgtgtacatgcatgtgtgtgcatgtgcgtgtatgtgcgtgtacacagtaagcagcactgttacaggctgacttggaaattgtgcttcttcttggaatcctccatacaaccatatgcagaaatttgggcagagatttagatccaaatatgtttaatgcaataataatttcagagtaaatttaaaatccctgctgttatgagcaagggctccctaacttctgtaggagcacacagtggagaccgtgcagccttattcagtcatcaacaaaccctgtgacccccactctattcctctggagctccagtttctgaggacatggcaaggacaggacagggactaagaagcagacatttggaagagtgcctgtccccttgtgagggtggctgctttttcccacgcagccccgtcccctgcagtcccatctccctcaggctccacttcccctttgaccaggagagccgaggcatggccttcaccccctgcctacaaggtcttggaggggcctgtccccaactcaccagcagacactgtgcctcccctggggactgtacagtgacacctgtcaaatctgccggctcctggctttccatttgctgctcagagacgaaagtggacagcgagtctgcgttgctcagaatctcgttgtgagcattgtcctcagccccaggccctcgtaggagacccaagcgccagaaacacaccttaggaaggcaaagagccaactcagaagcccacacccagggctccccacggggtccgtagggcacggctggacctgctgccaccaccccctcccagtgaggtcactccaggaagtccatgctcagcacatccaggacctgctgctggggccaggccctggtgctgggcttgggggctcaccccatccccagggtacaggctgtggggtaagggtctcacctgggctgtaggaagcacagggctacagaatggcccaccagcctgtatgatgctcaaaagggcctgtgtcccccatagtcaatgcacagcatccaggccacttcagagactcagggcagccatgagagcacggggacccacccacctggactacactgtgggcaagaagcagttcctgagcccctgatgcccccagctcctggagaaatcaactcaccctgtccatgcacttggggtcccctccacaacctagaagagaagacggttcccttagtggccagggaggggcccatgcagcactccttcttagagggcagtgttgggcaggggtgggctgggggctgggacactggacaaagatccccgggcctggggatccacatgaggccctgctaactcgggagatccttcaggagcggggagcataaagggaagtaggctaaaaacaaacaagtggaacatcactgttttctgctctgtgttttgctctgaacaaagctacataaatcccacaaccacttctcgtctcgactcttgtcatccagttgaggagctgactgccccctgcctggatgggcctgaccagtggaggaactggccctgccttcccagacttggctgggagatgaggggacccccagccttgggagagggacggatgacaccagggccctagggttgcacaggatgggaggatggggggtgatcacaaggaggaagatagagcccggccagagacactaggacttggggcaggggtgagcgtttctgtctgtgggaacagaagaaggcagggcagagagtgcccagagcccttgccctcagccagcacctacctgagccgatgcaacaacagacaatcagcacagccaccaacagcaacggaacaaccaaagtcacaaccaaaatcacccatatattatgtccattgcctgagaaaagacaggaaaagacaggagtctcgggctgctggtccctgtctcctctgcagctggggcttccccagtgggctttgtacctgattctttgtggacacactcgatgtcactccagggcgtacaatccttgaccttgaccatccctctggggcacctgggtacacacagggagggaggggggggactcttgatggaaagctggccaggtgggatgaaagaggagccactctccctgcccaatgtccctgagaaggcgtcaggggaaggatagtctcctcgtatctgcagggggtccccctatgctcccttgtttaggctggggaagggtctgagcatgcacactttacccccttggcctccctgctctggggtcagagctgcagttccaggagccttctgtgctgggcacacactaatcttccctgggctgcaggggaggcctgcgttaggaggaatcacactccaggggaagatcacaagcccgtgtggccacaagctgagccccttcctccagttaacccacagtacaagtgagccctcgcccccacctgtctgctggttcctctcaatcacagcaaacactggaggaccagagaagagcaattactctttgcttccaaaaccaaaataggaaaaagacaggacttattgagaaatcaggggccaggggtgaggctggctgggtgggctcaggtcctcatgggaacttgaaggagctccacccatggccttattatgatttttgcgggctgtgggcatttctgtcttcttgaattaaaagcaaatattaaaaattacattttatgactcaatttgtttaaatataaatataaccccagctggattctataccattattttcttatgatttcaagataaaatatttcatgtacctctgttgtgggccctaagtcatggcctcctgtgcctagtgaacaagtcagcctggccaaggggactagtgctggggaggggtgagaaggggccactgcaggggacaggggtggggacaggcagatggaccaggaggggcaggttgcaggctcaggagacgccacaggctcagggacacctatgggggtggaggcaccatggggtcagggctgatagatacgggtacaaggagactcgggtctttttagggttccttgcttctgtgggttctttgaggctgctgggagccccttggctgttgtctcaccctctgctgcacttccggcacatctcagcagaattgtcattccggaaagttcctggtttgcactgacatgctgtgttcctggtcgtggtgcagggacttctctcttcttcatctgatgacagagtacaaggttttgggaatgtgtttccctgacgtgtcccttgacctttcctcaccaccccaactccctccccctcagctcagctcaactcagtttgccaaggagttctgagggccagattctgcaccagcacactcgggctcacacaggacacccacccttcagctgtcaccaacacttggagtcatacaaaaggaccatgattcattatttattacatcagattagggaaaaagcaccatttagatcgcatggtcagtagcaaaggaggcacatggtatgtgagagagtctgcaagaagaggagcccttgggtgacttcccaaaaacccagcctgctgaggaagagggaggcgcctgagaaactgaaggctgagtgagcctgagaacctgccaggagcacacagcccagggggagcgtggccccagagcagacccgtaccaccgctgaaactcagccctgtccactcagccaggccttctttgtgctgtaatgatgcccctaccctcttggagctgatagtttgcactaccaggtggcatgcattataaaaatgatttctttctgtttcattttatggacctaagacataaccatggaacagggtatgatgaagaccaagttgggctggaacttggttccctgactcacattggctaccactcccacctcactgcccctcactccacctctggacaagaggtccacacattctgtacctgatttacaagctgtacatgggaggcaagcaaacaaattgttggaagcattggtgtaacccacaccctctgtgcaccggttacaggctccaggatgttctgatctatgagatcctgggaagggagagaaaagccaatgaatgaattgccacagagttcccagaggatcgtggcggtggctaggaaactcttcttttggccatcagtagaccccagacagagaaatcccatcttcttggcttggtcttgtcgtcaattctgcatctatacacacctctgactggcgctgctgacagaaatacaatacaaaccacatgcaaaattcaaattctatgagagccatattaaaatagtaaaaagagaatgaggtcaaattaattttaacaatgtactttttggacctaaaatatccaaaacattagcatttcaacatgtaaacaagataaaacattgagatattttcttttattttgaatactaagtgttcgaaacccagagtgtatttttcactcactgcacatctcaattcaaagtggctgtgttttaagtgattaatggccacataggcctagagaccagggcaatgccacctgcatccctggaaactcacaaaaagtcctaatccctgccctcagtgagctcttggtcagtagaaggtacaaacaggcgcagaaacaatacagcgatgaggggaaggcttcagatacagcccatgccacctgccatgggaggaaaatggaaggaaaaagggtcctccctatacagagtcaaagaatgatccacagaaagaaggcctacctcatgctgccctggattgcagagggtctccaggcactgaggtgacagcctgcaggagctgtcgccagcgggagcccatgtctggaggctcgaccttcacctccagggcttcgccccttcaggtgacctcactctcccctttcagtgcccatttatttatccctctcctctgattcatatttactgatattgaaagatactcttagaaaacccaaactgtggaaaaaaaacttccttgataatgtgttacgatgacgacactaccaattataaaaatgtggttattgagtaatagtgctggggcaactaaggttactactgaaaaataataaaggcttttttttttttttgagatggagtctcgctctctcaccaggctggagttcagtggcgtgatcttggctcactgtaacctccgcctcctgggttcaagcgattctcctgcctcagcctcccgagtagctgggactacaggagcgtgccaccacgcctggctaattttttgtatttttagtagagacggggtttcactaggtttcaccaggatggtctcgatctcctgacctcatgatccacctgcctcggcctcccaaagtgctgggattacaggagtgagccaccgtgccactgtgaaggaaaaacttccttgctgatgtgttatgatgatgacactatcgatgataaaaatatgattattcagtaatggcgctggggcaactaaggttactgctgaaaaataataaagcttcttgcttatgctctccctataaggaaatagagactaggtctatcaaggtgtcaactgtaaagtatgaaatcacacaagtactgcatgagaaatttttcttacaagtttggagagagaaaggaccttctcagtctcacgagaaactaaaaagttgcataaagttaactatatgaaaattaggaagaaaactgcatggaagaaatcttgactaagatgaaaacaaagtaggagaaaatacttgcaatgaaaaccacactgcaaagcatagtttccttaacctataggaattcataccaaaaaaatctagaaagaacatcaacaagaaagtagtagacttgaacaacactattaacaactagactggacagatgtctataaaacactctactcaatcaaaacaagatacacattcttttaaagtgcacatagaacattctccaaaataaaccatatgcttggccataagataaacctcaatacacttaaaaggatagagataatacaaaatacactctcctaccacaatggaataaaattagaaatcaatagcaggaagaaactggggaacatcacagctatataaaaattaaatagcacactcctaaataaccaactggtctaaaaagaaatcaaaagagaaatcagaaaataagacgaatgaaaatgaagacacaacataccaaaacctatgggatacagctaacgtagctgaagtttacagagaaattgtctattaaggaagaagaaatatccttcctaaatgtctattaaggaagaagaaatatctcaatctataacctaataatccactctaagacactcgaaaaagaagagcaaactatagataaagcaagcagaaggaagaaaataatacagattagagcagaaattaatgagacggagaacagaaaaacaacagagtaaattaatgaactcaaaatctagttctttaaatagatcgatatattggcacaactaattgtgttaaaaaattagcacagggaaaaaataagactcaaattatagtcacgcactgcatgatgacgtttcggtcaacaatgaaccacatatgtgacggtggtcccataatattataatggaggaggaaaattcctatcgcttagtaatgtcataagtcaatgcgttactcaggtgtttgtggtaatgctgatgtaaacaaacctacttcactgccagttaaaagtatagcacatataatgaagttctatatataatatttgataatgataataaatgacttactgatttatgtatttttgatactatacattgtaatgttattttagagtgtactcctacttacaaataaaaaaggtaactataaaacagcctcatgcagttttccagaagaaggcattgttatcagaggacataggagttgacagctccatgtgtgtctgcccctgaagatcctccaacgcgacaagatgtggaggtgaaagacagtgatgttgatgaacctgtccttgtgtagacctaggttaatgtctgtgtttctttttttttttttttttgagaaggagtcacactccgtcacccaggctggagtgcagtggcgcaatctcagctcactacaacctctgcctctcaggttcaagcgattatcctgcctcagcctcagcctcccgagtagctgggactacaggtgcctgccaccatgcccagctaattttttgtatttttagtagagacagggtttcactgtgttagccaggatggtctcgatctcctgacctcgtgatccgcctgccttggcctcccaaagtgctgggattacaggtgtgagccactgcgcccggccaatgtctgtgtttctatcttagtttttaacaaaaaaatttttaagtaaaaaaaagtttaagttaaaaatacaaaaatgtttatagaatacgaatataaagaaagaacattttttgtacagctgtacagtttttgttttttaagctaagtgttaaaacgagtgaaaaagttttaaaaattaaaaagtttataaagtaaaatagttacacgaagttaatattgaaggaaggaaaaaaaaatttacagatttggtgtagcctaaatgtacagtgtttataaagtccatagtagtgtacaggaatgtcccaggccttcacattcactcaccactcactgactcacccagacaagatccagtcctgcaagctccattcatggtaagtgccctagacaactacatcatcttttttaaccttttataccatatttttattgggccttttctatgttcacatgtttaggaactcaaatacttatcattgtgttacaattgtctactagtacaggtttgtaatctaagagcaataggctatatcacatagcctagggatgcagtaggctatatcatctaggtttgtggaggtacactctatgatgtttgcacaatgatgcacttgtcagaatgagttcccatcattaactgaggcatgactgtattagaatcagaaatgagagagagcacattactacagattatatagaaataaaaaaattataaaagaatactatgaaacctgtacaacaaaaaattaggtaccttggatgaaaggggcaaattcctagaaagacacaaactactgaaactgaatcaagatgaaagagacaatgtgaatagacatatagcaagtaaagattttgacttagttatcaaaactactcctaaagaaaagtcgttttcacaagatggcactgaaagcaaagaaggaagctcctgcccctcctaaagctgaagcgatgcaaaggttttgaaggccaagaaggcagtgtagaaaggtgtccactgccatgaaaaaaagaatatccatacatcacccaccttccggtggcccaagatactgagactctggagagcacccccaggagaaacaagcttgaccactatgctatcatcaagcttccactgaccactgagtatgccatgaagaagatagaagacgacaacaacacacttgtgttcattgtagatgttaaaaccaacaagcaccagatcaaacaggttgtgaagaagctctatgatgtttatgtggccaaggttcaacaccctgattaggcctgatggagagaagaaggcatatgttcgactggctcctgattaccatgtcttggatgttgccaacaaaattgggatcatctaaactgaatccagctggctaattctaaatacatgtatatgttttcaccagaaaaacaaagttgaggcccagatgcctttaccactgaatgataccaaccatttcaagaagaattaataccaattattcagaaaccctttttaaagacagcagaggaaggagcactttccaattcattgtataaggacaatattactgatatgatttggctgtgtccccacacaaatctcatcttgaattcccgtaagttgtgggagggatccaatgggaggtaattgaatcatgtggggcaggtctttcccttgcagttctcatgataatgagtaagtctcataagatctgatggttattataagggggagttttcctgcacaagctctctttgcttgctgccatccatgtaagacatgacttgctcctccttgccttccatcattattgtaagacttccccagccacgtagaactgtaagttcaattaaacctctttctttgtaaattgcccagtcttgggaatgtcttcatcagcagcacgaaaaaaaaaaaaaaaaactaatacagtaaattggtaccagtagagtggggagctgctgaaaagatacctgaaaatatggaagcaactttggaactgcataacaggcagaggttggaacagtttggagggctcagacgaagataggaaaatgtgggaaagtgtggaacttcctagagacttgttgaatggctttgaccaaaagcctaatagtgatatggacaataaagtccaggctgagatgatctcagatggagatgaggaacttattgggaactggagcaaaggtgactcttgttatattttagcaaagaaagcaaagagagtggtggcattttgtcccttccctagagatctgtggagctttgaactgggaagaggtgatttagggtatgtggcagaagaaatttctaggcagcaatgcattcaaggggtgacttgagtgctgtaaaaggcattcagtttttttgtttatttgtttgtttctttgtttttaaccaatgttgcattcctaggataaaacttacttggtcctggtatataattctttttttgttttgttttgttttttgtttttgagacagagtcttgctctgttgcccaggctggagtgcagtggcatgatctcggctcactgcaagtccgcctcctgggttcacaccattctcctgcctcagcctcctgagtagctgggactacaggcacccaccaccatgcctggctaatttttttgtatttttagtagagacggggtttcaccgtgttcgccaggatggtctcaatctcctgacctcatgatccacctgccttggcctcccaaagtgctgggattacacgcatgagccaccgcgcctggccggcattcagttttataagggaaccagagcattaaagtttggaaaatctgcaacctgacaatgtgctagaaaagaaaacccattttctgaggagaaattaaagatggctgcataaatttgcataagtaatgaggagctgagtgttaatccccaagacaatggggaaaatgtctccagggcatgttagaggtcatcatggcagcccctcccatcacaggcccgaaggcctaggagaaaatagtttcctggtaggagtccagggtcttgtgctgtgtggagtctagggacttggtgccctacattccagccactccagctgtgactaaaaggggccaaggtacagcttgggctgttgcttcagaggtggaagccccaagccttggcagctcccacatggtgttaagcctgcaggtgcacagaagtcaagaattgaggtttgggaacctccacgtagatttcagaagatgtatgaaaacgcctggatgcccaggcaaaagtttgctgtaggggcagggccctcatggagaacctctgctagggcagtgtggaagggaaatgtggcatcagagcccccacacggagtccctactggggcactgcctagtggagctgtgaaaagagggccattgtccttcagaccccagaatggtagaactgctgataacttatacaccgtgcacctagaaaagctgcagacactcaacaccggcacgtgaaaccagccaggaggggcgctataccttgcaatgccacaggggcggagctgcccaagactatgggaacccgcctcttgcatcagtgtgacctggatgtaagacaaggagtcaaacgagatcattttggagctttaagatctgactgccctgctggatttcaaacatgcatggggcctgtagccctttgttttcgacaatgtcacccatttggaatggatgtatttatccaatgcctgtacccccattatatctaggaagtaactaacttgcttttgattttataggctcataggcagaagggacttgctttgtctcacatgagactttggacggtgaacttccgagctaatgctgaaatgagttaagactttgggggactgttgggaaggcatgattggttttgaaatgtgaggacatgagatgtgggaggggccaggggtgatagggtttggatacattctcactcaaatttcatgttgaattcccacatgttgtgggagggacctggtgggagatatctgaatcacaggggcaggtctttcccatgctgttctcattatagtgagtaagtctcatgatatctgatggttattataaggtggagttttcctgtacaagctctttgcttgctgccatccaagtaagatgtgacttgctcttccttgtcttctgccatgattgtgaggcttctgcagccacatggaactgttaagtccaattaaacctctttcttttgtaaattgccagctttgggtatgtctttatcagcaccatataaacggactaatacaattagcttaatatgaagaccagaaaaggacctcataaagaaagaaaactacagactaacgattcttatgaatattgttgcaaaaatttgcaacaaaatactagcaagttgaatccacaagcatacaaaaagaattataggctgggcacggtggctcacgactgtaatcccagcactttggaaggctgaggcaggcagatcacaaggtcaggagatctagaccatcctggttaacacggtgaaaccccgtctctactaaaaaatacaaaaaattagctgggcgtggtggcaggcgcctgtagtccctgctacttggaaggctgaggcaggagaatggtgtgaacccgggaggcagagcttgcagtgagccgagatcgcgccactgcactccagcctgggcaacagagtgagactccatctcaaaaacaaaaaacaaaacaaaacaaaaaagaattatataccaggaccaaataagttttatcctaggaatgaaaggttggttcaacatcccaaaataaattgatgtaacaaattatatcaatagaatgaaaaccaaaagtcacatgattatctcaaaaacacagagaaagcattttactaactccaacaccctttcatgataaaaatcacaaaataatctaggaataaaagtgaacttcctcaacctgataaagaatatctacaaaaacccacagctaacattatatttaatggtgaacaactgaaagatgttctccaaaaaagatatctgttttcactacttttattcaatatggtactggaggctctagccaggacaattaggtaagaaaaagaaataaaaagcatccagattggaaaagaaaaggtaaaactttctctatttgcaaattatattttcttatatagaggaaatcctaaggaagccattataaaaacattaagaataacaaacaagttctgcaaggttatagaatacaagatcaatgtacaaaaatcaattatatttgtatacactcacaatgaatcctaaaatgaaattaagaaaaggttttatccacaatagcataaaaaagtattaaatatctaggaataagtttaacaaaatcaacccaaaatttatagtctgcaaactacgaaacattattttaaaaattagagatgatttaaataaatcaaaaaaactcatgctttgggatcaaaagacttctcattgttaagatgccaggaacctctaaactgagcaacaggtgcaacacaatccctgtgagaaactcagctgattttagaaattggcaagctgatcctaaaattaatatggaatttcaaaaagcccagcataaacaaaataattctggaaaaggaaaacaaaaaagaaagattcatacttcctgatgtcaaaactcactacaagactgtgtggcactggaaagaggacagatatagatcaatggaaaagaattgagagtccaaaaatacacccatacctttatggtcaattggtttttgacaaggatgccaaggccatttaatgggaaaaatcatcatttcaacgaatggcaactggatagccacatgcaaaagaatgcagttggacgcttatctgatgccatttacaaaaattaactgaaaatgcatcaagagttaaagtacaaaactcttaggagaaaacatggggataaagcttcataaccttggatttggcaaaggatcaataagtatctgttgaatagaagaaccagaaac

SEQ ID NO: 71 - DNA, 5107 bp, Homo sapiens
tgccatctcaaaacatgtgtattttaatgagacaacaaagatcaagggaactttagtccttacaatgtaatgatcaaaaaagtgaaatagataatcaacataacattgcttgtagaccatgcaaacaatcttattgcatttgtatatttgtaatgaactgttttataataacaaaatgtaaaatgtgtattttatttgtccttttattgttttcctacttcttagacatgttaagaactatggaaaaagatatgggagtttgtgaaaatttaaataattcatatttatattacaagaaacagatattagaatatgtttgttttatatttcttttgtagcagaattttctagccaggcattgtggcttacacctgtaattccagcactttgggaggctgaggtgggacaatcacttaagcccaagagtttgaaatcagtgagggcaacatagtgagactctatctctacaaaaaattctctatctatatctatataaaggaattttgtgaggaaaactatatattttgtatataaatgaattttatcaggaaatatatctgtaaatgaattttataaaatatagcatcactttatccttgatttatttcatttaataattattttaaagtaatatactaataaactcattttaaaaactgctatgaccataaaactattagagataacataagagaaaatctaggtgaccttgggtttggagataactttttatatataacaccaaaggcgcaatcaatgaaaaaaaatgacaagctctatatcacatatcaatattaaaatgtgatctgtgaaaggcatcgtcaagagaacaaaaagacaagccacagactgggagaaaatatttgcaaaagacatatgtgataaaagacaattatcaaaatatacaaataattcttaaaactcaaaaataagaaaatgaacaactcagttaaataatgggcaaaagatctcaacagaaaccccatcaaagaagaaacacagtggcaagcatatgaaaatatgatctacatcatatgccattaggaaattgcaaattaaaacaatgagataccactacatttctacattggtgaaaattccaagtactgacagcactctcagtgctggtgaggatatggtgcagtagaaatccacactcatgccgggcacagtggctcatgcctgtaatcccagcactttgggaggctgaggcgggtggatcaccaggtcaggagtttgagatcagcctgaccaacatggtgaaaccccggctctactaaaaatacaaaaattagcccggtgtggtggcgggcgcctgctactcgggagtctgaggcaggagaatcgcttgaacccaggaggtggaggttgcagtgagccgagatggcgccactgcactctagcctgggcgacagagcaagactccatctcaaaaaaaaaaaaaaaaaaaagaggccaggagtggtggctcacacctgtaatcccagcactttgggagactgaggtaggcggatcacttgaggtcaggagttggagaccagccttgccaacatgacaaaaccctgtctctactaaaaccacaaaaattagccaggagtattggcacatgcctgtagtcccagttactcgggaggctgagacaggagaatttcttgaacccgggaggcggaggctgcagtgagccgatatcgcaccactgtactccagcctgaacgacagggcgagactctgtctcaaaaaaaaaaaaaaaaaaaaaaaaaaggaaagaaagaaagaaagaaaaaagaaaattccgtgattgcagtctttacgtatttatttgttattaagtacagtaaaataaagaaggatagatgtcatggaaaatgtcacgaaaataaaagagttaaaaaaaaaaaaaagtaggctgcaatgccagatgcctgaaaagttaatcaacgaaaggacttaaatgtccccattgaatttaggaacaaagaagtaattaatgaactgggcaaaaacactcaatgtaccagcgttatcgatttagaaactgaaactaagtatatctgatgttgcttttaggaaacaagtaaatgaggtcctaaaaagttaaactgtgaccatattttctttcctttttctaatttctccttgggccatttccaaaaagccctaataccccgactgatagaaatggataccttgctgtgcactggtactactgtgattcatggaaagctgatcatgcaacccaagacgccaaaattcccagccttactgttacgaaagaaagtttctaagcacaattgtctctagccaacttcctcttagtaagaaagaggccaggcagggcttcatgcagggtacagccctgagtttcttactgcgtggtaagtttctggggctgggagtaaagcagcgtgaccgaaagcagtacaaagttctaccggacacgcagatcccggtcctacaaatatgaggtccataatgagactgagatatcattcatccaacaaatatttattgaataccaaacattgggcttacggctaaaggaaaatacaaagttgtgttggatatgggttctgttttcaaggagcttataatctaataggaaagatgaggttactacattagtagcaatcagaccagatagaactggaagtgtgatgtaaatgaggtacagattgattgtagaattttgcagaaagaaaacaattctgaagaaatgttcatggaagtattagcagttgagatgtatcttaaaagataagtggggttcctgttggaaacattcaaaactctctcttctagctattttaaaatacgcaatatattattaactatggtcaccttactgtgctatagaacactagaacttattcctactatctaactataattttgtacccactaaccaacctctccctgtccctcctccccctattcatcccaccctctggtaaccactgttctactctctgcttcccaaaacaaagaaatgatcactgtttcggtgatggagatgtcaattaccctgatttgatcattacacattgcatacatgtatagaaatatcacatgcaactcttaagtatataccattcttatgtaccaaatacaaataaaattgaaaaaaaaaaaaaactttggctgggcgcggtaggtcatgccagcactttgggaggctgaggcaggcggatcacctgaggtcaggagttccagaccagcctggccaacatggtgaaacccaatctcttctaaaaaatacaaaaattagcttggtgtggtggcaggggcccgtaatcccagctactcaggaggctgaggcaggagaaatgcttgaacctggaaggcagaggctacagtgagccgagatcatgccactgcacttcagcctgggtgacaaagcaagactccatctcaaaaaaaaaaaaaaaaaagcctcctgagtaactgggactacaggcatgcgacaatactcccggctctctttttaaaaatgagaagtagaagtagtggtgactgtcaagaaagtattttggaaaaatactatgaataaccagaccaaagaaaccaaataccagttgtttcaggagcagtaaatcatttttgagggcttgagcaaaggtcttgctagaaaggtgcttaggggtcagattttggacataatgccaggccaagaaaatttgcactttatttcattaacaatgaggagctcttgaaagttttattggcaggacctaagatagttacagacccacaagtaacatgggtctagaccttgggaacaagaaaagtcaagatcgagtatgcagacttgggaaccgagtataactaatggttaagattaaataaaaatacataagaacactgagatagagaaatggctcattaatgctgcaaatgtctgcatgtttagggatgaaatagaaaaagaagtcagaaaaatacagttcaaacaataggaaagaaaaccagaaatgcatgattctaagaaatgaatgggtggacatggtggctcacatctgtaatcccagcactttgggaggccgaggcagaaggatagctacagcccaggagttcaagaccacccagagcaacacagcaaaaccccatctctacaaaaaacaaaaataaaaattagccaagcatggtggtacacacctgtagtcccagctactcactcaacaggctgaggcagaaggatcacttgagcccaggaggtgaaggatacagtaagctatgattgcaccattgcactccagcctggctgagagaatgagagcttgtttccaaaaataaaaaataagaaagaatttttagaatgagaggaaaacaacatgaaacatgagaaaaataacattccctgttatatggtaggtgcttcgcttatagtttctcattaattcatcatgtaatgtctctgggataaacattatggatttcctgcagaaacagaagctcagaattttatgccaggtgttgaaaggccatgtagctaatagatgatagaacacagactcacactctggtagtcctgagttaacagtagaaaagtcctgggctgggcgtggtggttcacgcctgtaatcccagcattttgggaggttgaggcaggcagatcaccagaggtcaggagtttgagaccagcctggccaacatgactaaagcctgtctctaccaaaaccacaattacccagcgtggtggcgggcacttatagtaccaactactcaggaggctgaggcagaagaattgcttgaacctgggaggtagaggtttcagtgaggcaagatcaagccacggcactccagcctgggtgacagaatgagactctgtataacaaacaaacaaacaaaatcagtaagaaagtcccagactaagaggcatcaaatcaggattctactccaactctgatgccagcttccaggaatacacttgataagttgtttcattcccataaatcttgggtgattcgtgtttaatgagagcattgaactgaatcatttattctatgactcagttctaatatttcacaattctatggttgtataatattacaggaaattcttgagaaggtgcagagggaatggatgaaaaaaaccacatgactaacataaa

SEQ ID NO: 72 - DNA, 4633 bp, Homo sapiens
atgatcacaagaagaaactgtgctctaaaatgaaccaatgaacaatatgtgtcgggatagacacacattaaacaataatataagtatctgcacaatatgtatctcaaattatcattttaaggtattatgagtattttaacacactggaaaatttacttgctaacagtttcttccattcacactggttaccttttgaatttatacttttgtactcatgctaccatccctcaaaatgtttcttggaaagctctcttaaagtaggttttagaacctccagcaggttattttttaaattcttgcacatggatcatgagtttgatttttgaaaacagtgagaaaaaaactcagaaacaaaaggaaataatggaattctgaaaaaattatgaattaattttggtagagttataaattcaaatgcctgcaagtgctgggtaggtaatgtaaagtgagtacagacagcatgctggacactgtagtagctggagagttcaggctatgtctaaaggatgctggaatgcaggatcagcatagcctggttttccagtcttgcagcctaggctgaaaatttacctattgtctggaccatctcaatgttttaaatgttggctcagttctttaaacacttgatttgcaaactctgctttacaatagtacattttcatcgtgcttatattctatgcagatttttcttaaacttttcataaatataaatgtcttcacactatttttttctcactaattcatcaatagcatatgacaaagagtgagaggcagaatggaaagatatcatatggtcttcccccatataaaatagcattttccttctactttaccctcacatatttttgccatcacattatcagcatttgacagattgtgcatttacttatttgtctttttcgctactgtaacctaagctctatgaagatttttgttgttgttgactgatttatacttagttcttagaatatttattggcaaataatagactcttaataaatattcattgaatgaatgaatattacacagataggcaactatatggaagaagtaaccagggaattatggatatttaactttgacaagaaaatacacaatcaggaatacatccgatggtatgttggagctggctcatactggcctgcaagaggtgatggtgtgcatctcttctcagctctgcatacagtgacgtcccattggttggctgaagtaagccatagtgagattaattccacctcagaaatcagcaaatgatacaaatattgtctcatttaccagcatactattggatacaagagttatgatatattggcttagtcaaaagaagcattttctaacatttagagctctctaacaacagaatggcctatctcacagtatttggtcctgcattaaagtttcacttactggaacttaacatcagctgtccccaatctttttggcaccagggactggtttcatggaagacgatttttctacagatgagggaagctgatgggtttgggataaaactgttccacctcagatcatcaggcattagttacattcttatacggaacgtgcaactagatccctcacatgcacagttcacaatagcttactgctcctatgaaaatctaatgcctcggctgatctgacaggaggcggagctcaggcggtagtgctctcctgcccgctgctcgcctcctgctgtgcggccaggttcctaacagactaggaacccatatccttccgtggcctgggggttggggacccttgctatacatcataaaacttattcaagcttgtagaatcgctgggacataagatattttgctcctttgaatatagtgtcatttttcctatggctgcttttaagatttttctaatcgtcattggtttttctaatgttttaatatggtatgtccaggtttggaattatttttatttataatttttaataatattttagtcatttactttagattcttagaacttcttgaatttgtggtttggtatcttttatcagttctagaaaatctcagttattatttctttaaatattttctctgccacattcactttgttctatttctgagatgttacactttctcattgtaccctcaaagtcccttccccttcctctatatttttccatccctttgtctactatttagtttcttctaatcttgcttctagtttattaattctttctttaactatatctaatcaaattataaatcccatagaaatttttttgcaaagttattacatttttctgttatttattttctatttggttgttttccaaatttgctatgtcaacttttatagtttatagcaccatactgaaatatttatacttgatattttatttttttctaaataatataagcatttatgtttttatagccttatacttcatttataataagcgtagtatatcaagaatagtatatatcaagcatttgtgggtatgtttctatttcctgttgtatcaacttggtttcattcctggattcttatttcctgtattcctgtttaagtgtgctggacattgtttttgagcattatttgtaagaataattggaaatctatgatgacaagcatattccttcaaagaagacttttgtttactttttccaagtaactggaaataatagtctgggaccatcttaatctcagttcaagctttaagattttctggattatccagatgacaaacgaccaggctaaaagtctggaaacattggtttatttatagttactgtttatgatggaagtacaacatttttatgtctcagtttaatgaaataaatgattaattagagtctccatttttagtggaacccaggctttgacttttcccttatagccccatgacattgcagaaagctcagctccacttcagagccttttctctgcagtgttagaatttacttattttggagttcttgtcttctcactggctctgctctgttaattctccaccttcttgttaactcatagctgcttttaagattttatttttatttcacttaatttgttgttttcctcatttaaaaggcttttctgaattctgagttctccatcactctaaattgaacagagattaatattttgagaatttgtatgtcttaaaatactcttatccttatttcactcttctacttaatggatagtttggttggttataaactactgtgctaaaataatttttcttagattttttgaaggcattctccacagttttctagattccagtattggtgttgagaagtctaactctagtcttagttccaatactttggctttatttcttcttagtgtaagctattaggattatacctttgtccttaatattttgtaaactttcatgataatgggccattctatgggtttcatttattgtgctttaatctctctaagtgtggaaatttatgtcctacaactgtggcaagctttctttgataaatttttattctccattttcttcctctcctcccctgaatcttccattagtcagataatgaggcttcctaggatgattttctaattttttatactttctcttctattacccacacttctctttttgttttaatgtgtgagaggtttctctgattttattttctaattcttctactggatttaaatttctgatgtatattttaatttccaagagctcttattctctgttcctatttttgtatatcaatctgctttgtttatttgtttgttttgttttgttttgtttttttgaaacaaggtcacattctgttgcccaggctggaatgcagttgcacaatcatggctcactacagccttgacctcctgggctcagttgatcctcccacctcagccacctgtgtagctgagactacaggcatgtgccaccatgctcaactatttttatttatttttggtagagatggggtttcgcatgttggccagttggccaggcttgtctcgaactcctggtctcaagccatctgaccaccttggcctccaaagagctaggattacaggtatgaaccaccatgcccagccaacctgcttttttttatggctgtggtattttcttttttgttgagagagagacagagagagagacagagaaagagagagaaacagagagagagagagagatatttaaatgccaattttgtgcttgtattatctccatatatttgtctttttttcctcttcctttatttttttctgtttctgtggttaaaagcagagaagattcttcctgtttcttagaagggggtagttgggataagcctagctatcaatggtgggagagaagagtctgaaggcctactcttcagcatgcagactttccttaacccccttgatttcctctgtccacaattgtccttcctgtactcttcttgctattccaaagttgagtctctcaggttctatttttcactaaatttcagactcctgtgaggcaattgggaagatgaatggaaacagtcatagcttatctttgtatggcagagttgtgagaatggaatcaacactaagctgcatagatacttgtcttcagaatcttgatttttagccacaatcctcactcccaccttctatacaacctgaaaaagagctttttgctaagagaaacccattgtcttctaattagatc

SEQ ID NO: 73 - DNA, 9640 bp, Homo sapiens
aagatattttatctttgttttctcaccctctcacaagagtgagaggggctgtcttttgtcattcataataagctcctttcaaccataccagaatttatactgatcaggtgactcttggtgggagcctagatagcttcaggatgggagctggttgccgaaaaaaccaaccaagtgattagatgtttggaaatttctgcctgacccctgacttacgggagggctgcaaggagagagggggtagagatttagttaagcacaaatgtccaaagacttaatcaatcatgcctatgtaacagaatcaaccataaaaattctaaatgattagggactgctctcaagcttatattctatctataagcaacgggataatttgatagaaaataggataacacaggaaaatgtctgtgaaaattgctatgaggacaacaatagagagctactgatagagaacgactgagaagctactttagattgacattcaagaaggcccaaaagacattttactgaagtctaaatgatataatggggccaaccatgtgaatggctatctgggaacatacactccacaaaaaggaaaaaaaaagattaaaatatcttgattcaacttctcaaattttctaaaacactgaagaaaagagaacacttccacactcattttaagaggcattattctgatatcaaagccagacaaagttaccacaaaacaactaagaccaatatcccttatgaacattgatacaaaaatcctcaacaaaatatagcacactcacttcaacaggattgtaacaggttatacactatgaccaactggaatgtattcctggaatgcaaggttgattcaacatacaaaatcgaacaatgcaatacaccaccttaacagaatggagaagaaaccacatgatcatttcaaatgaaaacagaaaaagcatttgattaaatttaacttcttttcataaaacacacaactaatatgaatagaaggaaactatctcaccatagtaaaagccatatacaaaaaacccaaagtaaatgtcatactcaaagcagtaagactgaaagcttttccacaaagatcaggaacaatgaaaggatgctattaggttggtgcaaaagtaatcgcagtttttgccattttttttttaaagtaatggcaaaaaccgaaattacttttgcaccagcctaatacttctgttacatatagtactggaggttctagacagagcaattagggaagaaaaacaaataaaggcatccaaactggaaaaaaagaagtaaaattatctctgttcacagatgatatgatcatatatgtagaaaattctaaagattccacaaaaaaaacctattagaactaataaatagggatggagacaagacggctgaataggaacagctccagtctaaagctcccagcgtgagcattgcagaagacacatgatttctgcatttccaactgaggtaccagattcatctcactggggagtatcggaaagtgggtgcaagacagtgggtacagtgcactgagcatgagctgaagcagggcggggcatcacctcacctgggaagtgcaaggggtcagggaattccctttcctagtcaaagaaaggggtgacagatggcacctggaaaatcaggtcactcccaccctaatactgtgcttttccaatggtcttagcaaacggcacaccaggagattatatcccgcgcctggcttggagggtcctacacccatggagcctcgctcactgctagcacaacagtgtgagatcaaactgcaatgcggcagcgaggctgggggaggggcgcctgccattgcccaggcttgagtaggtaaacaaagcagccaggaagctcaaactgggtgcagcccaccacagctcaaggaggctggcctacctctgtagactccacctctgggggcagggcatagccaaacaaggcagcagaaacgtctgcagacttaaatgtccctgtctgacatctttgaagagagtagtggttctcccagcacacagctggagatctgagaacagacagactgcctcctcaagtgggtcactgacccccaagtagcctaactgggaggcagccccaagtaggggcagactgacacctcacacagcccggtactcctctgagacaaaacttccagaggaacgatcaggcagcaacatttgctgttcaccaatatccactgttctgcagcctccattgctcatacccaggcaaacagagtctggagtggacctccagcaaactccaacagacctgcagctgagggtcctgacagaaggaaaactaacaaacagaaaggacatccacaccaaaaccccatctgtacatcaccatcatcaaagaccaaaggtagataaaaccacaaagatgcagaaaaaacagagcagaaaaactggaaactctaaaaataagagtgcctctcctcctccaaaggaacacagctcctcaccagcaatggaacaaagctagacagagagtgactttgacaagctgagagaagaaggcttctgatgatcgaactactccgagctaaaggagaagtacgaacccaggcaaagaagttaaaaaccttgaaaaaaaaattagacaaatggctaactagaataaccaatgcagagaagtccttaaaggacctgatggagctgaaaaccaaggcacgagaactacgtgacaaatgcacaagcctcagtagccgattcaatcaactggaagaaagggtatcagtgatggaagatcaaatgaatgaaatgaagtgagaagagaagtttagagaaaaaagaataaaaagaaatgaacaaagcctccaagaaatatgggactaggtgaaaagaccaaatctatgtctgattggtgtacctgaaagtgatggggagaatgaaaccaagttggaaaacactccgcaggatatcatccaggagaacttcctcaacctaccaaggcaggctaccattgaaattcaggaaatacagagaacgccacaaagatactcctcaagaagagcaactccaagacacataattgtcagattcaccaaagttgaaatgaaggaaaaaatgttaacagtagccagagagaaaggtcgggttacccacaaagggaagcccatcagactgacagctgatctctcggcagaaactctacaagccagaagacaggggggccaatagtcaagattcttaaagaaaagaattttcaacccagaatttcatatccagccaaactaagcttcataagtgaaggagaaataaaatactttacagacaagcaaaggctgagagattttgtcaccaccaggcctgccctaaaagagctcttgaaggaagcaataaacatggaaaggaacaaccagtaccagccactgcaaaaacatgccaaattgtaagaccatgaatgctaggaagaaactgtatcaactaacgagcaaaataaccagctaacatcataatgacaggatcaaattcacacataacaatattaaccttaaacgtaaatggactaaatgctccaattaaaagacacagactggcaaaattggatacagagtcaagacccatcagtgtgctgtattcaggaaacccatctcacgagcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatcctaaatatatatgcacccaatacaggagcacccagattcataaagcaagtcctgactgacctacaaagagacttagactcccacacaataataatgggagactttaacaccccactgtcaacattagacagatcaacaagacagaaagttaacaaggatatccaggaattgaactcagctgtgcaccaagcggacctaatagacatctacagaactctccaccccaaatcaacagaatatacattcttttcagcaccacaccacacctattacaaaattgaccacatagttggaagtaaagcactcctcagcaaatgtaaaagaacagaaattataacaaactgtctctcagactacagtgcaatcaaactagaactcaggattaagaaactcactcaaaaccgctcaactacatggaaactgaacaacctgctcctaaatgactactgggtacataacgaaatgaaggcagaaataaagatgttctttgaaaccaacaagaacaaagacacaacataccagaatctccgggacacattcaaagcagtgtgtagagggaaatttatagcactaaatacccaaaagagaaagcaggaaagatctaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaattaatgaatctaggaactggttttttgaaaagagcaacaaaatagaccgctagcaagactaatagaaaagagagaagaatcaaatagaagcaataaaaaaatgataaaggtgatatcaccaccgatcccatagaaatacagactaccatcagagaatactataaacacctctacgcaaataaactagaaaatctagaagaaatggataaattccttgacacatacaccctcccaagactaaaccaggaagaagttgaatctctgaatagaacaataacaggctctgaaattgaggcaataattaatagcttaccaaccaaaaaaactccaggaccaaaaggattcacagctgaattctaccagaggtacaaggaggagctggtatcattccttctgaaactattccaatcaatagaaaaagagggaatcctccctaactcattttatgaggccagcatcatcctgataccaaagcctggcagagacacaacaaaaaaaaaagagaattttagaccaatatccctgatgaacatcgatgcaaaaatcctcaataaaatactgacaaaccgaatccagcagcacatcaaaaagcttatccaccatgatcaagttggattcatccctgggatgcaaggctggttcaacatacgcaaatgaataaacataatccagcatataaacagaaccaaagacaaaaaccacatgattatctcaatagatgcagaaaaggcctttgacaaaattcaacaacctacatgctacaaactctcaataaattaggtattgatgggatgtatctcaaaataataggagctatctatgacaaacccacagccagtatcatactgaatgggcaaaaactggaagcattccctttgaaaactggcacaagacagggatgccctctctcaccgctcctattcaacatagtgttgaaagttctggtcagggcaattaggcaggagaaggaaattaagggtattcaattaggaaaagaggaagtcaaattgcccctgtctgcagatgacatgattggatatctagaaaaccccatattgtctcagcccaaaatctccttaagccaacaggcaacttcagcaaagtctcaggatacaaagtcaatgtgcaaaaatcataagcatttttatacaccaataacagacaaacagagagacaaatcatgagtgaactaccattcacaattgcttcaaagagaataaaatgcctaggaatccaacttacaagggacatgaaggacctctttaaggagaactataaaccactgctcaatgaaataaaagaggatacaaacaaatgcaagaacattccatgctcatgggtaggaagaatcaatatcgtgaaaatggccatactgtccaaggtaatttatagattcaatgccatccccatcaagctaccaatgactttcttcacagaattggaaaaaactattttaaagttcatatggaacccaaaaagagcccgcactgccaagtcaatcctaagccaaaggaacaaagctggaggcatcacactacctgacttcaaatacactacaaggctatagtaaccaaaacagcatggtactggtaccaaaacagagaaacagaccaatggaacagaacagagccctcagaaataatgccgcatatctacaactacctgatctttgacaaacctgacaaaaacaacaaatggggaaaggattccctatttaataaatggtgctgggaaaactggccagccatatgaagaaagctgaaactggatcccttccttacaccttatacaaaaattaattcaagatggattaaagacttacatgttagacctaaaaccagaaaaaccctagaagaaaacctaggcaataccattcaggacataggcatgggtaaggacttcatgtctaaaacaccaaaagcaatggcaacgaaagccaaaattgacaaatgggatctaattaaactaaagagcttctgcacagcagaagaaactaccatcagagtgaacaggcaacctacagaatgggagaaaatttttgcaatctactcatctgacaaagggctaatatccagaatctacaatgaactcaaacaaatttacaagaaaaaaaaaacaaccccatcaaaaagtgggcaaaggatatgaacagacacttctcaaaagaagacacttatgcagccaaaagacccatgaaaacatgctcatcatcactgaccatcagagaaatgcaaatcaaaaccacaatgagataccatctcacaccagttagaatggcaatcattaaaaagtcaggaaacaacaagcgctggagaggatgtggagaaataggaacacttttacactgttgatgggactgtaaactagttcaaccattgtggaagtcggtgtggcgattcctcagggatctagaactagaaataccatttgacccagccatcccattactgggtatatacccaaaggattataaaacatactgctataaagacacatgcacacgtatgtttactgtggcactattcacaatagcaaagacttggaaccaacccaaatgtccaacaatgatagactggattaagaaaatgtggcgcatatacaccatggaatactatgcagccataaaaaatgatgagttcatgttctttgtagggacatggatgaagctggaaaccatcattctcagcaaactattgcaaggacaaaaaaaaacaaacaccgcatgttctcactcataggtggaaattgaacaatgagaacacatggacacaggaaggggaacatcacacaccggggcctgttgtggggtgtggggagtggggagcgatagcattaggagatatacttgacattaaatgatgagttaatgggtgcagtacactaacatggcacatgtatacatatgtaactaacctgcatgttgtgcacatgtaccctaaaacttaaagtataataaaaaaagaactaataaataaattcaacaaagtagcagtatacaaaatcaacccaagaaaatcagatatatttttatacattaccaatgagcaatctgaaaaggaaactacaaaaaaaattctatttacaatagaaatagaatttctttattttaaagaataaaatacttaggaattaatttcaccaaggaggtgaaatatctgtacaatgaaaactacaaaacactgctgaaaaaaaattttaggacattaataaataaaaacctatcatatcttcatagataagaaaatttaatgtttttaagatgcccatgctacccaaagcaacctacagattcaatgtaatccctatcaaaatcccaatgatgtttattgcagaaatagaaaaacttatcctaaaatttgtatgaaatctcaaggggccccaaaacaacactgaaaatagaagaacaaagctaaaattctcatagttcctgatttcaaaacttattacaaagctatagtaatcaaaacaatgtgatattggcataaacacagacagatagatgggaggaacagagtagaaaacccagaaataacccttgtatatataatcaaattattttcaacaagagtgtcaagaacattcaataggaaatgaacagtattttcaagaaacagtgctggcacaactggatatccgtgtgctaaagaataagtagaatccttacctagcaccatatacaaaaattaattgaaaatgaatcaaagacctaaacataagacctaaaactataccactcttgggaaaaaataaaacagggcaaaaacctcatgataccagatttggtaatgatttctcagatacgaccaaaaaggcacagagaacacaagaataaaacagacaaattggacttcatgaaaattaaaaaaaaaaacctgtgcatcccaagacaatatcaacagagtaaaaagacaacccacagaatgggagaaaacatttaaaaattacgtatctgataagacattaatatacagaatatatagagaactcctaaaacttaacaataaaaaaatcaaattcaaaaatgggtaaaggactcgtatggacatttctccaaaggtatacaaatggccaagaggcacgtggaaagatcctcaacatcaccaatcataagacaaatataaatcaaaaacataatgagataccacttcacacccattatgacggctattatcaaaagacagaaaagaacaaatgttggcaaagaagtagagaaattggaaactttgtgtatagctaatgggaatgtaaaatggtacagcctctgtggaaaatagtatgaagattcctttaaaagttaaacataaaattaccttttgacccagcaattccacttttgggtaaatactcaaaagaattaaatgcagggtctcaaagaggtgtttttgaacaagtttcacctcacgatgaacgtacacccatgttcatagtagcattattcacaatggctaaaaagtggaagcaacccaaatgtcattcgacagacaaatgaataagtaaaatgtggtagaaacatacaatggaattttattcagccttaaaagggaaggcaattctgcaatatgctacaacatggctgaaccttgagtacattatgctaaatgaagtaagtcggtcacaaaaaaaggcaactaatgtatgatcctgcttatatgaaatactcagagttaccaaaatcacacatctagatagacagtagaacagtggttgccaggggccgaggtagcacacaatggacagttagtgcttaatgggtacagagtttcagtcttacaagatgaaaagagttagggggatggataatggggatgcttacacaactttataaatgtatttaatgccactgaactgcacacttaaaaatggctaagatggcaaattttgtttatgtgtatcttggcacaataaaaataaaactgagggggggaaatgccttgattcaagaaaaagctcaccatatttgagttgaataaagaaggctgaagtttaatgcaccagaagactagctctagatgagatctgagagacaggcaaggaccagatcatgtaaggctttcctggccataggtaagcagtctggattatctgaaaattccggtacttccagg

SEQ ID NO: 74 - DNA, 15072 bp, Homo sapiens
aaattaagacacaaaaaattctgaaaaggctctggttgaattaaaaaaatcagtggggcatatttgtgtgggtctatttaattcattcctttttattactgagtagtattccatcgtatggctataccacaatgtgtttataccttcacccattcttgaacatctggttgtttctagctttgggttattgtgaataaaactgctgtgaacattcatgccagctattgtgtggacacatttttctttctttcttttttttttgggggggggacggaatcttgctgtgttgcccaggctggagtgcagtggcacaatctcggctcacttcaagctccgcctcctgggctcacaccattctcctgcctcagtctcccgagcagctgggactacaggcacccgccaacacgcccagctaattttttgtatttttagtagagacggagtttcaccgtgttagccaggatgatctcgatctcctgacctcatgatccacccgtcttggcctcccaaagtgctgggattacaggtgtgagccaccgtgccccgccgacacgtttttatttcttttgggcaaacacctaggagtgagattgagggattgtatggtaactgtatgtttaactttacaagaaacttgataagaaattgccaaactggtttgctggtgagaatgctgtgggtgaaggattacctaggtgccgaggcaagagactgaaggcaaaaactgtttcagtataataaaatagttagaataagaacagttataatacaaattagatatagagatgatcgtggacattatcaataattagcataaacattattaatcattagtttttaatattactctttgttgtattactaatataaccaaggaataaccagcgggtatagggttaggtgctgaagggacattgtgagaagtgacctagaaggcaagaggtgaaccctctgtcatgcccgcataagggccgcttgagggctccttggtcaagtggtaacaccagtgccttggtaggcacccgtacttagcagaccgtgaaagagagtcttcctttccttggaggagtcagggaacactctactccaccagcttcttgtgggaggctggatattatccaggcctgcccgcagtcatccgcaggactaaacccctccctgtgatgctgtgcttcaatggtcatgctcctggtccactttcatgttcctcccgtactcctgattcctctttgaagttcttagaagataatggtagaagaaatagtgaaagtcttaaagtctgtgatctttctgataagtgcatagaagaaaacgctgacgtatgctgccttccctctctgcttcagctacctaaaagagaagggccccgtgtcctacgatcacatgacttgcttggccttatcaatcacttagatgactcaccctccttaccctgcccccttgtcttgtatacaataaatatcagtgtgcccagccattcagggccactgccagtctccgcgtcttggtggtagtggtcccccaggcccagctgttttatctttatctctttgtctcgtgtctttatttcttatgatctctcatttccgcacatggggagaacacccacaaagccccgtagggctggaccgtacagaatgcaaaaaccattttgtattctcaccagcagtaactaagagttccagttgttctacatctttgtcaacactttttattgtcagactctaattctagccactctagtgggtgtgccctagtatctcatattgactttaaaatgcattttcctaatgcttaatgatatattgagcatttcttcatgttcttacttgccatttgtatatctttgcatcttttcctcatttttcattgggttctttttcttattagttgtgtgtttttaaaataccacgtaagtattttgagggagattatctcaaaggaaccctaaagtggttttttccagcctcaaggaaacttaggtctttaagaaaataaaacttgctccttatttttaaaaaagagggagaaaaataaatctcctaatttatttggtgtatctatttgaatgtccatgtacagcactaagttgtttaaagaagatatatgacaaagtagctaaaaaacatggctggatatggtggctcacacctgtaatcccggcactttgggaagctgaggtggatggattgcttgagcccaggagttttaaaaccagccttggtaacatgacaagaccccatctcaaaaataaataaataaataaaaataaaaagcataatgcttactattcatcatttggtgaattaaagtgaatgcaatattttggtgattcattttgctgatccaatgtgaatgacaactcttttaagccacatgttaccatttattgaataactcttcttaatgacttttctgacccctctcaaaggtaataattcatttctctacctttgaaaagcctctctgtatcttgttaccattttattgaataactcttcttaataacttttctgacccctcccaaaggtaataattcatttctctacctttgaaaagcctctctgtatcttgcagtacgcctcctctagaaatggcaggaagtccttggccggcgcggtggctcacgcctgtaatcccagcactttgggagtccgaggcgggcagatcacgaggtcaggagatcgagaccatcctagctaacacggtgaaaccacgtctctactaaaaatacaaaaaaatacaaaaagttagctgggcgtggtggcggacgcttgtagtcccagctactcaggaggctgaggcaggagaatgccgtgaacccgggaggcagaggttgcagtgagccgagatcgcgccactgcactccagcctgggcgacagagcgagactccatcgcaaaaaaaaaaaaaaaatcagttttatttacagcttaatgtgattgtatcacaactctttagaggcagtatggcatagtgaacagggattgggttttagagtcacttgcaacctctctgacttgatcctcagtttcttcatctataaaatagagattatgataccacatgtaatgtgaaaattaggactaggtaaacaaagtgcctgctgctatgtttggctcaataaataataactattattctcatgttttgatcttcctagtctacaacttaacctcttaaaaattagaaattggccgggcgcggtggctcacgcctgtaatcccagcactttgggaggccgaggcgggcggatcacgaggtcaggatatcgagaccatcccggctaaaacggtgaaaccccgtctctactgaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaattagaaattgtgaggccgggtgcagtggctcatgcctgtaatcccagcactttgggaggctgaggtggccacgtggatcacctgaggtcaggagttcgagaccagcctggccaacatggtgaaaccccatttctactaaaaatacaaaaattagccaggcatggtggtgagtgcctgtaatcccagctactcgggaggctgaggcaggagaattgcttgaacccaggaggtggaggttgcagtgagtggagactgcaccactgcactccagcctgggtaacagagtgagactccgtctcaaaaaaaaaaattagaaattgtgataagattttaactttaaagttatattttgttatagatcattttctgtaattggacatttactatgtgccaggctataactggacatttacttgtgccaagtgctttatatatgaaatctcacaaggcaggtaggttttcttattcttattttacagacaacagagacacacaaggatgaagtaacttgctcaggattcttcaggaagaggcagagtttgaattcaaactaaagccagattctgaccctggcattttagccactatggtttcctgcttcccacttttgtttttatttgcattccaagctttacctaatctaaaactcgtgttactttaaatctagcctcatctatgtttgcacgtatccttgcagatattatccatctacatcactggaattgttacgtgtataaacttgaacaatatgtgatctgtttagcacatccaggttttctctcctacaggacctaagatctagaagttgacttcatcaaattccattccatttcattctatttattctattttttttttttttttttagatggagtctcgctctgttgcctaggctggagtgcaatggtgcaatctcggctcactgcaacctctgcctcttgggttcaagcgattctcctgcctcagcttcccgaatagctgggattacaggtgcctgccaccatggctggcaaatttttgtatttttagtagagactgggtttcactatgctggccaggctggtcttgaactcccaacctcaggtgatctgcctgcttcggcctcccaaagtgctaggattacaggcgtgagccactgagcacagcccattctatttattttaatttaaaaatattgcctgggcgaggtggctcacacctttaatcccagcactttgggaggccaaggcgggtggatcacgaggtcaggagatcgagaccatccgggctaacacggtgaaaccacgtctctactaaaaatacaaaaaattagccgggcatggtggtgggtacctgtagtcccagctactcaggaggctgaggcaggagaatggcgtgaaccctggaggcggaggttgcagtgagccgagattgcgccactgcactccagcctgggcaacagagcgagactccgtctcaaaaaaaaaaaaaaaaaaaaaagcaaaaaattcccaaagatggtgtattagccattgtcaaagaaaataaattcttaaggattactatagagaatgaatattggtattggttaatataactctgatttttaattaaaataataaaaagaaatgaatgagtttgaatattatccttataactttttatttcttttgtttacctttaagccctttacaattgtaatttccaaattacaattttgattactgtttcagaaattaaaatcccctacaacacagcctctaatgattcccattttccattttaacctggcttcttccccgggcaagtgcccaacgaaatggatgattcttatttccatgacctgaaggtcaaagaactctagtcattccaaacctgtagcaggagggagcagattacaagaacaagagccttcctgcttctaaatcacatgcatacatgtttagctcagttctagttttgtttttttttttttttttttttttttgagacagagtcttgctctgtcgtccaggctggagtgcagtggcacaatcttggctcactgcaagctccgcctcgcgagttcatgccattctcctgcctaagcctcccgagtagctgggactacaggcgcctgccaccatgcctggccaattttttatatttttaatagagacggggtttcaccatgttagcccggatggtctcgatctcctgacctcgtgatctgcccgcctcggcctcccaaagtgctgggattacagcgtgagccaccgcgcccggcaagctcaattctagtttttaggtttgttttaaataattcacacattgagaaggtacatagacatttgatattggtaaaatattgagatagtattataaagttttatttatataatacgactttaaatcaaatctgcttgagacagggtcttgctaactagattgtgaactattcaaatcaaagacagttttcttctttgtattacccacagcaagtaaataatggaattctctttttttttattttatttgaggtggagtctcgatctgtcacccaggctggagtctggagtgcagtagcactatctaggctcactgcaacctccgccgcccagggttcaagtgattctcctgcctcagccttctgagtagctgggactgcaggtgcccgccaccacacctggctaatttttgtatttttagtagcgatgaggtttcaccatattggctagactgttctccaactcctgaccttgagatccgcctacctcggcctcccaaagtgctgggattacaggcctgagtcactgcacccggcctggaattctcaatagaatcatagaacctggactttaccactcatgtgctcccatttggcatttcaaatagcccagtgacaagagttcccaatgcaggcagcaactatttctactgttgaatacttctaattgtttttttttttaatgaatgaatgaaaggacagaagaaagaaaagaaaagaattataaatttgaactcaaatgtgataatttgcacacatttttcattttattcacagaatgattattgaagttctgaacacatcatttgtgtttcccttcagacctctcctctccaggtgaaaagtcagggtactttccactgtacctcaaggactggggagcctgtcagcatcagtgggttgggtgcagggtcttgggagactttttcaaactacacaactctctcaaacagtggaagctgacataccctcagagttagggcaagggagccccagttaaaggttaggttctcccagaagcaggtgctgagaaggagttgggaaaacaaaaggtttattgggagtaaatcctttaaagggaaagggaaggagaagaattgggcaagtggagccatcagaaagcactgcagacctgacagagtccgccatccccatgaggagccccagtgcagagactgcctgttacaggagtctggcactaagctgaaatggctaggcgtttgtaccaccctgttctgtcattggctaggggtcctcccaggaagagcaagctcttggcctaaaagctgatgcagattctaaaggagctgacagctggaggctgttgggaaaccacactctgtgtagctgggcagagagtcatttctttcctttttggtagagatgagatctcactatgttgcccaaggtggtctcaaattcctagcctcaagcaatcctccgacctcggcctcctaaatgctgggattacgggtgtgtgctactgcgcctggccatgggttatttcttgaagatggctgtgagcagcacgcatgtctttgtcttccctaaaaaggcaggaagggaagaatctgagagatagtttagagaagtcttgacaagggttggtgattggtcagatgtatagagggagaggtcaaagataaccttgatggctaggatagcattaacttcaacaaatgtggtttggctgagttataacctcttcacaccatgcctacagctgccttttactgaaagcagcctgcttatttattacacaggttgccatggcttgtgccatctgtgttgagtgaccaaccacactccttacctgcaatcgatagtgctggccaggggattgatctgcaggcaaaggcagcaaagaggctggaggtggcttgatgtgaaactgtcccattttgaatggggacaaaccaactcaatactcttttgggaagactcaagtggtaagtgaacaaggagagattgaagcacgtgcccaggctgtgtcctaaagaacactgagctgttgttctcattctctcctgctgcactgagctgtctagacagcagtgagacctagaagccctgttgttacttgaagaggcaacatatcctttgctgcctgatatatccttgcagcaaactccagtaatcataggtgatctgggcatattgcttccttaaggagagtatcctctgaatttgaaagtgataatgctgatgattattgtgtttttgtataataaaagtgggtaaaagatgaggattgaccctgaacctctaagaactgtcccttgagtctcagttttggccgacttgtataaactttgaacatgtccagcttgcctctgcacctctgtgattatttttcccatagcaggagctgtcacctctctctctctctctctctctgtctttctttctttctttctttctttctttctttctttctttctttctttctttctttctttctttcctttctttctttctttctttctttctttctttctttctttctttctttctttctttctttctttctttctttctttccttctttctttctttttgagatggagactcactcttgtcgcccaggctggagtgcaatggcacaatctcggctcactgcaacctctgcctcccgggttcaagtgattctcgtgcctcaacctcctgagtagctgggattacaggcgcccaccaccatgcctggctaatttttgtatttttagtagagacggagtttcaccatgttggccaagctggtctcaaactcctgacctcaggtgattcctctgcctcagcctcccaaattgctgggtgtaagccactgtgcccaaccacatctctcatttttgaatgccaggctgatctgtctgcttcactttcatggtcttccaaaaaactgtcaggctacccaaagtagcctgaagtgattattgtctatatgtttttctgcatcattttgctccctttgaactcagttccaaaaagatggagtgattcgtgaagtgaatttctacttttgctttgccataaaatagtcctactatctgttctttcactcattcattcatttgttcatccagtttcctccctgtctccactcccattgccactgcatgtatcctgcccaacacagttcaaatgtagtgagaaggtaggtgtactttaggacctttgtgattcagcctgcccttactgttaattatgacttagtatttttaatcatgtcactcaagaaaccagatgtgacacttaaatgtagcttggataggataaggataagacaagatagaataagggataattacttgctttgcagaggattctttttaatttttaatttttaaaaaataaaagtattggccaggttcgatggcttatgcctgtaatctcagcactttaagagggaaaggtgggtggatcgcttgagcccaggagttcaagaccagcctgggcaacgtgataaaacaacatctctatgaaaaatacaaaaaattatccaggcgtggtggtgcatgcctgtagtcccagctaccggggggcactgaggtgggaagatcacctgagcctgggaggtcgaggctgcagtgacctatgattgcaccactgcactccaacctgggtaatggagtgagaccctgtctcaaaaaacataaataaataaaataaaataaaaattaaaactattcaccacagggtcatctcagaatgtctccatgatgcatttaaactctgtgatttacaatacttaaatttatacttcattttctcaaaagctagctatcaagttaagtagacatatgtcctgaaataattgttatttataattataggttacacatcgtgatagctttactttttttgcataaacatggctgaaaatacatgaaaaaaatgaagaaacactgaagtacaacttaaaagaagccaaaagactctcaaaataaggaatgatcatcaaaaacaatctgtcactttactttgcacaaataacaacagaactcaattttacactaaggataaataagatgtagtgaacatgacttttgagtatgatacttatgtaaagtaacggtggagcagacattatacatccccatttgggggaaggagggaactggccatgtctttcttcctttctttctttctttcttttctttctcagggtctcaatctgttcccctggctgagtgtagtggcaagatcatggctcactgcagcctcaagctcccaggctcaagtgatcctctcacctcagtctcctgagcaactgggactacaggtggaagtcaccatgcccagctaactttttattttttgtagagatgggggtctcactacattgtccagatttgtctcaaactcctagacccaagcaatcctcccacctcagccttccaaagtgctggcgtgagccaatttttatatttatttatttatttatttatttttcaaaatggagtttcgctcttgttgcccaggctggagtgcaatggcacgatctcggctcaccgcaacctctgcctccagggttcaagtgattctcctgcctcagcctccagagtagctaggattacaggcatgagccactatgccctgctaattttgtatttttagtagagacagggtttctccatgttggtcaggctggtcttgaactcccgacctgaggtgatctgcccgcttcagcctccctaagtgctgggattacaggtgtgaaccaccgcacctggtttacctggccaatttttaaatgttttaagtagctattattttcacataattcaaaattcaaaagctataatacaatatgcagttaaaagtctccctttcagaaatagacccacataaaaacagtcacctgattttttttttttttttttgagatgaagtctcactgtgtcgcctaggctggaatgcaatggtgcaatcttggctcactgcaaactctgcctcctgggttcaagcgattttcctgcctcagcctcctgaatagctggggttacaggtgcacactaccatgcaaggctaatttttgtacttttagtagagactaggttttgccatgttgaccagctggtcttgaaatcctgacctcaagtgatctgcctgctttggcctcccaaagtgctgggattacaggcttgagccactgcacccggcaagtcaactgatttttaacaaaggagcaaagacaatacagtggagaaaagagagtcttttcaataagagtgttggaacaactgggcatccatgtgcaaaaaaaaaagaaaaagaatctagacacagactttataccttttacaaaaattagttcaaagtgaatcacacacctaaatgtaaactaaaatagtataaaactcctagaagataagaaaggaggaaatcgaaatttcctctaaatctaaaatccatttgggggaaggagggaactggccatgtctttcttccttgggtttggcaatgacctttcagatatgacatcaaaggcatgatccatgaagaaaaaattgataagctggatgttattaaaaatctctgccctgtgaaaagcactgttaagagaataaaaagccacagacttggaaaaaagttgcaaaagacattatctgataaggaacttttatccaaaatgtactcttaaagctcaacaataaaaaaacaaacaactggcagggtgcagtggctcatgcccgtaatcccagcactttgggaggccgaagcaggtggatcacctgaggtcgggagttcaagaccagcctgaccaacatggcgaaaccctgtctctactaaaaatacaaaaattagccgagcatggtggagggcgcctgtaatcccagctactctactcaggaggctgaggcaggagaatcgcttgaacccggaaggcagaggttacagtgagctaagatcatgccactgcactccagcctgggcaaaaagagtgagactctgtcaaaaaaacaaaacaaaacaaaacaaacctgactataaaatggactaaagaccttaacagaaacttcaccaaagaaggtatacagatggcaaataagcattatgaaaggatactccacatcatgtgtcatcagggaaatgccaattaaaataacaatgagatctcactatatacctattagaatggccaaagtccagaaccctgacaaaactaaaggaccaagatgtcctttgataggtgaaattgattgatagataaactgtggtccattgagacaatggaatattatacagtattaaagagaaatgagctatcagccatgaagagaagtggaagaaacttaaacgtgtatttctctttagggaagactttttttttattgtctcctgtatccttgcacctgggaatggtgcctagtgctaggtaggtgcttaataaatatttgtcaagtagggcatgctggctcatgcctgtaatccaagcactttgggaggacaaggtgggagaattgctgaagcccaggagttctataccagcctgggcaacagagggagacatctgtgtatgggttgttgtgtaaacataaacgttcaactcttttggtaaatactaaggagtgtgattgccggattgtataagagtatgtttagtttttagctggatgtggtggcatgtgcctgtagtcctagctacttgggaggctgggctgggaggattatttgagcccaagaggtttcctgaacaaggtagaaaccatatgactctcttgagaaagcttttgggccagagggaacaggaaatgtaaaggcatattctaggaagacttgtttctttgactgatctactgtcagggtaacttctgttccttttccaaagaaagactcaagggagaaatcaccttctcagtgttgtatttaataagaggttaaacgtgagttggtcatggtgccatcttttttcatacctagcaacaatctgtattaattggaccatttacttttaagaaaggattattttggctgggcgcggtggctcatgcctgtaatcccagaagtttagggtgccagggcgggtggatcacaaggtcaggagttcaagaccaacttggctaaaatggtgaaaccccatctctactaaatatacaaaaattagctgggtgtggtggcgggcgcctgtaatcccagctactcggtagggtgaggcaggagaatcgcttgaacctgggaggcggaggttgtggtgagccgatattgtgccactgcactccagcctgggtgacagagtgagactctatctcaaaaaaaaaaaaaagaaaaaaaggattattttatgtataaatatattttgcttaactaagaacttttttgaaaaaataatgtacatgttgattggatttttgtaagccaaatattttgaaaacattgtatcattttttagcatctctggacccagctagtattgtgagtacttctactctcttttcagtgacaaccttagagcagtagctcttaagtgggggcaatattgtaccccaggggacatttggcaaatttggtgacatttttggttgtgacaactttgttggaggaaggggttgcttctggcagctagtgggtagagaccagggatactgctaaacatcctcctacaatgaacagggccacccaccctcccccacaaaatattatgtgacctcaaagaaaaatagtgctgaggtggagaaatattgctctaggatctaaaacttacagaacagaggagaggactgtggcacatgcatcctatcaggttaaaacagagggtgtcagccaggcatggtgactcatgcctgtaatcctagcatgttggaaggctgagacaggaggatcacttgagcccaggagctcaagaccagcctgggcaacatagcaaggctccttctctacaaaaaataaaaaattagctgggcacagtggtgagcacctgtagtcccagctactcaggaggctgacaccgcaggattgcttaaatccaggagtttgaggctgcagtgagctatgatcgtactactgcaccactccagcctggtcaacagagaaagaccctgtctgtaaataaataaatagagggtgtgaggccatgccctctgttgcttttagtctaattcactcaatcatttattcattcatttgttcaataaatatttactgagtgctgagtatttaaaaaatattactgagtacaaattacttcagaacttagcaatttaaaaccacaaaaaccaggagctttttcacagtttctgtgggtcaggaattcggaagagatttggctgggtgttttcattcagggtctcccatgaagttgcagtccaaatgccggccaagatgcagtcatctgaaggctgggctggggatggagcctgcttcctgggcgctcacccacagggctggagaatggatgcaggctgctggccaaaggcctccgttctttgccacgtggagctttccaagcctgcttgaatgtccttaccacatggctcctctcacagcaggtgatcctacagagagcagggctgaagccacatattttattacctaatcttgactgttacacactgtcatgtctgcaacattttactggttttacagaacagctctattccatgtgggaggggactgcacaagggtatgaataccagaaagtgacaatcactggacagtatatttcaagctggctaccacagtgcctagacattgcaggactatggtccaggctctggtccagggccatggaccaggcttcattcctggtgaggagagataagcagttgataaactaatgaatgaacggggtaagtgctggaaaggaaataaataaagcagaatggtgcaatagagagcaatgggctaaggaggcaggagtgcagatgtagatggggtggtcagggaaggcctcactgagacctgaatgacaaggaactggccctggaaatacccagtgatagagtgttccaaggagagggaccaacacctacaaaatattatgaatagtcattggtggaggccaggtacagtggctcacacctgtaatcccagcactttggaaggctgagttgggaggactacttgaacttaagaagttgagaccagcctgggcaacatagtgagacctcacctctacaaaaaactaaaaaattagctggccatggtggcatatgcttgtagtcccagcgttgggaggctgaggtgggaggatcacttgagtctgggaggttgaggctggagtgagctgtgattgtatcactgcactccagcctgagtggcggagcaagactttttctcaaaaagaaaaaagtaactagtagaatcttgatatgtacatgagggctgagaa

SEQ ID NO: 75 - DNA, 13250 bp, Homo sapiens
gccttctcgtaaatctgttttaaaagtgtcctttattctgaataccattttgatccgtgatccactgatggaagtcaatgatgttgaactaagaaaatacataggttactagctatgaaccattcttcattagtgcacttgcttggtaatgggttaatttgaattgggaatgaatcttagtccacaaactagaggtgcagagaatattgcagtttgctaaatagacttaatcttgactttaagcttctactgctttcaggtagcagaaagattcacctcgattattcttggatttctttcccatatcaccctcccagagttgtgccaaggttccaggctttactaatgtcatgatgtcaggaaggcctgagaagttatccgtttacaccagtccctactgcttctgggctgcatttgaggctagggagggtgctttgtcagcatccagccatcctcctggggttgctgcacacctcagggtgcagccagagtgcaggtatggccatctgccactcagagtttcacagtcattcacttccaagatctcccttaagtgtgagagatcttgctatcttctcacctgcttttctcctcaagaaggtaagccagagccctcgacccttgtgaatgaggaaatttcagagagaaaaacattggaactccccctgccccagagttggtaactgctcaaatgctggctgccgccaggtggtgcaagaggcgctgcttctctgtggtcacctagcagcagtctcctgtggccagttccccacgtagaggtggcaactgcccttcttcatggctacttgctggaggtttgtgggaggaggggagtatggggggtgtgtgtggctttacctgccccaaattgtcaggaggatttgaggcatttctttgttgttgttgttgtttggctgtttccaaaacccatttggaaacctgttattccgtaagagtagccttcaaattcttaagcattttctataaatcttcagtgaactaataaaagtatttccttttcccttttctggcaatgggtagtctagttctgttaatattcctgcaaagaaactcatctaccagcctcactcacactgtgcacttttgccctcagaatcctcagtggctagcctaattgactacaaccagtttagatgatcagctaccttccttttgccattatttcagatgctgccttgcccatagcacaaccaatgcatttaaaaaataaaaacatttggggtgggagaactatgattaaataaaggagatctctgtagagtatggcaaagcttgcacacaactttaataaaaatatgctgtcttgagtaaccagcatattacagaggctctgtgaatgcctcttcatctagaatttcagtacaagctgtacataaaatatttatacagcacagtgtgctttgcccctcacaaaagcgtgggttcagatgtacactgttactatagacgtcactaacatataagccggtgaagaacctttaatgtatttgtaatgttagcaaagtatctgtcatcagattaaacttgtagtgactgataatgtagccttggctcctagccaaaaatattttttttgatatcagaatgacacttaatagtaaagatatgtcatagaggaaggggaagaagagaatttactagagaaacttaaaagactggttggtgcagaacctagtaacttggtttgtggctggcagaaatgggagtagtccctgggattacttctaaggaggaaattttactacaaacacagctgggaataattctgttaccaagtcttttttaggatcaatacagagcttatttgtaaaaattaaaatctaactatcactttattgtctatgggtatctgttacattttatctgtaaaagaggaatggaaatgcctgcctagtaggttcatcataaggactgagaggatacgggaccttattaagtcctcagtaagtagcagcaattttgcttttgtttttatgatgattacttccactcatgactttacctgcatgttctttaatcttcaaaatagattagtgaagtagtgatgtttccattttagaaataaaatacgctggggaaacgaattgtaatacacatgacaaagcttaatattagtatccttctatgaaggatccctcagtatccttatataaagatcctttatggctctaatatgcttcagttgattttgttccttgtaggcaaaagtttcaataaatatactgttttctctccattatcaaggatatatggattaatattaatatataaatatataaatccattatatagtaatatatattaacatatacttcctttattaatatcctggatatatgaaattaatatcttggatatatgaaaaggtattccagatcaataagatgaacacagtagtagaaaaatagagaacatgaacaagagtgtaaaaaggtgcgaagtgttcaaccccaaagatatgctaatcaaaatttaaaaattaaatctatacaatacaatttaaaaaataacattacccattgttagagggggtgtggaggagtgggtattgtcatgtgccactgggtcaaacattgtgtagggcaaattaacaatatcagatcctcacattttctgtacatttgaccttgaccttatcccaggcaaatacttgatggtatagtgaaggatatctttctcagcattacatatataatcaaaaataagaggtgacttaagtgcttcaagggaatttattaaaatggattattgatcagtcattaaaaatgaaagcatacaagactattaaatggtacagaatttctatcagaataagtgggaaaaacaagttacaagtaatatcatatgatttacttttagtgaaacttacatgcacttacacatttgtgtattatgtttatgtgtcatgcatacatataaaagtggaaggcggttcaacaaagtgctaattatcctcatgatttttattttttctttgatttttatgaacttacagtaaagaacaaagtactactttgaaggaagaaaaattattttttaataattcagcataaattacataggttatccaaagatagtaatatggtatttgatctgaacctagacttctgttctgttgatttgacacattttggtgtctttccttttatgttaaataagtaactatcatttacctacagcagaagaagaatataacttagcatttgagacttgataacatagagctgttgaatagttctgtaagatttgttagggaaccaaaaccaggcatgtgaggatggtgctggaagagaaaaggcgggaagggtttgcagtcaactgtcagttatcttcagctttcaggctcgctgcacatggacaggtgaggaccaagggaagaagagcaagcttgggtatttggttgagctgttaagttcagggttagaaaatgaccagcacaaaccttttggcttgagagccaaagttcttggcaggaagtctctgcttgtttccgtttgccttcctcccagtttctcctcaatgccttgcagtcagcatcctgtatctgccattttgaaaactgcccttaggggtcatgagtgacccccttccttattgttaaacccagtgacattttgtccttatctgcagcatttgatgtgttactcaactctctttgggcttgtgtgcctctccacccttgtggttattctcctgcctctgtaaccactcagtgtcttcttccatgtcccttgacccttcactgtgtcttctactgattccccttagaactttcatttacccctggagcttcaaccatcatcttcaggtaaaactctagcaacaagtcatctttgcccgctgtgcatcatccttgctgccattgagagtttggtcttaaaatggtacttgcaattagaacacgttcactttgtcacaaaatctgacagacattggacatacttagaattcatatctggcttcctgagacagctgtcagattgtctaccaatggtctacccattgatgatggaacaagctccttgtatcagcctcaaataaaaatgatggaattaataaaagacgcttaccttaaggcacaaaggcctatgaatttcaaaaagcattgacagaaccgatccaaaaaatatgtagtttgtaaaaactctaatacaatccacactgaagtaaaaagcttaacttagaataatccaaatagtctttgtcagctggacagctaatcttggtgaacatggaagagtagacaataatgttaaggcattgtgtgagggttaaattgtttgcgaggtcggcattgctggggcttcggattcaaactgggccttgaaagagggggtaagaaaagtctatggggaactgatgggcacaaaggcagggtgtaagtgtttgttcttgggaaaatgatcagactaatctgattgaatagaagacgtttattggaaattaaaggaagataaagtagtgatagataatggaagaactgaaggtcaacaggggagtttatatgtgatggaagagaaaatcattatcactagggatgtagatgtaagaaaacgttaggtttggaagttataagacaagagaacttcaaagtttgtgggattctgtaaggtgggatgggaataagcaatattgttgagtacctgctgtgtgatctgtaaggcataagatgtcattattattttacagcaagctttggagtagatgtactagttcccattttatgcatagtgagatggaattttgagcagacatacttgtctaagtttggcagagtggctggaccaggattcatgcccagtgacatctgacttcaaagcacagtgaggatggagaatgttgagaccagttcttcattttacagtcaaggggatgggcccaggcctattcaaggttacaggaataggatgaaagcaatttctctgtaagagagagtggataggctgtgatctgcagagggtccaagttagaggctcttgttataaacagatgaggtatgccaaggaagttgggttcagcagtgtgataggagtgaaaaagaaggggtagagagcagctggacattcggggaaagtggtggtgactgttagtggaaggtaatgacgagagagatgacttgaaaacagttccgaggttttagtcccagggaactgccattaacagttttaggagaaaagccatgtgtgtgttatggagtggtctgagtaagtatgatagacattaaaaaatacataaaaatagagtggtatgcatgtgctgaattatgtttgtactaccaaacacacggaggaggagaacagaacagaaggtggaaagctatgagggatccagcgcttttctttgcagtggtggagagtcacgagagcaaatagctagcctttacctaaagcaaaagggactctttgcatgatatcttaggctcccttttattctggcctgcccctgcacccccagcaggaaagtggcttaactgtactttgatttccaaaatgcgtagcagtctctagtattgattcccctctcctgcagatctcaagcctaaaaatgagtattgttccattacatttccctcaaaaacatttctttttcctttcagaatgatggtcactatactggatggacttctgaactagtgaattactttcatcttttgatcacactaggaaattgtccacggagttgaaatatttattgcagtaatttctggccttacataattaagataacatatcgtttttttctttataactatcatgaagttgtcatgtttgtttcctttaactttgctttttagaggtacgaatctgttccctagtcttttatgctccaatgatctgttcagactgctcttgatctacaaatgtatgattgagaaaagacttttataggatgaaatatgagcaagctgttttactctgaagaataaaagtgaattgtattactctgcagattaagtcaataaataccccattttcataaacacaatatgcacagactagataatactagggaaacttgatacatcaaaaggagtattaagactgaaaaaaatggagatactcaatttattgcaggctttattcaataaacctagaaaatagagagtttaaatcaaaatctgttactctgtttctagagataatcaatgttaaaattgtactatattattttccaagtttttagaatatgtgcatgtgttgttgtgttagctttctctatttttgcaacttgagtaacatttattacatgcttgtgctgtgccaagctaaataccaagcattttatatatattaatttattctcataacccttggtacttttattatcctcatttacacacaggacaattgaagctcagagaaattagccaggcacagtggctcactcctgtaatgccagcactttaggaggccaaggcaggcagatcacttgaggtcagaagtttgagaccagcctggccaacatggcgaaaccccgtctctaataaaaatacaaaaattagctgggcgtggtggcacatgcctgtaatcccagctactagagaggctgaggcaggagaattgcttgaacctgggaggcagaggttgcattgtgctgagattgcaccattgcactctagcctgggtgacagagctagacttggtctcaagaaaaaaaaaaagaaagaaagaaagaaatgacttgcccatgttcacatagctggtaaacccacactggttcagaacttaaaccagtgagataccaaagcccatatcagtgggcttttttacatacttcttttccttaataaaatgcttatttcttttttctacagcatcattttaaatgacagcatagtattcagttatatggaaatgtaatggtttctctatcccatctccttttattagacatttatattgtttcttgttatttacttttagaaataacattgcagtgaacatctgtcatgcacatctatgattatttccttaggataaattgccagaagtggcattgctgaacaatgatagaatgtagcactcaggtgttgatgtattctgttaatttactctgttgatgtactgttttctcgaaaggccacaccagtttataatctcagtagcagtatattgaagtacctggtaactttcagctctcagcaacattggtagttagcaatttgaaaaaaaaaagtgtttgtttttaaaaaacattctaggtattcctttttaagtccatattatctcttgcctctaatgctgtagtagtcatgatctccttactggtttatttctatctagcacccactttgccactaacagaatcggatagggcacggactgtagagttagatgcctgggttcaaatcatgactgtgctgtgcctcaatttccccgtaagtaaaatgaaaatagtaataaaagccctctggtaaagtactttagaacagtgcctgacttttggtatgtgttcagtaattgttggcctactagtattgtcttccagaagtccctgcttatatgattaaaaaaacccaaggttatacttgtttttgaattgtaattattaccaaatcagtaaatcacagtagaaactaaagtgctgaccttgaagcattgttagtgttaacactgtgaccaacctgaagatcacaaattaccttccgtgactcagttgatgctgagaggtcagggatagagtaataacaggaataactagaatgttaaagtgctttatattaagctgccagtgcacttccacacacattatctcattcgatcctcacaacacagctgtgaaggagatggagcgggtattattaatctcatcttacagaggaggaaattgacttggaggattaagtggcttgctcactgatggttgtggaaatggtcagtggcagagctgaatgtgtactctgggccttctgactgtaaatacttactcttgatgcttcataacatcatgataagctaaggaggtgcaggtgtagatgcccaggtctggagatttgctggaaaagaaggagcaaaagaggatgccactgggaggagggagcagagttggggtaaggaaacttagatatactaaaagagagggaggtacccagcggggagagaggtggggaaggagtcataaagaaagggaaaaacagggggccaggacttccgtgactacagggctggctgaatagatcagggtggagggcttcatctttgagactgaaggaatgcgtcccctgagccaggaaggagggaggagatggagcaagtagacacaggtgatttgaaatagaaaggaacattaagagggctgaaggattgtggcctgaatgaagaaagaaggaagtatttatttctggagagtaaaagtggtaggtttggggttttagatttgagaaagggaaaccatttagagtatctgtgtgggaaatgggccaaggaattagaaatgcctgccagagacctctgcaggatgcaggaaggacccagataaaaacgtctgggctccaagtcgacagattctgtgaaccccttaggcatgctgaggatttccttgccagatgatgtaactatctgaggatgtttctttgtgagctcagtgctagacaggcacaggagcagtattaggatggaaacatttcttaattgcttgaggagtgaggaaaaaaacggcactctgcaataaccctcttgtttccaaataccaaagcagctgttgggctgtgctcctgtctaggtaccttttcctcaggagttaagtgccacatgatgatatttatggttgctttttagggggtacatggttttttaattagtgaagaccgagtagcaatagttttgttttgtgttctaatagcctttgttattatagtcagggaggtgaagtgaggagatgatagatgctttcctaatctgtgaaatgaggagttggactaggcaggtgctccccaaagtccctttctaacattaccattttctcatccaactccagtctacgctgcctcctctccatttcctcctttaccagacagtttagtgtgtctcaagttatattttatggtgctttagatatatatatgtatatttttgcttagagacttcatgcattattattagagacttcatgcagtatgtagtgactgtagaaaaatgaaagatgtatcgataaataaaagacctgttaaaaatatgtaactttaccaccattaaataaccactgtttatattcttccggagatttttttttttaggtgtgtatgcctaaataagattcttaaatacagaaatgcaccctgcttttctcagttgaaaattataaacctctctgcttatcagtagtcactgctgtgtaattattaaaggttgatgaagactctgtttcaggaatgtattttaacaaatctcactttggacatatgcattaatgtacattcttctaactgtatttgtgaggctgctctgaattattttcttataaaattaggaaagaggtttaatatataatacacattgcctggaagactgaaccgatttacagttccatcaccagtatgcgagaggtctcttttcccacacccttaacattggatagtggagtttaaaacaaacaaacaaaaaaaccttaccagttttatagacagatgaacatcttttcatatgccatttatattcctttgtgagttttctgttcatatcctttgcccatttctccagaggggtatttgctatttttgttactgacttgcagcaacgagattttaaagatttaaaatttttaaatgtcttttattataaaagtatgttagttgttttgataatttctttgaatttttatactgcttttaaatgtatataaatatttaattttaggttgtcaaatctttttctttatggtttccatataggctaactaggaagtaagaatgccttggtatttgttgcccattgtcagttctttacatagcagagtaatctctttcaagtgtgatcacatcttggcatacccctgcctgagctcgtcatggcattcttgttatcatggcctgcagggcctggcacgatcttgcttttcctgctgtaaagccccacctcttgtcactcacccttgaacactatgttccagccccactggtctcttctcagtccagggaatatgccaacctccttcctgtccctgaaattctgcaggtgcagtttctttgcttgggaaatgtgtgcacacgcgcacacacacacactcttttgagcacttgtcaatatgcaattatttatttatttttgagatgcagtctcgcctaggctggagttctgtggtgcgatcttggctcactctgcaacctctgcctcctgggttcaagtgattctcctgcctcagcctagcaagtagctgggattacaggtgcccactacgacgcccagctaatttttgtatttttagtagagtcggggtttcaccgtgttagccaggctgatctcaaactcctgacctcaggtgatccacccacctcagcctctgaaaatgctgggattacaggagtgagccactgtgcccagccacaattatcatttcttattaacttactcttttcctgtttccccctccagcctgtaacaccataggggcagggaccttgtctgtgttgaccacagcgaggtctctagtgcttaacatgtggtatttgtaggagatcggtcagggtggtggaagaaattgtaggaaaagatgcaaaccttcttggaagaggttttgcaaaagcttcaaaaaagggtttggctgaaggcagccaaattctcttacctggagcctgagagcaaaggttagataataaggggatgtaaaggaattgatctagataagttagtttacttaggcctcagaacctggcctttaatcatctgtgcgcaggactgctctttcccagggagcagcgggaagccgggggagggggaaccatgttaattacccacaagtgtgttgactcaaagactttgtcattacatccatactgaataaatgcccgcagcactggcttgtcagggccacagctgctatgactctttctttctgtgagcaccccgatcccctagtccgctctttcactggatacctgtgtctaagtacgttttttcatccatcgctcagccagaatctgccggtcagacctggcaagtatttatagaagaaatgaatcaatattacatctctaaccacaagattgcacaggcatttaactatatttaccttattgtagttttatggtttcatctcacattttaaaatattttatctgtatgaaacttagtttgaaatgtgacttgagataggaattaaaattaatttctttcccaaatgaatagccacctgcaatttttgtagttcttgtttattagagagtccttactcaaagtatagtccttaagcactattatattgttttttctttcttctgtttgcttttctctccttgggtagtcctttgtgcaaaacgtaaatgcagaaactgctcattgacttgagccaaattgctcatgagcatgctggttcaataccaagaaagatgatcttggcgtcacccaccatagcctaccttctaagaagaaagaagacatcatgtgactgacttagggagttgtactatttgttcaatatctaatgctagtagacaatcttgttttagataattctggccgccagtttttttaaactgttggaacctggaaatttgaacattccagtgactacctttcctaactgcctcttatctctagatgtggaataaaaatcctttggcagaccatgtgttccagtttttggtttggaaaatatggattattattcttttccttattttaactctgaaaattaaaattaatgacaaaagtcagatgtgcccattctcacatattcaaacaataaaacatacagacaaaaaaaggattcttgtatcccactttttgatcctattcctaatataaccactgctgagtttattgtatatactttcagacattttttatgcttagtggatatattagatctttatacattccccccccccatatacttgcatttttttttttgactaatgtcataaactttgttatacacctcagtgggatttaaaaacacctgaagcctttgttttttggctggtggcaaaaaaaccagagtaacttagagaagttacccattgatgttttcacagggctttaaacacgaagacctgatttgtttgtgtaaatcgttggatgtaatcttacagaggaccagggcttgagcaccttcagaaacatggtatcatctgatcatgatgatttccatcccacgacagaggaagaaatggagactccaaagggacagaagtgaattcttccaaatttatgaaaatgaacacttagctaaaatgtgttcactgggttatgacaagtaactggacttctagggaatgggatggcaggtggggtgctatcagtttataaaattttttgtaaccttgtctcttatttctgcttccctcccccagccatgggaacacaagataaatttggagtaggtgagggtggagagcaaagtgactccctgggctgtgcccttcacactggttttagaaagcatgcagctgactgccctggggtctgatctatggtgctgcgctcgagagaactgtaaggtctgctgtaagtgatgggggctgtggacttatgcagaagtgcacttgttgggggttttcacagtacccaccttattatactagagaggcaggtttcattgcttaaggggacaatttatggcaataggcttatctccttgttttagctctttatgtttttctgcctttaataaaatgtgaagtcacaaagcaattaaatagtagtgtagttttcaggcaggaggtggagaaaggctaactagggggaaaaggccaacatgattgacagaggctggctggagatttacattgagaataactcgttcttcaaaactttcttcattttctggtgagaattagggacaaatcatataccagaaggatggatgattaaaaatgtaggagttatgatttctttttgactttgtaagtctctaaatcctccaccttaacatagagttctcatttcaaaatgggaaccagccctgccagagactaaagtgagccagaaatactctaaagtcttaaatagttaataagtgtgagattgtttatattttgtaaaatgtcttaagatacaatgaaatggagaatc

SEQ ID NO: 76 - DNA, 17767 bp, Homo sapiens
acctctctgcttatcagtagtcactgctgtgtaattattaaaggttgatgaagactctgtttcaggaatgtattttaacaaatctcactttggacatatgcattaatgtacattcttctaactgtatttgtgaggctgctctgaattattttcttataaaattaggaaagaggtttaatatataatacacattgcctggaagactgaaccgatttacagttccatcaccagtatgcgagaggtctcttttcccacacccttaacattggatagtggagtttaaaacaaacaaacaaaaaaaccttaccagttttatagacagatgaacatcttttcatatgccatttatattcctttgtgagttttctgttcatatcctttgcccatttctccagaggggtatttgctatttttgttactgacttgcagcaacgagattttaaagatttaaaatttttaaatgtcttttattataaaagtatgttagttgttttgataatttctttgaatttttatactgcttttaaatgtatataaatatttaattttaggttgtcaaatctttttctttatggtttccatataggctaactaggaagtaagaatgccttggtatttgttgcccattgtcagttctttacatagcagagtaatctctttcaagtgtgatcacatcttggcatacccctgcctgagctcgtcatggcattcttgttatcatggcctgcagggcctggcacgatcttgcttttcctgctgtaaagccccacctcttgtcactcacccttgaacactatgttccagccccactggtctcttctcagtccagggaatatgccaacctccttcctgtccctgaaattctgcaggtgcagtttctttgcttgggaaatgtgtgcacacgcgcacacacacacactcttttgagcacttgtcaatatgcaattatttatttatttttgagatgcagtctcgcctaggctggagttctgtggtgcgatcttggctcactctgcaacctctgcctcctgggttcaagtgattctcctgcctcagcctagcaagtagctgggattacaggtgcccactacgacgcccagctaatttttgtatttttagtagagtcggggtttcaccgtgttagccaggctgatctcaaactcctgacctcaggtgatccacccacctcagcctctgaaaatgctgggattacaggagtgagccactgtgcccagccacaattatcatttcttattaacttactcttttcctgtttccccctccagcctgtaacaccataggggcagggaccttgtctgtgttgaccacagcgaggtctctagtgcttaacatgtggtatttgtaggagatcggtcagggtggtggaagaaattgtaggaaaagatgcaaaccttcttggaagaggttttgcaaaagcttcaaaaaagggtttggctgaaggcagccaaattctcttacctggagcctgagagcaaaggttagataataaggggatgtaaaggaattgatctagataagttagtttacttaggcctcagaacctggcctttaatcatctgtgcgcaggactgctctttcccagggagcagcgggaagccgggggagggggaaccatgttaattacccacaagtgtgttgactcaaagactttgtcattacatccatactgaataaatgcccgcagcactggcttgtcagggccacagctgctatgactctttctttctgtgagcaccccgatcccctagtccgctctttcactggatacctgtgtctaagtacgttttttcatccatcgctcagccagaatctgccggtcagacctggcaagtatttatagaagaaatgaatcaatattacatctctaaccacaagattgcacaggcatttaactatatttaccttattgtagttttatggtttcatctcacattttaaaatattttatctgtatgaaacttagtttgaaatgtgacttgagataggaattaaaattaatttctttcccaaatgaatagccacctgcaatttttgtagttcttgtttattagagagtccttactcaaagtatagtccttaagcactattatattgttttttctttcttctgtttgcttttctctccttgggtagtcctttgtgcaaaacgtaaatgcagaaactgctcattgacttgagccaaattgctcatgagcatgctggttcaataccaagaaagatgatcttggcgtcacccaccatagcctaccttctaagaagaaagaagacatcatgtgactgacttagggagttgtactatttgttcaatatctaatgctagtagacaatcttgttttagataattctggccgccagtttttttaaactgttggaacctggaaatttgaacattccagtgactacctttcctaactgcctcttatctctagatgtggaataaaaatcctttggcagaccatgtgttccagtttttggtttggaaaatatggattattattcttttccttattttaactctgaaaattaaaattaatgacaaaagtcagatgtgcccattctcacatattcaaacaataaaacatacagacaaaaaaaggattcttgtatcccactttttgatcctattcctaatataaccactgctgagtttattgtatatactttcagacattttttatgcttagtggatatattagatctttatacattccccccccccatatacttgcatttttttttttgactaatgtcataaactttgttatacacctcagtgggatttaaaaacacctgaagcctttgttttttggctggtggcaaaaaaaccagagtaacttagagaagttacccattgatgttttcacagggctttaaacacgaagacctgatttgtttgtgtaaatcgttggatgtaatcttacagaggaccagggcttgagcaccttcagaaacatggtatcatctgatcatgatgatttccatcccacgacagaggaagaaatggagactccaaagggacagaagtgaattcttccaaatttatgaaaatgaacacttagctaaaatgtgttcactgggttatgacaagtaactggacttctagggaatgggatggcaggtggggtgctatcagtttataaaattttttgtaaccttgtctcttatttctgcttccctcccccagccatgggaacacaagataaatttggagtaggtgagggtggagagcaaagtgactccctgggctgtgcccttcacactggttttagaaagcatgcagctgactgccctggggtctgatctatggtgctgcgctcgagagaactgtaaggtctgctgtaagtgatgggggctgtggacttatgcagaagtgcacttgttgggggttttcacagtacccaccttattatactagagaggcaggtttcattgcttaaggggacaatttatggcaataggcttatctccttgttttagctctttatgtttttctgcctttaataaaatgtgaagtcacaaagcaattaaatagtagtgtagttttcaggcaggaggtggagaaaggctaactagggggaaaaggccaacatgattgacagaggctggctggagatttacattgagaataactcgttcttcaaaactttcttcattttctggtgagaattagggacaaatcatataccagaaggatggatgattaaaaatgtaggagttatgatttctttttgactttgtaagtctctaaatcctccaccttaacatagagttctcatttcaaaatgggaaccagccctgccagagactaaagtgagccagaaatactctaaagtcttaaatagttaataagtgtgagattgtttatattttgtaaaatgtcttaagatacaatgaaatggagaatccctgagtgtttttttgatttcctaaactctgatccacaattatagatgtgtctgaaggttcaaaaatattgaacgtgatttcagttgtttctagaatttaaaaaaattaataatttttaataatgacactttaaatgaggagaaggcttttaaaaccaaatataaaaatctggagagttcagattccctgtctctcctctttcaacctttaatgtataaaacaaatccttttgattcagccactgtgtattgataatggcttatttattacaatcagaggaattaaacaaagatatgtagatactttgtcatcttttcttattatagaaacagtttgattttaagaatttttattcagaacgcagattcgaaaagaaaaaaaagaatttttagaaaagttgccttttaatttaaatttcttgttttgtcctaataatcacattgaaatagccaaaacaaataatataaattaaaatgcaacgatggcccggcatggtggcacatgactgtagtcccagctactcaggaagctaaggccagcagattgcttgagcccaggagttcaagaccagttggggcaacatggtgagaccctgtctctacttttaaaatgtggtgattggtacctgttgagagaagggttaactgaaagttattcacatggcccagaaagtggctgaaaagtgctctttctggtgtgaatttctcttgctgtgaaagcactctgaaggggagacctaatgccattgcaggagcacttcagctccaaacttgagcgttgcaatcagaacaagaacccgaggaaaagcctgcaaaatgagcctgctgcgatatagggtgtgcttttggacagttatacataagaatttttttcttttttcttttttcttttgtttgagacagtgtctcactctgttgcccaggctagagagcagtggcgtgatcattgcttactgaagcctcaaattcctgggctcaagcagtcctcccacctcagtctcctgagtagctgggactgcaggaatgcaccaccacatctggctaatttattttttgtagaggtgaagtcttgctttgttgcccaggttggtctcaaactcctggactcaggtgatcctcctgcatggacctcccaaagtgctgggattataggcatgagccactgtgcccagcctcatgagaagatttatgatgatagatagaagaattattaatttccacagtttgacaaatgataacaaatagcttttacagtttgagcatcccctatcccaaacgcttgggactagaagtatttcggactttggacttttttgaatttgggaatatttgcatatacataatgaaattccttggggatgagacacaagtctaaataacaagttcgtttatgtttcatatacaccttatatacaaagactgaaggtaactttatacaatatttttaataattttgtgcatgaaataaagttttgaccgcattttggctgtaacctgtcacatgaggtcaggtgtgaaatttccacttttggtgtcatgtcagcattcaaaaagtgttggattttggagcatttctatttcagatttttggattaaggacgttcaacttgtatgccaaattagtaaatattttttgagttcctacccacatccctgtgtatgggctctagaagcagccatggtttagtttcctcacctgtaagggagggtgtagaacttcttttaatgtacatcactgtaggttaagttcgggtagagaaaagactaaaggcaaccaaggctggctgtcctctgagcccctatgctaagctgaactaggcttttgtttctggcaatggatcattttgctgtcacggagccagtgattatttaccacccctggttttgagtaggtttccttttcccctggcaatagctcttagagtgtttcacagagaggcaacgggattcagaagatgcccgtttacactggtaccactgtctcgttatgtcatggtaaagtaatgaagtccaccatcattactttaccagttccccattggtgttttggtcttccctatacattttttttaacttttatttatttttaatgagatgaaattcacataatataacaataggcagtttaataattgacaattcagatgtatttagtacattcataatattgtgtagctgccacctctctctagttccaaaacatttttgtcactacaaaagaaaaccccgtacccagtaatcagtaacacactattctctcctctctctcatccctgacaatcattaatctgctttcagtctctatgaatttacaattctagataccacatgtaaaataaatgttctcatacaatatgtgaccttttgtgtctggcttctttcacttagtatattcatccatgttgtaatgtcttagccattttatggctgaatagtccatggtacggatatatcataatttgtttatccattcatctgttgatagatttttgattttttccccaccttttaattcttatgaataaggctgctatgaacatgggtgtgtaagtacttgagtccctgttttcagttcttttaggttcatacttagaggtgtaattgctgggttatatggcaagtctgtgtaacctttttgcaaaactgttttccacagggccaaaccatttctagtcccaccaacaatgtacaaggttccaatttttccatatccttgcaaacatttattttccctttttaaaaaaattatagtcgtccttgtgggtataaagtagtattttattatggttttgatttatattttcctaatgattaatggtatttatctttccatgtacacattggccatttgtatatcttctttggagacatgtctgttgaagtcctttgcccatttaaaaattgttatttgttgttgacttgtaagagtgctttatatattctggatactagacccttaatagatatgtgatttgcacatagtttttctcatttttaaggttttctttttttttaatttttatttatttttttttagacagagtcttgctctgttgcccaggctggagtacagtggcaagatcttggctcactgcaacctctgtctcctgggttcaagtgattctcctgcctcagcctcctgggtagctgggattacaggcatgcatcaccacgcctggctaatttttttgtatttttagtagagatggggtttcaccgtgttggccaggctatcttgaactcttgacctcaggtgatccacccgcctcagcctcccaaaatgctgggattacaggtgtgagccaccacccctggcctccctatgttttcttctaagaagttatgcttttattttttatacttaggttgttaattcattttgagttaatttttcatatggtatggggtaggggcccaactttattcttttgtatgtagatatctagttttcccagcaccacttgctgaagagacagtatttccccatttgaatggtctttgtacccttgttaaaaatctattggccatatatgtgagattttatttctggactcttttttctattggtccatatatttatccctatactagtactacaccgtttttgattactgtagctttgtagtaagttttgaaattgagaagtgagagttcttcaacttttttcttttttttagtgttgttttggctatttggatccctttcagcttcatacgaatttaaggatctgttttttcatttctgcaaaaagggctgttggagttttgataaggagtacattgaatctgcagattatttggagtaatattgtcatcttaacaatattaagacttccaatccatgaatataggatgtatttccatttatttaggtcttattcttcagcagtgtcttgtaatttccagtgtgtaagtcttttgcctcctgtgttaaatttgttcctaggtttttttgttttgttttgttggttttcttttttttttttttttttttttttttttttgagacagtctcattctgttgcccaggctggagtgcggtggcacgacctcggctcactgcaacctcctcctcctgggttcaagcgattctcatgcctcagcctcctgagtagctgagattacaggcgcacaccactacgcccagctaattttttgtatttttaatagagatagagtcttgacgtgttggccagactggtctcggactcctgacctcaggtgatccgccctcctccatctcccaaagtgctagaattacgggcatgagccaccatgcccggccatccctaggtattttattctttatatgcaattataaatataattgttttcttaatttactttatgaatgatttgtatttattattattatttttttttttttttgagacggagtttcgcttttgtcacccaggctggagtgcaatggtgcgatcttggctcaccacagcctccacctcccagggtcaagcaattctcctgcctcagcctcctgagtagctgggattacaggcacacaccaccatgcttgactaattttttattgttagtagagacggggtttttccatgttggtcaggctggtcttgaactcctgacctcaggtgatctgcccatcccagcctcccaaagtgctgggattatagttgtgagccaccacacccggcaagaaatattatttttattttttaaaaaataatctctagtggttattttaaaattcaaggtaagaaccccactattcctccaaatattctgtagagtggtctctgttaagtttgatatacatccttctacatgttttccatgcatttatatacaaacatactttcttactgtgaataaagtcatatactttgtctaaattttaacttactattttacataattatagattgtgtctttctctgctagtttacttatttctcttaaatgctgcagagtaacccatcatactgatatgctacgtagctgacccttgaacatcatgggtccacttatatgcaggtccacgtgcaggtctgcttttatgcagatattttcaacccaacatggattgaaaatagagtacttgagggatgcaaaacttgcataaagagagaattgacttttcatatacgcaggttcttcagggctggctacagaacttcagtatgtgaggatttgggtatttgcaggcagtcatggaaccagtcctccttgtatatcgagggatgactgtactttgtttaaggctttattttaatgatcatttagtgtggtgttggtgttttatagtataaataatgcaacagttaacaattttatacccacatcaacgtatgtccatgtaagtctttaaggtaataagaattgctgaggcaaaaaaaattaccttaaatttttttaaagttttgtgttaggcataacacataatttactatcttaactgtttttttaattgcacaattcagtaatgttgtttacattcacattattgcgcaaccagtctctaaaactctttttcatctttcaaaacaaaagcgctatatctgttatacaacaactccccacccccctcttcccctggcagccattctactttctgtctctgtaattttgactattctaggtacctcataagtggaatcacacgctgtctgtctttttgtggctggcttattttacccagtgtaatgtcctcaagggtcatctatgttgtaacatgtgtccaaatttcattcctttctaaggctgaataatattccattgtagcatcacattgagtaattaaatgcttggaaagaaagaagaaaaagaagggtatgtctgactcttttcattcccatacaatgtggtaacatacgtaataatctaaatagaatataaataaataaaatgaagtccttttaggtatgtgtatgagctatataaacaggtatttttaaatgcattgtggatccaacttcatattagtaggtgaggaaacaactagtagcacataaatgcttcttgggcttcttgcacacttgccctccatacacctcacctcatgcccaacataactttcattatccctccacccattgctggcagtcatttttaaatagctttggattttatgccaaaagatcttctacttgttgacagattctgtgaatacccagtgttcgcttcttttgcactttccaagaaagatgagtttgggaatttgctaacatgttctaaagttaaagctttttgttctgggataactgaaaagtttagttatccaaaaggcagcccaccttcatttttcaggagggtcactgtgatgttctgtctttctgagtctcatgtctcatacctttctgtgctctgtcataattaactaaagcagaaggagggagatccttttgtaaaatgcccaaagaaaagaaagccagatggaagtgaggagtaagagtaaccacagttgctttcctcttccatcagtctttaaaaactttttattttgaaataatgttagatttagagaaatgttgcaaaggtagtacggggctcccatacccttcactcagtttctcctaatgttgttatcttacataaccatattgaactatcgttaatataattatcaaaattgggaatctaaattggtctaatacttccagctaaacaacagaccttactagcattctatccagttttccgctatcctttctttatgttccatgatccaatccaagatccacattgtattgagtagttctgactctttaaactcccacagtttgtgacagttccttgtcattccctgtcagttatttctggttagttattttgtggaatgactagatttggggctgtctgatgtttcctagtgtttacctttaagttatgcttttttttgttttgaaagaagaccacaaaagcaatgatgtatcttttttattgcctcataactggttacttgatgtcagtttcccttattgctagtgctattcgtgtggactcatcatggacagttacttcattctgtgggttataacccaatattatcatcattattttcttcttcaaattattctagctttggccactgggagctccttcaggctgactctgatgtccttttgacatgcttccatcttttttcaagtacttcctcacattatggcatcccctgatgctctaggctaatcttgtattttccttgccctacttttggaatcagtcacttccctaaggagcctgggtccttttactggacaatggtgtttagaaaccaatatctgagtaccagacgtgcacattgcaactggggtggctttttgtcttccatgagttttatggtgagctctttcctgtgaacatggttgtaccaggtctgaaactcgtttttaacacttctaggtagtcagtcactttgatgtaaagtcattttgatcacttaatgttgagttgttaaaatcaatgcacataccctgtagaaaaataggttctttatcaatggaatagattaactttttgtggaaaaatacttttacattgataggatagcattagcatccagacatttttgacattccttcaataactattcctgagtttctgactctcatttttagcccattccatttttatttattttattttattttattttttgagacggagtctcgctctgttgccaggctggtgtgcagtggtgtggtcttggctcactgcaacctcccgctcctgggttcaagcgactctcctgcctcagcctcccaagtagctgggactacaggcatgcaccaccatgcccagctaatttttgtatttttagtagagatgtggtttcaccatgttggccaggatggtctcaatctcttgacctcatgatccgcctgcctcagcctcccaaagtgctgggattataggtgtgagctgttgcacccggcccccattccatattttaatgagaatatcttttggttagttatagaggtaaatacctggatttacaatgtgtaactacagattcatcatcctataataaagtaactctttttgcataaacttttgataagttatttttgtccttataattttatgtgtgaagtctttacggtcagaggacattgacaaaatattttagattgaaagcctgttctccttgatgattcagtataacttcttttgactgcgcttttagttcttgcaaaatagatcttgtttagatgagattccagcatgactcctttgtaatttttcatatttttgctattacatctcaactcttgaagagctatttctgtgaaaaccaaacatgcagtcaaggcacattccacgtgtggctgatggggttatcatagttacaaatcatatttatccacagtgataattatcttccttagcgttttgttctacttcagagctcatttgtgggccttaccacctgtttcttacatatggggaaagagtctcttattctcttttggaatatagatctaagagtagatttatatcaggatttgaaagatgaatctttttcaaggatgtttttcctctggaccgtggcattgtgtaagaaatttccctactcatcccatccctggggcacattaatttggagatgatgttaaatgtgtcagagtgtggcacaaatctcaactggcagataaagcctagtattgaattgttttcagttcagaaacgtggctggctgactttgaccctgaatgtgtaaattatctttgcagcaataagaacttgaagtagctttgatagctaatcatagtatgataactcagccagaagaattcactaagagcagtttgtgtgtcttccatctaatgtaaaggttagtaatgtaagtcatattcttggtgcctttagacctagttatgcagagagacatcacattgacattcagtaattcttactcttaacagttccttaactctaaaatcatctttttccttacctttccctagttctagaacagcaaaatattttacttagattctatcattaattaatatactcgtttgaatttttctcttctaaaaaatgtaggccaggcatggtggctttacacctgtaatcccaggactttgggaggtcgaggcgggcggatcacctgaggtctggagtccgagaccagtctggccaatgtggcgaaacccaccccgtctctactaaaaatacaaaaattagctgggtgtggtggtgtgcgccatagtcccagctactctggaggctgaggcaggagaatcacttgaacccgggaggcagaggttgcagtgagccaagatcacgtcactgtattccagcttgggtgacagagcaagactctgtctcaaaaaaaaaaaaaaaaaagtaaaattattttggccttaccatgcttggtttctttgtctttgttttttcattcactttatgtttggggaggagaatggagtgtcagtgatttcagcaaaaagttggggtaccagttcataataaattagtgtctaagattaatgttacagctgatattcaaagtaccaaatacgttattgttctgattattctggtccttaaatttgtctctttcctggagacgtggtaaacaataatgatgattctaataatgaccatttattgaatgagcactatgtgtcagacattgtactggtgatgtggtttggctgtgtgtccctacccaaatctcatctcaaattgtaatccccacgtgttgagggagggacctgatgggaggtgattggatcatgaggatggtttaccccatgctgtcctcctgatagcgagggagttctcatgagatctaatggtttaaaagtgtttggcagtttcacccttgcacccatgtctctctctgtctctcctgctgtcatgtgaagaagaggtccttgcctccccttggccttccaccgtgattataagtttcctggccgggtgcagtggctcacacctgtaatcccagcactttgagagaccaacgcgggcagatcacttgaggtcaggagttcaagaccagtctggccaacatggcgaaacctgtctctactgaaaaaacaaaaattagccgggcgggtggcgcacacctgtaatctcagctgttcgggaagctgaggcaggagaatcgattgaacctgacagatggaggttacagtgagccaagattgtgccactgcacttcagcctgtgtaacagagtgagactctctcaaaaaataatgataatagtaagtttcctaaggcttccccagccatgcagaactgtgagtcaattaaaccttttttcttcataaattgctcagtctcaggtagttctttatagcagtgtgaaaatggactaatgcaattgggcaatgtctgacagtttgcaaataccatctcatttgtttttaatagaaacctcctgctgagagtggtggctcacgcctgtaatcccagctctttgggaggccgaggcaggcagatcacatggtcaggagtttgagaccagcctgaccaacatgatgaaacctgtctctactaaaaatagaaaaattagctgggtgtggtggtacgcgcctgtaatcccagctacttaggagactgaggcaggagaatcacttgaacgtgggaggcagaggttgcagtgagcccagattgaaccactgcactccagcctgggcaacaaagtgagactccgtctcaaaaaaaaaaaaaaaaaaaatctaatactagccatgaggaaagataatcactctcagatagtaaagcatttgcttagccatatgttaagctctgaattcagatgaaggggcatctaaaacaggcagagagcatcaggaagggcttcctggaggagaaagtgcgtacactcagtctttaagagcacgtgggaggaaaaaccagtgaagtcctcctgctgtagacagaatgatcagcctgggcaaaggtgtagaggggtaagagagcgttaaacatgaggcagctgtgtaatattgtttcctgtaatctcttctgtacaggtggagaggtagcaagagacccaaatgatgaatggctgtgagtgccatgccatagcaaaattctgggttttaaaagagaataagcatgatcaggctggggatgttgaggaggggaaagaagggggatagagatggagaccacccagtggcccgctctccctcagtgctttggattatggggaaatgaacagagagccactgtgcccagattttattatgggttgagcagtgatcaagatgggagagagaaatggtaatgggactaactggcccatacaccagatggcatttgaggggaaggccgggtctgtgttgtcagggggccctgtgttctgactcccttcccattagaataggtggtgattaaacaagctatgccacaccctaaattctggttctgggttttactattcagtcagttttatcaaattaagatgatcatgtcttcccttctgaaaaattataggggaagaaaaaccatagaactttcccccagtatatagcattgaattacacatattcctacacacacacacacacacacacacacacacacacacacaccactcacacatatatacgtacatacatatataatagaatttttatataatatgtaaaattttaaaaatatatatttttagaagggctgggggtggtgggggcggtggctcacacctgaaatcccagcactttgggaggccgaggtgggcaaatcacctgaggtcaggaattcgagactagcctgactaacatggtgaaaccccgtctctactaaaaatacaaaattagccgggtgtggtggtgcatgcctgtaatctcagctactcaggaggttgagacaggagaatcacttgaacccaggaggtggaggttgcagtgagctgagatcccgccattgtactccagtctgggcaacaacagcaaaactctgtctcagaaaaaaaatatatgtgtgtgttttataaacctataaaatatgtgtgtgtgtgtgtgtatatatttatatatttatatatattacatatatatatatgtttagaaaataaaagatgcagtatgtcagtgctttcttatgacagttgcagctacaaaggaagattaaagctttttaaaaagtagaatttttatctgtttgtggagaggactgaaaccagtaagctcttgaaatgttttcatcctctcatcaaatatatatggacctgccatatgccaggtactgttcttactactgtggaaatagcagaaaggaaaaacaaagtccctgctctcagaaggtttagaatgagataaggcaggctactgagttggcttaaaaactaagaggaaactagtgaagtgtagttgcccgttcacatttttatttttttaagtattttatgcccacggaaaactgtgggactgggacttgaattctaattttatgttttcttgggttattctttaaaacagggtcttagactagtaattaatacagtgtcactctctttcaccttcctcaattcctttgcatgcttgttaggtcattcagagtggcactaaggtaaactttggcatatcaaaatccacttgaaagcagatggttagcaaggggcagtgacttatgcctgtaatcccagcattttgggaggccaaggcgggtggatcacttgaggtcagaagttcaagaccagcctggccaatatggtgagaacccgtctctactataaatacaaaaattagctggtgtggcgacgcacacctgtagtcccagctatttgggacggtgaggcaggagaatcgcttgaatccgggaagcagaggttgcagtgagccaagatcgtgccattgcactccagcctgggcgttacagcaagactccatctcaaaaaaaaaaaaaaaaaaaaaaaggagatggctatgcttgttaaacactgtttcagttgagtacctctcctgtgggcttgttggttcttgtgcagattcctgctcctgcccaagtccaggactagctgcacatacctgcacatgtgcctcacccagtccaggacggctagccttgttctcttcacccagcccagcagcagagtgctaggaaactttgctggcagggctgtaagaacctctgtagtttcttcccatttccttgttctcctaacttactatgctgggaggaaataatatggtgtggtaacgattttaggcaaagaaaaaaagcgccgaaatggatgtggtggtaaaattaggccaatcttttggaagcaccttagcaacctcctttcatgttcttggtacctttacctggttgtattgtaatgttcatttttccttgtgaacatctctctgtgtgtgtgtatgtgtataatttatctagtaccatggaatctttgaaggaaagactaaaaaactttcagaattattattattattattattattttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgaaaactttcagaattataacaataagtttcatttgttgtatagcacattctacgtgaccatagaccaactctcctttatcaatatttgtgtattctcttaaagagctaaaagaaatcattttttaaaaattctttatatctaatgttggccaatgttacctataagaaa

SEQ ID NO: 77 - DNA, 3551 bp, Homo sapiens
agtgtagtgtggtgtgtcattagaagcatgatttgttcttaccaatgcagtgattacattggttcttctacattcagtagaatgctaataatgtggtaatgctagtcgccagtcttcttaatctctataacagaggaagcagaagtagagcagatcctatcctagccttgtaggtctagagaccgaactatagtgtcttctgggaaagcacttaaacaaaacacaggtttataaattgttatggtcactaatgtttcagtcaagatggtgactacctatgatttgtgtgtatgtgctacccttttgagaagcattaattagtccgttctctcactgctataaagaaatactggagactgggcaatttataaagaaaaggggtttaattggctcagggttccgcaggccaggaagcatggtggcttctggggaggcctcaggaaacttagaatcatggcagaaggcaaaggggaagcaggcacgttttacgtggccagagcaggaggaagagagaggagagaggtgctacacgcttttaaataaccagatctcacagtaattcactgactcactgtcaccagaacagcacccaggggatggtgctggcccattcatgagaactctgcccccatgatccaatcacctcccactaggccccaccttcaacactcgggattactgttcaacatgagacttgatggggacacagatctaaaccatatcaagcattaatattactattaacctgtgtgaaaaggaactgaattctgctgtgacattttttgtttaagaattaggcctagcaggtgtggtggctcacgcctgtaatcccagcacttcgggaggccgaggtgggcggattgcctgagctcaggagttcaagaccagcctgggcaacatggtgaaaccctctctctactaaaatacaaaagaatattagccaggaatggcggtgtgcacctgtagtcccagctactctggaggctcaggcaggagaattgtttgaacctgggaggcagaggttgcagtgagcggagatcacaccactgcactccagcctcagcaacggggcaagactccatctctacaaaaaaaaaaaaaaaaaaaagaattaggcttagggagtgcatggtggctcacgtctgtaatctcagcactttgggaagctgaggtgggcagatcgcttagggtcaggagttcaagatcagcctggccaacatggcaaaaccccgtctatacaaaactacaaaaattagcaagccatggtggtggacatctgtaatcccagctactgagaagtctgaggcaggagaattgcttgaacctgggaggtggaggttgtagtgatccaagatcataccactacactccaggctgtgtgacacaatgagactgtgtcttaaaaaaaaaaaaaaaaaaaaaaggccttaagataaaaaacagtgaaataaaagaagtcatatttttaagaaatgaaatccctaatgtttaaaaattatttaatgtataaaattatcaatttttatacattagggatttcatttttttaaatatgacttcaggctgggcgtggtggctcatgcctgtaatcccagcactttgtgaggccaaggtgggcggatcacctgagatcaggagttcgaaaccagcctggccaacgtggtgaaaccccatttctactaaaaatacggaaattagccgggtgtggtggtggcatgcacctgtaatcctgaccagccagctgagatcgtgccactgcacttcagcttgggcgacagagcaagactccatctcaaaaaatgtgtatattatatatatatgacttcatagacacacattggtctatacaacaaaaacaaagcattaggaaattatctcatgatttagccacaaaattaaaagatttatttcaacaaacacttattgaatgcttacccatttgactggatgatgcgtaggaataacaagaggtctgaggcatagtagtagacccatggagctgatagtttcagggcagggtagacatctaataaagtctttgtttccttttgtaagtttctctaagtttgtttaggatacctattttgacagccatacagatcttcagaaaatagggattatcaccagacaccacaaggaaataggtggaaaaatatttaaaaataaattgtaagccaagcatggtggcccatgcctgtaatctcagcatgtgatttgggaggccaaggctagaggatcacttgaggccaggagttcaagaccagtctgggcaacatagcaagacctatatctacctaaaaaaaaaatttaagaaaatttaaaataagtaaataaattgtagtaaaaatgtaggttatgtttcttcgtctgaaaataagctattctgaaaagctaagctttcccaatggtacatgagttctctctctaattatatcttctgtattcctctctcacttgaataattttcttttgaaaactttctgaagttatatgctttcagactttgtaaaataatatgttgaacatgattaatcatctctcagttaggttcattattttcaatcatattattgtattgtgctgtgataacaatgtccctagaaactggacagtttatagagcagttcgcctgatcatttttgttttttaagtatctttttttttttttttaaagacagtctctctctgtcacccaggctggagtgcagtggcacgatctcagctcactgcaatctccgcctcccgggttaaagcaattcttggtctcagtctcccaagcagctgggatgggactacaggtgcatgccaccacgcctggctaatttttttttgtatttttagtagagacagggtttcaccatgttggccaggctgctctcaaactcctgacctgaagtaatccacccgcctcagcctcccaaagtattgggattaccggcgtgagctactatgcacaccccttaaacatcattgtaaaaatcacttcccttgctataggaatttggctttgagttactaggccttccagaagccatccccatgactttgttatctggcctaagccataggtggggagtggggagggagacatccaaagttaattagaaccaagtataaatttgccatggatttaagccttctgtataagataaattcatccatagtatttttggattactttatttacttgattatttatttacttatttgattatttctgttctcattaattttctaattatgactagacaactaagttctgggtaagatatgtcattattacgtaatgatgtcttattcttggcattataaatgactatactgtgttgtagttttattatatttatgacatatgagaaataaataataggaactttaagaagactctatcacttcatatctctttggtctctttctctgtctttaacattggtcaggttccaaactagtgaaaactacagaaacaagtgcagttttctagtatagtctttcatcttacgaaaatatatttaatccccactcttttttaagtttcactttgccttaagggg

SEQ ID NO: 78 - DNA, 9360 bp, Homo sapiens
aatagaaaccgaaactttttaatggaatgcaggaaaatcttaaaatggacgctagagccctttgataattattataattttatgacagcaatgttaagaataatggtgttaacaaaacttttatattttgaatgtgtttgtgtatttgaatgtatttggctacaaacagccataatgtaactagcactcattgaacacttgctatgtgctgggtaggcatgggattaggcacttccatacctaattttgttcgatcatcagagcaactctaagagagtaggtactattaatattgccatgttaatttataggggcagtgaggcttaaggaaggctaagtgatttacgtaaagactcatagccagtgattagtaggtagagtttggattcacacctgggactttctgactacgagaggcgaggctcttgagcactatgctatgtcaatgtttttaattttataagaaaatgaactttgtttctcttattataaaatgtttttctatggataaaataaactagttcatcttacctgaaaaataattccttgtaagatattgagttcttcctaaaaaaagaattaagtattgccatttctaaattgatctacttgtgagagtaattgcgataataaatatgttaaagattttaaaagaaaaattctgtattatatgaagtttgtaccatttgttattataaaagaggaaaaatatatttttctctacccatcttagggtcaaggctgaggtcactataacaagagacagatttaacaggagaaaggcatacacatttatttaatataaatttttttgagacggagttttgctcttgtcgcccaggctggagtgcaatggcatgatctcagctcactgcaaccactgcctcctgggttcaagcagctctcctgtctcagcctcccaggtagctgggattacaggcgcccaccaccacacccacctaatttttgtatttttggtagagacagggtttcaccatgttggccaagctggtcttgaactcctgacctcaggtaatccacctgccttggcctcccaaagtgttgggattataggcgtgagccactgtacccggcctatttaatataaattttatgtgacataggtgccttcataaggaagtgaagaacccaagaaacaggtaaacttggatatttttatgctaggtttgatgaagagtggaaagttgtagagaaatatgataggacaaagagtgtggtccagtggtaataagctagagagaacttagcaaggcctgcttgttcagattcttctctgtgatcctttagcttcagagatcaggtatagggagggcaccccttacgtgatggtcttatgacctgcattggggtaaggggtaaggggagggtcagagtgaccttcctgtgtttgatttgagggtagcgtgtcctgaccccctcattattttcatattgcttattcttttactctctgattagagtaaatttctaagaatagggctctagggaatagtcctagtgatttttcttatatcaggggtgtccaagggagttcttagtttctgtttcaggttgtgccagtaaagccccctccctcatccctcttttctgcttatcagtagagacagaaactaaaaaccatggcttcaggctgctaaaagcctaaaacaaaacataacaaaacagaacaacaacaacaaaataaggcaggttggatgagcttgtcttacatcatacccgtcttgaaatatttgaattattttactaaattaatttctttaatttatataataccttttctctgatgactcaaaattcacatacccagaactttcacacaataggtaaacttctgttaattgccagtgggttattttttgttctgggaggtttttataaagcacatagccacttcttttttaattaatagaagtagattttgccattgagaaacaaattcgtatttctgggctttgtcaaccactatcagctgtgaatttacttttctaaatgcacaaatgagtctttcttattacttttattttccattttaggctgttatccagaagttcctctatctaggtaggtagatgcatgtctctatgctaaatattaaatagaacctttccctgtctttttcttgggtatggctctatgtatttatcctaccatatattaaactctgtggatgataatttgctttgattcattatttttttaacagtctgaagcatcaagcccattggtggcacattatttaaaggttctatttgaaatgcacatgactccctctagtcataaattctaagctgaggaatggaaggccaaaggtgaagagatcttcatgttcaaccctcttgtactcattcggtatctgacatactgccctgccatgtttttgtgacaaatgtatagtagagtctcaccacacgtgctggtgatgtactcacattcaattccattcactgagagagagagaaacagtaatgcagaatattctacactgcctcccattctgttcagtgagcccaggactgagtgaactcaagatggaaagatgcatgtgttacttcttgtggagctgattctggagcgtaaagagtagtatttctttctcagtgggggcaaaatgtaaaccaaccacttcagctgagaaaggacagctatagggggttgattcaactttatgtgatttctgcctctggtgcagaattcagaccctaatcatcaaattagctatggcattttctactagtcatatcttcctgttcagattataaacaatctgagggttgggggaaagcagcttttagtatttcctctcctagaagtatctttaaaaaaaatctctcccaatggcaaggaagatacttattgacacaaaaggattttatacatgattccttgatttttctttcaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaattttttttttttggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgttattttttgttgtgagttctctctgtttggttttgttgtgaattctatcaatctgctggaagaggaattgattttacaatgtttttcttcttttagcatgaatttaaaaaaatagaatagaatactcagctgtgagccaacatgtatctaacatcctataatagtcactatacatagcttttaaaaattaagctcgaatgttcagccttttagaagcagattgctattgcttttgatttcagcatagtgtatattttatatattttaagacattacccagagtgagtaatgcactctatatgaagaatcagttcacacagacatatgtgcatgtgtatttaaaacaaaagtttcacagaaaaatactttctctatttgtgatgccctgggctattttctatactattttagtctatgtcattttattttattctctacttttttatggtgctgatgattccccagttggtttcttgagcttctaaggaatcacctgcaattcagaagcaatattccagtatcttttgatctatgtttgaatctaagtttggccattgccttgctgggtggcagatatgttactttaagtgtccatttctaactctgtgatatggagataatatgagtgcctgccttacagtcatgaagattaaataaaaggatacatagacagcacttaagctagcagctggaacacagtgagtgctcactatctggtagctattatcctaaaaattaatatagaccaaataaaaatagaaataattttataaatatttttatcagtatatattttagaatctaaatcaagtgatattacggatcctcctttacacagaaacactttgcatctgatttttcaacagtattatatattctttttttatttgtaatatgaaacataaagacagtagtagattaggtctataaattcatcccaatgtctgagcagcttacagaacaagtcttcggattgcactggtgacccagctcatcccctctttctctcttgtagttctcagaataactgtagaatgtgctggaaatggaacattctcagataaggaggaactggccagatcaaactaagctgtgttcccatccctcctgaaacaggatcttatggtgctttagcccaggacgtcaagtatcccctaggtatgaaacccagagtggagcatgctttgaaggtccctcagctacatgcagactagactgcatgtagctgactctaactgccctgggaaactatcctgagctttgacagacctgccatgaatcttaagcttttattgtcccttgctgcctatctgtgaggaataaagttgcttcacttactttgctgtgtgattgttctgtctcaccagactcatgcgagaggtagaaactgcagtcccaagatgcagtgggcatgatgaaactgcttcccacaaattactgagcactttatttttctcctaaagatcaatttagtataaaatatccagaaaagaaatttcacatgcttaatttagcaataatgtatgtccagtttgcacattgtagacactgggtattacaacagataatatataaacgtgcaaattattgcatggtactaaattcaggatttaaattaaaaaaaagatttggatataagagttagtgggtgcagcacaccagcatgtcacatgtatacatatgtaactaacctgcacattgtgcacatgtaccctaaaacttaaagtatagtaataataaaaaaaaagataaatacctcccagtagcaaaacaggacttgtgttatggtgttctaagactccatgaagaggccacttagttactggaactactggaacagaactcacaggtaacgctcaccaatggcagcaggtgttttgttttgttttcatcttattttaaaacaggataaaagggagatgttctctgtctttgatatgacagtattttaaagtgtaattaattttttaaactaattcagacttatcacttttatctccagccctgccctaacctactaccacatcattgtaagactacattgcatttatcatacttaaaaaattgttcatgcgtctataatagttgaatctaaattttggagcaggagtatagatagagagataaaagcattttctctgtagcaaaaactttgttgggaaattcttcaatggtaactaaaaaaagtaaaaaataaatgttttctctccagtacaaaatgcaattaaaaaaaaaacaaaaaaacaaaacagatcacacagaatttcatactccacttgggccctcctctattgcctggcttctgtagagaggaagcaaacatttgttccctgtctgtagaaggagaacccaaagtcataagcagtcaaatcaaactgcagaaataacggccctggaagatggttatttggtcagatgacatccactcacttgaaaactgaacttgtagcttcactgtgaaattaacttctgtccttttagtctgggcc

(The sequence listing continues in the following parts.)

What is claimed is:

1. A method of treating a condition in a subject in need of natalizumab therapy, comprising: administering a therapeutically effective amount of natalizumab to the subject, wherein the subject has a decreased risk of progressive multifocal leukoencephalopathy (PML) due to an infection of the brain by John Cunningham virus (JCV), wherein the subject's decreased risk is associated with an absence of one or more genetic variations in the subject, wherein the subject has been tested for a presence of the one or more genetic variations with a genetic assay and has been identified as not having the one or more genetic variations, wherein the one or more genetic variations disrupt or modulate a gene selected from the group consisting of homo sapiens chromodomain helicase DNA binding protein 7 (CHD7), homo sapiens interferon induced with helicase C domain 1 (IFIH1), homo sapiens immunoglobulin lambda like polypeptide 1 (IGLL1), homo sapiens mitochondrial antiviral signaling protein (MAVS), homo sapiens phospholipase C gamma 2 (PLCG2), homo sapiens SHANK-associated RH domain interactor (SHARPIN), homo sapiens T-cell immune regulator 1, ATPase H+ transporting V0 subunit a3 (TCIRG1), and any combinations thereof, and wherein the one or more genetic variations comprise chr8:61654298 T>A, chr2:163136505 C>G, chr22:23917192 G>T, chr20:3846397 C>T, chr16:81942175 A>G, chr8:145154222 G>A, chr11:67818269 G>A, chr8:145154824 A>C, chr22:23915745 G>A, chr20:3843027 C>A, or any combinations thereof, and wherein chromosome positions of the one or more genetic variations are defined with respect to UCSC hg19.

2. The method of claim 1, wherein the condition is multiple sclerosis or a relapsing form of multiple sclerosis.

3. The method of claim 1, wherein the one or more genetic variations have an odds ratio (OR) of 3 or more, and wherein the OR is:

$[D_D/D_N]/[N_D/N_N]$, wherein:
- $D_D$ is the number of subjects in a diseased cohort of subjects with the one or more genetic variations;
- $D_N$ is the number of subjects in the diseased cohort without the one or more genetic variations;
- $N_D$ is the number of subjects in a non-diseased cohort of subjects with the one or more genetic variations; and
- $N_N$ is the number of subjects in the non-diseased cohort without the one or more genetic variations, wherein the diseased cohort of subjects have PML, and wherein the non-diseased cohort of subjects do not have PML.

4. The method of claim 1, wherein the method further comprises testing the subject for the presence of the one or more genetic variations with the genetic assay prior to the administering.

5. The method of claim 4, wherein the genetic assay has a diagnostic yield of at least 20%.

6. The method of claim 1, wherein the one or more genetic variations comprise chr16:81942175 A>G.

7. The method of claim 1, wherein the one or more genetic variations comprise chr8:145154222 G>A.

8. The method of claim 1, wherein a first genetic variation of the one or more genetic variations disrupts or modulates a gene selected from the group consisting of CHD7, IFIH1, IGLL1, MAVS, PLCG2, SHARPIN, and TCIRG1; and wherein a second genetic variation of the one or more genetic variations disrupts or modulates a corresponding gene according to Tables 3 and 6.

9. The method of claim 1, wherein the one or more genetic variations comprise chr2:163136505 C>G.

10. The method of claim 1, wherein the one or more genetic variations comprise chr8:61654298 T>A.

11. The method of claim 1, wherein the one or more genetic variations-comprise chr22:23917192 G>T.

12. The method of claim 1, wherein the one or more genetic variations comprise chr20:3846397 C>T.

13. The method of claim 4, wherein the genetic assay comprises microarray analysis, PCR, sequencing, nucleic acid hybridization, or any combinations thereof.

14. The method of claim 1, wherein the subject has been tested with a JCV-antibody test.

15. The method of claim 14, wherein the JCV-antibody test does not detect a presence of JCV.

16. The method of claim 1, wherein the subject is identified as not having one or more other genetic variations that disrupt or modulate a corresponding gene according to Tables 19-24.

17. The method of claim 3, wherein the diseased cohort of subjects, the non-diseased cohort of subjects, or both cohorts of subjects are ethnically matched.

18. The method of claim 3, wherein the one or more genetic variations have an odds ratio (OR) of 6 or more.

19. The method of claim 1, wherein the subject has been tested with a CD62L test or a CSF IgM oligoclonal bands test.

20. The method of claim 1, wherein the subject has been identified as not having one or more other genetic variations that disrupt or modulate a corresponding gene according to Tables 3 and 6.

21. The method of claim 1, wherein the one or more genetic variations comprise chr11:67818269 G>A.

22. The method of claim 1, wherein the one or more genetic variations comprise chr8:145154824 A>C.

23. The method of claim 1, wherein the one or more genetic variations comprise chr22:23915745 G>A.

24. The method of claim 1, wherein the one or more genetic variations comprise chr20:3843027 C>A.

25. The method of claim 1, wherein the condition is Crohn's disease.

26. The method of claim 4, wherein prior to testing the subject for the presence of the one or more genetic variations with the genetic assay the method further comprises obtaining biological samples from subjects with PML and confirming each biological sample is not a duplicate of any other biological sample based on nucleic acid information of the biological samples.

27. The method of claim 4, wherein prior to testing the subject for the presence of the one or more genetic variations with the genetic assay the method further comprises obtaining biological samples from subjects with PML, determining a sex genotype for each biological sample based on nucleic acid information of the biological samples, and confirming the sex genotype of each biological sample is the same as a sex phenotype of the subject with PML from which the biological sample was obtained.

* * * * *